United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 16

SEQ ID NO: 55249 - DNA, 565 bp, Triticum aestivum
  Clone ID: PAT_TA_55249
ggcgtaaataaaccccagagaaagtttttcaacaatatggagtaagaaaatacatcctttggataagaacatttggactacataattgaggtttgacagctggtacaaggcacgattagtaggaatgtttgagtgaaatcgactgatggcttttaactttggaacgctggaacagaataaatgttgaatctccagatgcaggccttgcgagcaccgtgacttcttcacaggaatggaggaagaatcacccatcggcgggggtacttgggccgcccgtccttaccgtcgaagagcttcctcaggcggctgtgctttccgagcgcccagttggtcatgatagcagcggccacagcgaggaagacgtagcccgccacggtctgtgtggcgatgttgaaccccagccattggtagatctcggtggtgtagtttgcgcatgtcacaatgttgaacaggaaaccccgtgggatctggtagccgccgctgccggtcgggctcctgaggttcctcagcaggatgtggcagtaagagtttgcgatctggcacacgaccccgatgccgaacccaa

SEQ ID NO: 55250 - DNA, 630 bp, Triticum aestivum
  unsure (1)..(630): unsure at all n locations
  Clone ID: PAT_TA_55250
ggtataaactgaagagtttttgtcagcggtattagtaaacaaacaatgtgagaggagtgaccaagcagctcgcggaaaacatacaaggtacagaaaagcaaagctcaacataaccggtgggcggtcggaatttcaggaccaattacaacatcatcactgtcgccacggcggtgccagggggccgagccacagaagtgttgcgccggagactccaggtatacgacgccagtcccttttgtgttccctatcagagtgctggaaacatctgacgagaacaacacacattgagggttatggatgatgattagttaccttgtagtagaccaaacagacagcagcagcagcaaaagcagagagaacatattcctacttcatagacaacacggggggcgactccgggacattgcgggagtagccagctttgatctacttgagactagccttccaagcatacacaactaacctgccacgagcctttctggtctcaaactaacgagctcgccagagagagttcatgtatttcagtcagcgtccactcctctccagtttgtcctccaagaactattgcctttgatccttccatgacacatgtactgtgtncncatgcaaacctcggaggtcgccctggga

SEQ ID NO: 55251 - DNA, 459 bp, Triticum aestivum
  Clone ID: PAT_TA_55251
acacaagacacgcccaatttttttttttgggaaaaaaacccccaaacctgttctttttggaccgacccggaatcccctgatattctaaaacggggaaggggcttagattaaagccccgacaggggaaggcgccgacatgcaatgcctggggggcggaggcaaaaacgcgcgggggaaaggttggagcccccaaagggggggaggggggacaggagccccccggggggggggggggggccaaaactaaggcgcacgcggggggggggggggaccactaaattacagcgggggggggactaaaaacaaggtaggaaccgggccccgactcaacgctgggaaagaagggcgcccttgggcacccacgccaacccggggggcctggggcaaagaaagatttccggggggttcggggtaaacaaaagattcgggcaaggttccgggcctccaaaggaccggccc

SEQ ID NO: 55252 - DNA, 507 bp, Triticum aestivum
  Clone ID: PAT_TA_55252
gggggaaagggggcgcccccgattttttttttactggccttgggacccaacagggcctgggcgaacaaaaagacagaaaaaccctgggatttaattttccatagggggaaacatgaacctccaaaaaaaacctgggggaaaccccttttggaaaaaaaaaaaaacattgcccaagtgggggccaaattgccccttttgggaaaaaggctgggaggggaaaaccctaaaccccaaactggggacattttttttttgcaaaacccttttgctaaaacagggttacccttttgcggaaggtttttttaatttttttgggcggaaacctttgccccccaccaagaaaaaaacccggggggggcccccttgttggccattttgaagaaggtggacacagggttggcccccttccacccaagcacggggccagggaggcctccaaacccggggggaaagaaaaaacccggggggtttttggagtacttggagggaaaccccgccagggggggg

SEQ ID NO: 55253 - DNA, 659 bp, Triticum aestivum
  unsure (1)..(659): unsure at all n locations
  Clone ID: PAT_TA_55253
gaatcagaaaaggtatattcatatgagttaattcagcgcaaatactcagcatagcagcgcatcaaacgtgcacgggtcatcgagcctactacagtctagaggcgtgtaccacacctagctataggtagctagctagctagcttggtcgacaggtagcctagcccggccgcttgattgatcacacatgagccggggcgtccaacttgtcgaagcagggcacgtcggcggcggcgtagtcgcccggcccgacggcgatggtcaccggccagcattagtacgtggtgaggacacttgtggtggacatcgccacgtgggtggacaagatccctctcagctccatctccgcgccggccacgccgcgcccctcgtatagcgcgcgcacgtaacgcatcggtaggtcctcctccggcaccagccacaacggcacgagcacctcgctcaatgtctggtgcgtcacgtcgatgggcttcggaaggtcaaactcggcgatcctcgctgtaggcgcctccgccgaagaagatgacgacgactcgtccgtgagccggacggcgacgttggcgtactctagggtggcgcgcccgcttgggttgtaggccctgaggacgaacttgagcgacaccttgttgcccggnggtggcagcgacggtatgtagttggca

SEQ ID NO: 55254 - DNA, 648 bp, Triticum aestivum
  Clone ID: PAT_TA_55254
ttttttttttttttttttttttttttttttttttttttttttttttttttttttttttttttttttttttttttttttttttttttttttttttttttttttttttttttgggttccccggggaaaagcaggggcccttttggtagttaaaaacaaaagggaaccggggggccaaaaacgggttaaaccaaaaaaaaaggggggcccggtgggtttaaaaccaacacaaagggcgggcccaaacgaaaaaacaggtaaaaagaaggaagggggccccccaaccgggcgaccaagggaaaaccaggggggacaacgccgggaaaattactgaccaccacggggggggggcaccaggggggggggggaccccttttggaaggtgaaaccccaaagggggggggcatcctccaattggttggcgggaaaaaacaagccctgttggtccgggggaaagccccccttggccgggaacttggccttgaaaatggggaggggggaaaaactctcaacccccaaagggaagggcttgccgggggggggtttcaaaaaaaattggatgcccccacccaaacccaggacaaggggggggggggaccccttctggatggtgaaaacaaggaggggtcggccattctccaattggttgcc

SEQ ID NO: 55255 - DNA, 174 bp, Triticum aestivum
  Clone ID: PAT_TA_55255
gggcggccccccttttttttttttttattatcattgaaagggcaattatatatctcttctgtgcccacatcccaggatcatgacacacattcacagcgtccctaattcatgaggccacactgcaagaggatggcccctcccccacagatggggagaagaggcacatatatttag

SEQ ID NO: 55256 - DNA, 457 bp, Triticum aestivum
  Clone ID: PAT_TA_55256
gcggtaaaaaccgcgctggcggaatttgcttattggccaaggcaaacgacaaacacagagggttgggatgcgaccttcccaactgacgactttcttaaacccgccccaaggttgcgtgactctttatatctcaaaaaggtgaacctattgaagtggaaattgatacaaacggcgaggaattggcagatacaataccaatttttgcccagcccgtacatttacaccttttgcgcaattatacctatcttactgcacgtataaccggataccatcagccttttttttgacaaatatacggcagaggatcatcacctgtttgaccccggcctgaaacaatttattctcacacaaccgggtagggggtgaagcaataaatatctcctagggcgatgttctgcaccacatttttgtaggcgtaattgcactacaaacttatcctctcgatcgcgaaggcgtt

SEQ ID NO: 55257 - DNA, 405 bp, Triticum aestivum
  Clone ID: PAT_TA_55257
attctggggaattacatctgaattattctattggccaacagctgctggtgtttatttgaaacccaatgtactaaccagcaaattgtttttttacttactggacactcccctgactgactgactgactgcaaaggggggttgggtgcccattcccacccctccccattttattgcacatacacaaatgggacactgatagtacacttttacacaaacacatgatacaaatatccctcctgcaaaaaacacgggtgggcgactacctgatccaggccccgaggcctgacccgaaacagccattaagtagcacgacgcccgcccgcctgcctgcctgtttaccctacgcgccgtggttccgggctttaacggaacgaaaacccgatctcctcgaggggtcttcccttg

SEQ ID NO: 55258 - DNA, 234 bp, Triticum aestivum
  Clone ID: PAT_TA_55258
atattattcaactttctaacttctttcttaagggaacagaaaccaggcatgagcaccatggaaatataaggtgtgcatgagagacaaaaaccatagttgtcactgagatacaggaagacagagtacagcccattcacatggtttgcagatcaaacaaaatcacttgcactcaagcaggctttatgagtctgaacaagtgaatctagaaccgcactgcggtaacagcaataccct

SEQ ID NO: 55259 - DNA, 508 bp, Triticum aestivum
  Clone ID: PAT_TA_55259
aacaaaataaaattgatttaccccttgggggggcaaaaacagatagggaacgagggacacttttatcgcacaaaaattacaacaggtggtgtgccaacaaacacaagggaacaagataagcctcttttttacagttaatcgtgaatggggcatgcgggataatattttgcaacaatacaaacaaactttgggaagcttggcctttgaccttttaaaaaaggatagggggaaaaaaaaaataaccttttttaaaaggccttatttttatgggacaggtacaggccaaaacccaaccttgggcaggccttgaaaaacgcggccttttttggaacccccacgggggcctcaagcccggcgtcgctaaaagatgctgttccaaggggctcccaaaaaacctccccatttatccctcaaattgggacgcgaaacaccacgggcaccttcccattggcggtgaaaaaaaaataacggaccttttcgcaccaaccgggggcgtaaaaacttaaca

SEQ ID NO: 55260 - DNA, 154 bp, Triticum aestivum
  Clone ID: PAT_TA_55260
gtctgggaaaggcatttttatattccttttgtgccaacttccaaggatcgtgaggctcattcaatgtgtccctatattcatgagcttctctgcattgaagagggcccctccccaacagatctagagacgaggcacatataattaggtaaggatc

SEQ ID NO: 55261 - DNA, 255 bp, Triticum aestivum
  Clone ID: PAT_TA_55261
gaaagttcaacatagcacaatatattaatagcagatctgtagcatctcaggtatctaacaagatccgatccaatccaggatcgatccgaccacataacattattagacacagatcagataaaagatcaccacccagggatcaagaactcaaccaccaggattcaaaaaaaaaaaaaaaaaaaaaaaaaaaaaaaaaaaaaaaaaaaaaaaaaggggggccccacgcgtccgcggacgcgtgggcggacgcgtggg

SEQ ID NO: 55262 - DNA, 559 bp, Triticum aestivum
  unsure (1)..(559): unsure at all n locations
  Clone ID: PAT_TA_55262
ttnttttttattttttattattttttttttattttttttattttttttttattttttttttttttttttttttttttttttttttttttttttttttcccccccccactttctgaacattttttcaaaacaaggaagggggggaaaaaggaagggcccccgaaaaaagaaaagaaaaaaaaaagggggcccggtttatggaagggaagggggggggaacaaaaaaaacaatgggtgggcccggacccccgggaaaaaaaaaacaaggaaaccccggcccgggggggacccggtagggccacaaacccgggaccatcaattcatcaaagggcggggccgcaccccccggggaacccctgggggaacccccagccgcgggggcaaaattggaaggaaagggaattgccccccgcccaggcaaagggtttgagcccccccccgccgagcccggggggaaaccaggggtctttgccgggggggaaagcccccttggggggggccctgggggggacccacccgggggcggggggggccttgaaggggacgaaaaaggggggggg

SEQ ID NO: 55263 - DNA, 536 bp, Triticum aestivum
  Clone ID: PAT_TA_55263
ccagctgcaaacaaagaaaccattccatcgatggggggcaagacactaatccggggatggcataaaaaaaatatgggtatgtatagccggggctataattctaatatgcatcctcctcgacctacgtgggggggggcttacatacatatgctcatattttcacatatgagtagaacgagaagtaaaactgaaaaagcagagctgccgacaaatgggaattaacatgacatgtttatcaattatttaaacttgcactttaggccttgccaaattcctcgcaacctgggggcctgaaggcaatgaagctgacccactgcacttggcgcatgttgtcaaacccgatgacccggacataggcgtgggggtactcctttttaacctcctccacctcgttgagcacctgtgtggggtcggggcacccaaacataggcagtttccacattgtccagtatcgaccgtcgtagtacccgggggagctattgtgctcacggaaaacaaagccaaccttgctgaactcgaggcagggtacccacttg

SEQ ID NO: 55264 - DNA, 448 bp, Triticum aestivum
  Clone ID: PAT_TA_55264
gggacagggaacggggccaaaaagacccaaagcttttattaattcccaaaagttataggacaaagctcaaacccggactcaaaggaaaaaaaaaccaccgcaaaacccctgaaacttaaaaggggggccctttccaaaaaaaaaaaattacaatcaaggccaaaaattaactttaacaaaaaaccaagcctgccataaccggggaaaaaaacacttgggaaaaccggaaaaccaccactccattttcgggaaaaaaaggaaaaagaaaaccccctacccaagctgaaaagctgcccccctaaagggaaaaagccgggaggaaaaaaaaaaacccgggcaaacaccatgggtttacggggcccccattttgccaaaaagggcgtcggaaaagggggaaaaacccacagaaacaaggggggtcgtaactccaccccaggcccccacgaaa

SEQ ID NO: 55265 - DNA, 562 bp, Triticum aestivum
  Clone ID: PAT_TA_55265
ccataaacagggggaaaggggccccttttcccactttccaagaaaacaaatgtttccaactttaaagggatccaagactgtcccctacaaaaaactgtccattgaaccctgaccattgttagcttgttcataaaaaaaatatccacacaattttttgcacaatacaaggcaaagggggaaacataaaagtacaaaaccttttttgcccttgtcctgctgcccaaagtaaacaaaagcaaaaaaattcaaagagctggggccaccaatgacccaaaaaaagcggccaagggggccttaattcaggttgtaagaaatccaccccatttgctccccccgcgtggaaaaataccaccccagggtcagtttaaacaacctaaaatagcttccaagcaacacggtgacaagggcaaaagccaaccacaggcttttaatggaatccggaaactggttgaaaaaaaactcaccctgcccgatggacgtaaacacctcaccgacaccgatcaacaggtcccgaggcccttgccaaaaaatgctcatggaaacaggcaccttttgatggacc

SEQ ID NO: 55266 - DNA, 491 bp, Triticum aestivum
  Clone ID: PAT_TA_55266
gggaaaaaagggcccccccaattttttgggggggaccaggggtataaaaaaaatttcccccaacaaaaaggggaaacggggccgaccagcccaccccttcctttcccaaggggggagttttccttggcccccgagggttttccttttgggggcgggactccttctttcccaaccaagaccaatagggggggagggttgaaccaggctaccaccgggaactttgggggttttggggaaaaatttaaacaccccgcaaaaaaacaagggaacccttcaggggggggccttcccccaacaatgggggaggggaccccaagggcaaaaaaagggggggaaaaaatttaaaaggggcaacaggggcccccttaaaatttataaaacacgggaaagcaaacccccccccggggaaaagaagggcccctcaaaaaagaccttcatggaagggggcaaaagggggggaaaaaagctttggggaattatcgaaacttttt

SEQ ID NO: 55267 - DNA, 252 bp, Triticum aestivum
  Clone ID: PAT_TA_55267
gtggacggcctttccttttttttttttttttataattctgaggtgcattgcactatcatatagcccgagacgccagagctaagataattgtacagacaatcccactctaatcattacccttacggcagtattatgctttacgttaacacgaagagagcacttaaactgctacgcagctatgaacccatgatcctctatgtgctgagagcatagcccgcatggtctgacatggggattctgggaggagcattt

SEQ ID NO: 55268 - DNA, 586 bp, Triticum aestivum
  unsure (1)..(586): unsure at all n locations
  Clone ID: PAT_TA_55268
aaacctgccggtaattcggtggattattcagaaaccttacaagtttacaacccagcagagcacgaacgttccacttccactacagagccaagaattctcactgacaaggcattacggacaatggcagcactatctaactttacaaacttagaacaagtttacagagagattaatctgggcaagctccacccttcccttccccttccctgccagataaataatctaagagcgcctgcggcgcttattgcagcttcaggctgagcaagggcaatcagtcaatggccattggttaccggagtggcggcagcgtcgcctttcacggcgtagaaccggcggtacatggagtcgacaagggtgaggtagtaggtgcctgggacgagcaagcgcgtgtcctggctggtgacgaagtccttggcgccgtagcggtgctccatcagcttcagtgcctcgacgaatttcttcggcggaaccacatgcctagactccaacttngtggagatatccagtatgtttgcaatgtttgataggctgaacggatgctggcattcgttgattttgagggagacattgtcgatgtcatgccact

SEQ ID NO: 55269 - DNA, 419 bp, Triticum aestivum
  Clone ID: PAT_TA_55269
agcagcatgtttttgcttattattcacatgaggatggacattgatcgacccctggcccctgctaaaaaaaagttccaactttgtttgggggggcttcctccagtttgagcaatgaaatccctttaaccccgaaaaaaaaaaagaagttccaacttgagggatatactggtgctactaggagggagctacttggggggttgggagggcgcctcgcaaaactcgccgccaaaaacgttgcacgccttgtccgggaacaccgtttttggctcgaggaaggctaggtactcccttttcaccttcggggccctcgccggggaagttgggccgacggagccagcaagaaacttaagatacgggtacatttggacgtagaaagcctcaccgacggccaaagaaagagacctgcgtggggaacaccg

SEQ ID NO: 55270 - DNA, 264 bp, Triticum aestivum
  Clone ID: PAT_TA_55270
ggcaccaacaaaaaaaggcgcagcccggggattaaaacaaaaaggaaacaagggataccggagtatcacctaggaggcaaaccccctctctttttcccccttcctttttaaccttttaacacccatgttttccttaaacccgaactaatataagggggacaaccctccaaaccccacaaaagggccatgtaaaggtggaagcaacagggtttacttctcgggaccttcggtcgagggggcaatcctgataacaaaagggtgatg

SEQ ID NO: 55271 - DNA, 562 bp, Triticum aestivum
  Clone ID: PAT_TA_55271
gatcttaacggcgcttttttttttttttataaaggccagggactttttgaaaaacgacgacggaacaacggactaaccggcttattatggcatgtaggcgaagccgactcatcggaaggtcagcgctgccagcctagattcgcctgattaggaggtttgatctcccgggagttaccactcttgctccaaccacctgttattctttcgaacagctccggctccacgcatgctccgcgtagctcgccaggcaccagcttgccgtccgagacccgcaccggcaacttgatacagcccacgaacgacattgcaccccgacacccggaccttaacacacacggtgacgcccatgaactccactgtgcagctccgcctcgggggctcattgcagccccggcaacccgacaccttaacgcacacggcgaccctcggagcttattgcagccgggactccggagcgctcattgcagtcggggcgctcattgatggacgggaatttaacgacccgcgaccgtattgaccccgcgactggcgggcttaatcacacagcgatgctcatgcacat

SEQ ID NO: 55272 - DNA, 380 bp, Triticum aestivum
  Clone ID: PAT_TA_55272
aaaaccacggctggatttttatttatacggaaacgcaaactcggggttcagatttacggggggaatatttacagattaacaaagaagctggtccttcataaaagggaactcttattcaacaaaaaagcgggatgggcttaagggggggagcttgactacttgagtatgatttgttcaacaggggccgggcatcagggggatggcatccagctgctaacacttgcaaaaacaaaagcgtttggggggggacggccaaaggggcctacccatggaaatgccaagaagccctataaccatgcgggcaaaaaattaaggaataatgaagccgcgggatctaatttaaaatacagcgtccgcggacccgtgggcggacccgtggg

SEQ ID NO: 55273 - DNA, 424 bp, Triticum aestivum
  Clone ID: PAT_TA_55273
aaaacaaaaaatcccccttttttttgaacaattttggggccagatttaattcaggcgggtacaaaaaaggggggggctttggccaaagggaaacgaaaatcaactcatcgccaaaggaatacagggggtgggggttaaaaaaaacaagggtttatggcccggaaaagcaaaaaaaaccccccacctccaaggggctttttttttaaaaaaagcccagctaggagtacatgggttcgggggcagtttaaaagaaaaaaacattttgccatgccaaaaaagtttttaccctccctgagatagaccaaccttttaatccatgggcagaaacatcctcaatcaggagcaacttttttccttgccgcccttggattatcatactcaaactggagcacattttgaatatgggaagtatccttgatataaa

SEQ ID NO: 55274 - DNA, 546 bp, Triticum aestivum
  Clone ID: PAT_TA_55274
ggttcgaactacatataacatttttttttttgcgacccacacattcaagataacatgtaagcactacatgtgtcttaacagggaaacagcttttcaactggctttaccggtctggatacatcttacttgacttgaaccgaagcctgggggacgagcggggccctacagacttaaaaggaaccttagaggtgctgctcggctacatgaaaatcctgacctttttcccatggtcttggcggccaagttgcaggtgaacttggggcggacaacgccgccgttgccgagggggcgggagaccttgaccgagatgcaaaaccattggctgcaagagctcttggtgttgtccttgaagacccccgccatccttttgtctccggaccagttcatgtactccctgttgtgccggaagcattgaacgatttgtgtgcctattcctggaacggccatgggaatatttgaccgttacctgcaggtggaaaacatttacatatagcgagtcgggttcgatcttgatgacatggtaatgctacctgaattctgcgggaa

SEQ ID NO: 55275 - DNA, 536 bp, Triticum aestivum
  Clone ID: PAT_TA_55275
accttaacgaacaataagcagctcttattaacacgagcagccaaattacagttctacgcagccacccttactgaaaccaccacagctctagcaaatgttaaaaacgggggcatctggaacacagttttttatccgagctggtggcggcgtccaacctaacactttggcacctcaaaatctggcccagcaggtattctgatccttattataaggtttcctaggacatttacaaaaaaaaaacagagaacctttgccctcttgcaggccaaaccattgctctttgtgccaccaagtctccacagtattaaacccttaagaaaatagatacgaaggacaggagaccagcctgatgagtttttggcttactcaaccctaccccacacctgctatgacgctggataaggatagactgcacttgaccggaaccgagagcatatccaactctgcttctcaggatgaggatcagaggaaggcactccctgggcttgagaggaccactggatggattgggggcaaaagctccaccaagcttgtca

SEQ ID NO: 55276 - DNA, 647 bp, Triticum aestivum
  Clone ID: PAT_TA_55276
gatctaaaagatcttatatttctttacaaagtgagtcatgaataaagaggttattttgatgttacaaaaaaggagcatgagctcgctggggccatttcgccgctccacacaggtatgcattacatatatataccacaacatgccgaaaacaagcacttttctcattacatctatggatcagaaaaccaaaacgttcaaatctggttccctaaaaatgccaaactcctttttactagccctacaagattgctcaacttgattattattcatcagagccttgtgtatctagatacgtcagtggtcaagggggcttcatatatgtagccaggccgacgacacttccgaacaaggggcatcatatcagcatcacgtacgtcatctggatatagccacttcgtcttgggtaccggccatctgttttccttgctcttgttttgattgctcatgttttgttcgcttgtgttgataacttcagcactgatagttgcacagaactgaaaaccactgcctggccttaggacagataccgtaaaatgcattccttcaccatgtcgtaaagcactctctgccttgtccaaaatcagctcatggaactcttgtgcattggacagcgcaaagtcatcaagcttggaaattacatcgccagc

SEQ ID NO: 55277 - DNA, 635 bp, Triticum aestivum
  unsure (1)..(635): unsure at all n locations
  Clone ID: PAT_TA_55277
gaattagacacaccaacttttgagatgaagacgattagtttgaaagcgacaggttttaggcaagctggcttccaagcaggaggtcagcctggacacaatgaaccatacagacagagtacatcgacgcaggtggtaaactgctgaaaccaaacacttccagttttcaccacatggataacagagatacaggccaattcatcgcagcatcattaacagagatcacttcccgccaaacaagtagcccagggacgagccaccgccgggagcagcatgaaccttggttgaaggacggtccgtaaggaagttgcccgtgttctggccatctgcacggtagtagttgttcgcccggctacctggaatgccagctggaatctgcttggttacatcggcagctgccagtgctggtttctcagcaggtgctggcttcgcagctggtgctgcagcaggctttgcaggctcaccatctccaaacaggtaacccagagaactttgaccacctccagcactcccgccacgactcatcttgactgtaagataaataggtaaagtgcaacatatgagtgaacaagttcaacatgattgtcagagtgcaatacattaagaaacagncaatgaaatcatcagggataaaagtt

SEQ ID NO: 55278 - DNA, 498 bp, Triticum aestivum
  Clone ID: PAT_TA_55278
ccagcagcagcttacgtaaatccttaaaggtcatagaggcatgttggctacacttctgtaggcggagaggggacccttctccactgctaacactggctaccggcgagctccaaaaacagcagttaaaataacacatttgccctaaatctacacttggggggaaaaaaataggttccaggcctaatcacggttaactcaggggctcaacagcggttctaaaaaaaaaaatgtcccccttgtcaacggaaaagtacaggaagcctcctaaggagggagggacgtaggacccaaagcttgggccaacaatgcagggccaagcaggcccgtatgtcgggtcaaattcctttttgagcgcaagcgcaaggcgcttgctctcaaggcgcggcgtgaaaaggacaacctcccgggcaatccaaatcgcccgccgttgcaacgccagcggaatgtccgccgcgcgcacccgaaccgccacttttttcccctccccggtcggggggt

SEQ ID NO: 55279 - DNA, 140 bp, Triticum aestivum
  Clone ID: PAT_TA_55279
atgtcatcatcaagaagcttaagagtgtttgaggagcgcttacaccagtcactcggtcccgacgaggcctggaccggcatcttgcagcggtctcatatcttaattattgcttcttcttcagtattggctgtgcatacatt

SEQ ID NO: 55280 - DNA, 422 bp, Triticum aestivum
  Clone ID: PAT_TA_55280
ggggcctatcaaacacatttgaaagggaaacgaaaattggcggcaaactcggttcccccggcgggggttcggacagaacccacggcccaaacaaaaccaaccgggggggccctagaaatgaaagacgggccaaaaatctcacaggaccatgtctccggcatatacaggaataagaagccaatcaaccctcaaccaacaaggaacccttcacaacaatgaatggggggacaagattaccacaacaacttttttttttcctccgggtccgcttcctttttcgcctcgggttcctttttttcctctgccgcctcctcaaagggctttcctgggacaagctttggaacctcgtcgtcgtcgtcctgggcaaaaccgatgctggcgcccccagcctcaccgccaggcatttgtttttgaaactgctc

SEQ ID NO: 55281 - DNA, 602 bp, Triticum aestivum
  Clone ID: PAT_TA_55281
ggccaaaaaaacattgatgggttccgggggggccccattaaagcagaaaaaataggctcacaagggaacccctaaagcaggacaaaagtttttttttccgcaagaggagaacaagggaaaacatcacatccattttttaaacgggataaggaagcatttaaatgggaaaaactactttaggagcctcaaaaaaaaacccccccaaagccaaacctttttaaggggggatctccaccccgccggcggcaaactccggttgaaaaaccttggggtccttgccggcaacggggcaacccaccctgacccaggggccgaggatctccttgacggggccggccatttccttggccatggaggggacctttatgaacttggggaactcaaaaacctcctcaagggtgaagttgcccttgggcttgaagtttttgacctttttgggggccctttggggctccttgaaccccttaataaccagggctgcgggggaggggaccacggacaccttggcctggggaatttggacggggagcttgacggggacccggaggcccttccagtccttggccggttccttggggaaggcttctccgaacttttttggg

SEQ ID NO: 55282 - DNA, 537 bp, Triticum aestivum
  Clone ID: PAT_TA_55282
ggagcgcactattttttgaaacggagaaagtttgagacgcaagccaatcggtcagtcatgttctgggaaattcaggcacaagaaacattttttagtaaaaagggcataatgcatgttcttcaaaatctcattaattcatcaaataacggcctcgggtaaaagaaacttgcatgcccattgctccctgaggaccctgcttttccttatacgcaacccatccatccactgccaaaagagagcgcagggggcatcaaacaagtaaaaccaggtacactgcatttcctcactctgccgatggttttgcatcatcatccatttgatcatctccaggaagcccaaatatcctcaggttacggtccataaagccgacggcgatatatttggcatcagtgccaaactttgcagagggcactttccctgttcctgacaaatctggcaaggtcttgataagattccattccgtcttgacattggctacttggtaaacccttatatctgaaccagcaacagcaagataggtcccgctaaaatcaaatt

SEQ ID NO: 55283 - DNA, 521 bp, Triticum aestivum
  Clone ID: PAT_TA_55283
caaagaccaaagcgactggttaaggggaaaacgtggttttggaccatatttcgattttaacagattttaactggaaaggagggaatcagggtttttatccctaaaacttatgacacatagagttgggatgtagctgaaataggagggaggggctggaaaaaacacatccatgaaactacctttgcatccacagaacattcctttggaagggttgtttatggacaattaaaaaaccacatgcatggggggacctggccccatccttttgggggatgtcataagacgaagagcaccttagggggtttaaaaaccagtttttttatgcatggaaatcacttgcagctgccagttttccccaaagcaggaaaaaggggcaaatgttgctgccttagctcccgtctaaagcagggatgaaaagtcatgaatcctccattctaaatcgggaacgggggtctttccaaaatcctgcatcctccattaagaatccggaacaacatgggcttttcctagcagggcacaaa

SEQ ID NO: 55284 - DNA, 429 bp, Triticum aestivum
  Clone ID: PAT_TA_55284
aaaaaaaaaataccggcatagggggagttattactttatcatacatacccaggggaattacttgtacaaaagcataaatcccagggggggggtggcctgatcacttgggggggacatataaaggctggtctaagataggatatgccttggacgcaggcccgtaagcattttcagctaggtggcagctagtaattggctaagaaaagatcgattgggtatgaaaaaaatcatgaggccccggggagggggaacatttttttgtactcaaactggggggggcctatcccccaaagggaatccgagcgagagtagtcccacaccggaaaagaaggggggggtatttttatggacggggcggggggctccccatgcgtagagaacaatgaaggcgacataccaaaagagggggctgtccatgccgaagccggg

SEQ ID NO: 55285 - DNA, 420 bp, Triticum aestivum
  Clone ID: PAT_TA_55285
cggacccttgggttttcctgttatatttcgaaccggggccggggaggccccccgaaattccgtaccgggacccgaaggggaacctgttttcctcatgggaaagcgtataaaagggggggaaaaagagggccataacagttccccgggagaaaacgggccgccggtaaaaattccaaaacccgaggggcccgaagggtaaaggggcaaacgctggggggcctaaggggagggccaacttacaataatgggaaacgggctcacggcccctttttaaagaaaaaaacctcgccggccgggaggattaaaggatttggaaccgcccggggagaggggttttaaccaatggaacccggaggagctttttttttttcccaggagagcgcaaaaaggggagggccctacagcgcccgcccctgagaa

SEQ ID NO: 55286 - DNA, 338 bp, Triticum aestivum
  Clone ID: PAT_TA_55286
gggaacaaaaacggacaattctttaggggggttttttaagcatccttcacaagggggcctggcccaaattaaaaacaccgggggaaaaataaacataaaaaccttcccgaaaaagggctcaacaagttcaaagttccacccaacacaaaaacaggggagggcatatctaatcctcctcctccccctcgttttgggataagttgaagacccggagctataaaacaccgccctccttgttggaggaaaacccccggagccagccccccccattggggttttctagggacttctttggcaagaccttaaagtcccctttgggaaaggccccatcggggggg

SEQ ID NO: 55287 - DNA, 299 bp, Triticum aestivum
  Clone ID: PAT_TA_55287
aaaaaaaattacatgcatatggggagtttttactttttcatacatacccagggggattacttgtacaaaaacataaatcccaagggggggctgccctgatcacatggagaggacatataaagttttgtctcagctaggatatgccttggacgcatgcacgtaaactttttaagttagttgggaagtaataattggctaacaaaagattggttgggtatgaaaaaaaatatgaggccccggggacggggaacatttttttgtatttgaccttgggggggcctatcccccagagggaatcc

SEQ ID NO: 55288 - DNA, 379 bp, Triticum aestivum
  Clone ID: PAT_TA_55288
atggggcatttaaacaagcccgttctgggccttggccattttggcatttggggcacccgaagataagaaccaggtggggccaacttaacccggccccccccttggggacaggaaccccgcaaggaagcccaaactttaatcaaggaactttcctttgctttcattgggcattacagaaggggggggcacaacccaacccttgggcggggcgagccttctaaccattgggcttggcctggaacgcggggaatcaacgcccttcggtagcgcgcccacgaacggtggaacaagaatggggcttggccttaaaacgccttccaacaagcccgggccgcgccttttacactggcgcccctgaaacccttggtgcgggggggcg

SEQ ID NO: 55289 - DNA, 489 bp, Triticum aestivum
  unsure (1)..(489): unsure at all n locations
  Clone ID: PAT_TA_55289
gncgcggggtttttcccggtatatttcggaccggcccgctggggggcccccggatttccctaccgggacctggaagagaacctgtttttcctttggggggtcgtttttaaggtggggaaatttttggccataaccgtttcccgggggaaaatgttctccggctaaaatttccaaaaccttggggccccaaaggataaattgaaaaacctggggggccttaggggagggcccactttcattaattgggaatccgtctaccgcccctttttaaagaaggaaaccttgcgcggcgggtggtttttttaattctcccccccccgggggaagggttttttactattgggccccgggggggttttttttttttccccggggagcgccaaaaaggtgttgcccttctccccccggcccttagaaaaatgaggcaaaaattctccttttttttggcccccggggggaaaaaactttttggggggtgggaaagggggg

SEQ ID NO: 55290 - DNA, 419 bp, Triticum aestivum
  Clone ID: PAT_TA_55290
ggaacgaaaacggacaattttttaggggggtttttaaaacatccataaaagggggtccgggccacaattaaaaacaccgggggaaaaaaaaacataaaaactttcccgcaaaagggctcaacaagttcaaagttccacccgacacaaaaacaagggggggcatatttaatcctcctcctccccctctttttcggaaatgttaaagtaccggagctcaaaaaccctggcctctttgggggatgaaataacccggggccagccacccccattgggctttttaaggaacttttttgtcaagaacttcaagaacctcttggaaaaggccccatcggagggggcggggaccttttttttgtcggggccaaacgggacggagtccccgaggttgccggccttgcccccggacacctttatgcgct

SEQ ID NO: 55291 - DNA, 252 bp, Triticum aestivum
  Clone ID: PAT_TA_55291
gacccacccacttgcatgaattatatagactacgagctcatatagccatgggcaaaatgccgacaggttaaccgcatgttaaagactgaccacagaggatcttgcccacaacccacgccaggaacgaagtcccaaccctagcgcagctgctagtccagacaaatatgtggttaactaacctgtacccctccatcgacacaaaaatataaccagacagacacgcgcgggaagccacgagagaatagccatgca

SEQ ID NO: 55292 - DNA, 165 bp, Triticum aestivum
  Clone ID: PAT_TA_55292
gtgggaaaaaaagacgggacccaaaggaccctgaggcttgattacccctgagcatggagctcccagcattttgcggacgggcccggaactaacggcaaaaaacacactgggccctgtttttgacaaagagggcccccgcaccccacaaggaagagggaggggggc

SEQ ID NO: 55293 - DNA, 125 bp, Triticum aestivum
  Clone ID: PAT_TA_55293
cagtatgaaaacggctggaaaaataactactccctccgccccataatgggagacgttttttgacactagaaaactgatcctatggttcactagcattaacaacaacaagaaaatggaatgcttga

SEQ ID NO: 55294 - DNA, 347 bp, Triticum aestivum
  Clone ID: PAT_TA_55294
ggtgttggtgtggaagcgaaccggccccgagcggggtttatcacaaggttagccggggaccaggggcggaaaggggaaccccctggggacaggggggggccccccgggggagaggacataccccccccccccctggggcccccccgccggggggggccccaacggggggccctatccgttttgggggggcagggccggggaaaggggaaaaccaccgcccgagggggaggggaaccggggaaaattctaggggggggggatggggcccttaagacccccccgcacacaggtgcaggggccgtgctgcgaaagaaggcccccgacttgtccgccggggcagccccgaa

SEQ ID NO: 55295 - DNA, 349 bp, Triticum aestivum
  Clone ID: PAT_TA_55295
gagcggcccaaggggttgacccccttttaacttaaacccccccaaggccaaggggttgtgggttaacaaggcttaaaagaggaccaggtttttcattcagtttttattttaaaccgacaaccaactggtttttggagccctatttattggcccttttaggggagccccccttttcttaaaaaaaaccggggtttgagggtgtcctgatgatttggaaaagagatgcccccccccccccgaagaccaaaaatccaagcccgattgggccaacagggtaaacatttccttttttgacggggtggggaacaaaaaccctcttagggaaatttttttaaaaaactggaatttt

SEQ ID NO: 55296 - DNA, 331 bp, Triticum aestivum
  Clone ID: PAT_TA_55296
gggacaaaaataaaggccgcccttcagctgcaggtttactgaactgcttcccaacaaaaaggcgggcaccaatcatataagtccatggggttcgggggaaaaatttttcctccccccctaaaaaaaggttctccttcgggtttttcccaaaacagggaacctttaaccccccttcctgcattaaaaaagctgatgacttcccccccctttgaatcactcggggggggggcccaaaatgtcatcttttttgaagaggggggactttttttaagaaacaagtttgtttttaaaaccccccttcttaggggggggcccagggcccccctttttt

SEQ ID NO: 55297 - DNA, 227 bp, Triticum aestivum
  Clone ID: PAT_TA_55297
agggtggatttttttttttttttttaatttttattttttgcttcggacaaattactccccccgggggggggggcccccccccacaccacccgagggtacggaagagtaccggtgggggtccattgggaacttataggaaccaaaaacacccaccgcggtaaatatttttttgaccggcgcgaattataaattaggcaacaggtttttttaaaaaaaacctgttggga

SEQ ID NO: 55298 - DNA, 490 bp, Triticum aestivum
  Clone ID: PAT_TA_55298
aaaaaccggcccccattaataattggggaactccccccaaaatcaaaatttttaaaactcaggggcataatcaaccccgaataaaggggccaaatcagtttctacttttttacataaagcggccgaacaaacaacttttaaaaaaacaaattttaatttttttggatatgggcgggggggttatttggaccctgaagggggagccttttgggccttggaaaaataaaaaaacctgcccacctccgggaggggggctttggccgcgttaagctaaaaaaaaccctccccccattcggccaagaagggagttttgggggggtaaaaaattttggaaacaaaaaaggccttggtaaccttttttcaaaaaaggaccccttccaaggaaacgttaaaaaaccccaccccgttcccaccaaaaaaaccccctcctttggaggcctcccttagggcccctttgaggaaccccaccgggggaaaaccccggtttttt

SEQ ID NO: 55299 - DNA, 202 bp, Triticum aestivum
  Clone ID: PAT_TA_55299
ggaaacaaaaaacgggtccagagggaccctggtgctggattaacactaaacatgaagcccacagttttttacagacggccccagaactaccgggaaagaacacgctggcccttgttttttaagaggggacccctgcacccagttaaaaaaagcaatggggcccttgacatcttttggacgggcgaaacttaaccgggggcgg

SEQ ID NO: 55300 - DNA, 668 bp, Triticum aestivum
  Clone ID: PAT_TA_55300
gacacaataaaatgtacttaatacatgaactcgtgaacatttgtacatgagaagttaatagaaatagtggtgaattacatcatataatttggttctatactcttgtgtatatatcctaagtgctacccctttgtgatcaactctttgtccttcgaatcgaatggcacagctactgccccttgtggaaaaagaaaggactctataatacccataaacgtaaacttataattgcaaaaacaaaacgccacaagcaccatatataaggatatattacaaaatacaatgcagttcataggctcattcttcaattgacattctggacatcaaatcaaaattatgagggtattgttgtgaattgcaaaacttctaaaccaggtgctagcctcagaacatccttcagtatgtacttggaagcgacacatgttcattaactgggggaggcatggtgtcatctgttttcaatggcctgaaatcaatccaacaagcttcatctaccaaggagataacccattaggccttttaacactctgcatcatcatcccattctgatctgtcaggctgacagtcagcgaacaatacttcagctttgcacatgatttaaggacaatctaatgggagcaatcgtagcaaagtaaatcaacagtgaaattggtggtttttgccttttt

SEQ ID NO: 55301 - DNA, 484 bp, Triticum aestivum
  Clone ID: PAT_TA_55301
ccaaaaacaaaatttttccacaaaaaaacaaactccggggggtccaggggggccaaaccccctagggggggaggggggcccccccccaaccccccggggatatggggccccaaggacaacaataccaaaccctgggagaaaaaaaacaccgtggctggggaaagggaaccaaacgggaacggggtccacccggcccaggccccggaggaagggggggctttgggggaccccccccagggccttgggggaaaaccggaagaggttgaccccccccccccgggccagggttccggccacgggccccaccaggaaccccaaaatggaccgggccccgttccgaataaaggccggccccaccgtcctgggggggttaatggacccccccgacccgggcccagttataaaaaaataaaggagggggggggcccccagggccagccctgccagttcccaaagggttcggtggcggggggaccccccggaa

SEQ ID NO: 55302 - DNA, 493 bp, Triticum aestivum
  Clone ID: PAT_TA_55302
aaaatccgacggggggaacggcaaaaatttttgggggaccaaaccgcaaacataaaacttgatttatttagggggacgacccgacccacaagggccatattacaggggggggcagaaaaggggaaaacgagggccctccccccaaaccctttggaagagctatgcagggcccattcttgagggcagggcggcaggggagggaaaacatcgccccccatactaggagcaagcctcatagttaattacccggcccattattcaaaccgggcgaggcatgaatagggaaaaatcgccgagggcaaaaccccgcagcgctgggacaacaaattcgcggggggggttcaacaagcaaaacggctcgcgctcaacgtaaaacttggaggcaaaggacagctgaggcccccccaccccgctgaagtttgcaaccttgcggagggaccccccgagggggccctgcaggttgcaattgccgctgctgccccccaaaagggcc

SEQ ID NO: 55303 - DNA, 426 bp, Triticum aestivum
  Clone ID: PAT_TA_55303
gggaaaaaaaagggttcgggccccggagtccaaaaactggaccgggcgggaaaaaggaccgccccccgggacgggggggccccccccccaacgagccagcgagctaaaaccaccccccggggggcccgggggggggaactgggaacggcccccccccctttttggccccaaattaaagccccctggggggggagttggaggggacccccctcaccaaccaagggccgccccccggacggtccccggggagccgccggcccgacttgtaacccccccccccccccttgcccaaggttttggggccccccggcccccgccccccacggggggttttttgccccccccaagggtggcccccccggtccctctggggggcccccggggaccccgacggggggcccgggaggtctttgggactgccccccc

SEQ ID NO: 55304 - DNA, 543 bp, Triticum aestivum
  Clone ID: PAT_TA_55304
gggaacaaaattttgggaaaaaaacaaaaaacaggttcagggttacaaaaaagttgaagtttttgcgcagtttaaacaacccataaacgccgttatgcacaaacccgtaggggggaaatccccccatgcaggcaggcaggcatttttcccaaaaaaaccatgaaggaacaaatacctcaggccccacattttttttttttcccgatcaagccccagtttttaatgggcccttgaggagttaatgttcagttaagggcccatacggccacatatatataggcccgaagaagcccatatttttgtgggggggcagttgcaaatccggccaaggcatggccgggcccccggccacttgttttttccgttaatggggggccccagggggccaaaaacatgaccctcctgagggggtcctgggggggggccaacccccggaagtcggccccgggggccggttgccccaccggttggggggaaacaaccaaggaggcccccgggggcctccgggccccggggcccccggggcccggggggcccgggggg

SEQ ID NO: 55305 - DNA, 490 bp, Triticum aestivum
  Clone ID: PAT_TA_55305
aaggccaaaaaaaggctgaggggcccctttgatgtttttaaaggcgcccaacaggcccttttatttttttttcaagacaaacaagttggtatacaacagcatatatgatgccccatggcattaaacagggcagcagggtcctaaccttttattacactttgcaaaaaaaaaaaaaccaaaagggggggcgttttatttttgggggggccagccgaggggtccaaaaaaacgggcaggtcctttttgacggaaaacctcaaccaccgttttttttccatgtacaccagggccgggtggagggcaaacccgacgagcaccgccaggatgctcacaaccctcaccttgaaggaagcccgccccattaccccgacaattaggataggcggggggatgatcattaggacggagccaacggggcccaacgggaaccggaaaggccgggaggggctagggggggtcatcctcagcttgaggaaggggaagaactcca

SEQ ID NO: 55306 - DNA, 490 bp, Triticum aestivum
  Clone ID: PAT_TA_55306
aaaagggaaacccccccacaaaaggaaaaaaaggggtttatgtcaaaaaaaagggtttgggcccggaaaacaaaataaagttgtttcttttggacccagttggccgggggaaaaatttcttaagggggggaaaacccccccaaaaaaatcggccccggccgaacccccaacttaaaagggaatccctggccccccccaaagggggccgggggtacccctaaggcttgggaaggccccccacccccattactggaaggggccccggtttttaaaaatttcaactttttgggaaacgtcccggaacccacccctggcccgaccccgggggcccccccggaaattccggcccggccccggagggcgacccatttttccttaaagggagccaaataaaacctgggcgaaaccagggccaaagcggttcccgggggaaaatggtaacccgctcacattcccacacaaaaaacaacccgaaaccaaaaagggaaaa

SEQ ID NO: 55307 - DNA, 506 bp, Triticum aestivum
  Clone ID: PAT_TA_55307
ggacccaaaaactaaaagaaatacttggttttttattgggagcaaacgagggggaaaaaaactttttggggaagggggggggaccagaaaaagaaaaaaaggcgggggaccacatatctggaaaaaaactttttggggaagggggggggatcagtaaaaaagtcgggggacaacatatggactcctatttttttttaaaacaaaaaaaaaacatatcttttccttttttaaaagcatctcctggggggctttgttgggggggcaaaaaatccttcagcaccagggggggcgaaaattaaacaaaaaacccctccttttgggggctacaaagggcgggaagagcaaaaaatttcttaaaagaaaacccggggcaggaaaaaggctgtcatataaaaaaaataggttctaaaaaaaattatggcgacttatcactacgggaggggcaggaaagtaagaaactgggggtgggacctaggagcaagtatatatctcaatagcagcggaaa

SEQ ID NO: 55308 - DNA, 464 bp, Triticum aestivum
  Clone ID: PAT_TA_55308
gggccaaaaaaaggaaaaacaaaaagggaaaaaggcgggggggggggggagaccaaagaacaaaggggccaaaaaaaaaccgggggggggaaaaaaacggggcccggggcaattaaaccccccaaaaaacaattgggaagctagcttttggaaaaaaaggtttatttttccaaaaccccccaattttggggaaaaaaaaaaaagttaaaaaaacggaagggggggattagcccaaaaaccccgtttaaccaaaaccaaaaaacccccgggcgaaaagcttaaacccttgggggaaagggggggggaaaaccaaaaaaggcccttgaaaaacccctttaaaaaggaaaaaaaagggctcgggaagaaccaagggccggggcccaaaaaaggcagcccaaccttggcagggatttcaccaggggtcaggggataaggaaaaacttggttggggggaaaaaccaggg

SEQ ID NO: 55309 - DNA, 720 bp, Triticum aestivum
  unsure (1)..(720): unsure at all n locations
  Clone ID: PAT_TA_55309
gccctctttcttttattatttatttattttatttatttttattttattttatttattttatttttatttttttattttttttttttttttttttttttttttttttttttttttctttttttaaaaaaaaccccccccctttttttttttttaaacccccaactggggggggaaggtttaaaaaaaagggggccccctaaaaaaacccgggggggggggaaaaacggaaaaaaggccccccccaaagggggggggggggaaccaaaaaaaaaaaggttggcgggggttggggaaaccccaaaaaaaaaaggggggcccccagggaaagggttttctttcccaaaaaaaaaaaaaaaaaattttcccccccccttgaaacccatttggccgcccgccgcttaaaccaattttgcaaacaccgggccccccccccggggggaaacaaaccccccccggtttccttttgggccgagggaacccgggggggtcccgggccccccttttcccccttcccaaaaaaaaaaacaggggggggaatgggcctccccaacggaggaaggaaaggttgaacgaaaaagggggccgggaaaaacaaaacaagttccggnccgggaaggggcggggaaacctaacccgggggggggggggggggggggttcgccaaaaaccaggggggggggcggggggggggctcgctccgcccaaaaggggggggggggg

SEQ ID NO: 55310 - DNA, 468 bp, Triticum aestivum
  Clone ID: PAT_TA_55310
ggaccggctaaaagtggggcctaaaagggccctattttatttattactacgaacacaaatttcctaagggccaaaggggttattcggaaagaataatggcggcccctaaactttaaggttaaagggagggatgctttggccgttgttaaacacgttgccagaaacaaccaccgttttaaaaaaaaccaaccgggcaaagttttttccaaagaacgcctccccccaaaaaaaccttgaaaaaaaaaccgcctgaggggacaacccaccgggagggggcgtccagttgttcacccccaggtcgagggcgaggtaattaacgtaggcaggggggggatccttggacaccaagggggccatgaacttgtaaaacaacctgagccatccgatgaactcctccgggggggccacctccgaccggtcccagttaaaaccgtactggatactggacaggttcccgggggcgggggg

SEQ ID NO: 55311 - DNA, 653 bp, Triticum aestivum
  Clone ID: PAT_TA_55311
agggtgacccctctagaaagagccacgaccgtcgcaggcacgccgtacgtaagccctggatccctctgtgccggccgcccccccccccccccccccccccccccccccccccccccccccccccccccccccccccttttaccaaaagcccccctgccttggacaaattttttatcaaccagtttttttttttttgcaaggaattttttctcaggctaaacaaaggggccaacggggttttccttccaagtccccccgaaaaaaaaaccctcccaccaaccccaagaggggcatcttttttcaaacccggtttttcctttgtcctccgcctgtaaacggaattgacaggttccccccccctctcctagtttttataaaaaaataacccgaaaagtccttggccccccccaaattctccccccaacaaaaagggggctgggacttgcccaacaaaaatagccctcatgcgggtgaccctgacccctcccacttgttccccccctttttcagttgctcaaaccccattcgggtttgggaagcccccaaaaaattccccttcctggcccgggcttttccagtaggaaaacaggggttccaaaaccttctcgatatcttgaagcttcactttgttcataaacgtttctgccaagggg

SEQ ID NO: 55312 - DNA, 544 bp, Triticum aestivum
  Clone ID: PAT_TA_55312
aaaaggccagaacccaaaccctggataaaaacagcccgaaaaggaccaggaaacaaaccggggggggaaaaaaaacccaagtccattagggaaggggccatttggaaaaaatttaaaaaacagccttaatttaaaaattcccgaacccctttaaaaacaaaaaaaaaaaccttgggaaaaaaaggggccccaaaaaataaggggggaaaaaaaaaaatccaaaaaaaaacctggcccccccgggggaggagcaaggggggaccaaaaaaaaggggggccccgccccccccccaagggacccccccccaaaaaggccggcccaagcccctgggtaaaccgggggggccccaaagtaacccctaagcccccgggagaaagggggccggcccaaaggaaatgaaacgagggggaaaagggccccacccccaaccaagggaaatcttggggggcaaacccaaagggggcggggggaaaccctctttagggagggaaaaagcaaatttttttgggcggccaagcattgggccccgggggaaacctaaaa

SEQ ID NO: 55313 - DNA, 473 bp, Triticum aestivum
  Clone ID: PAT_TA_55313
aaaaaggcgccccacaaaaaacaacagcatttttaaaagggccctttaatttttttaacctttgggggcccaaaaaagcttttacgggtacaattttacaggcaagggggcaaaagggggcaaaaaaaggggggtcccaatgggggggccaaaaacaccccaaaaccccggggctcccggtttaaaagaacccccagcccccccaaaaccagggtgggggcgggaaaacaaaaagccctttcaaaaaacaagaccccaaaaaaacaaggctctccccatttttttataaacaggggaaaaaaaagcacaggggggggttggtttctccgggggccacaaaaaaaggtaaggggtcactaaccaaaatgcggggcgcaaatgttgggggcatccctcggcccatggaaaacccaggggggccggggggaaaacccggccctggaagcggtttgttccctcccccgggagggaaa

SEQ ID NO: 55314 - DNA, 553 bp, Triticum aestivum
  Clone ID: PAT_TA_55314
gggcccccaaaaaaatgcccaacgggggcaaaacaaaaatttgaaaatccgggcaaataaaggggacaaaggcagggcacaaaaccgtctgaacacagttaaacaacaagcccccccccatgaaaatccaacaaccttaaaaaaacccggcagtttcctcacctcccaggggccccaagccttccttggacacttaaaaggcatcggacaaccagggggaaacaagggacaggcggaacgtccccatttttgtcccaaacacccccaaagggggggctgcttttgggaaaaggggctttcctttttcacaaactacaggatcgggaaccaattcaacaacccctttgtttaagcaaacgggcaatccttgtttgcccaaaaagggttccatttcatgggaaaactggtccaaagggccttcctttaactcaaccggtggaggcgaaaaacttcctggcctcgcaaaaacattcccctaaaattctcggaataatccctcgacatcatcccttgggagaattgaaaaaaacaatccaaaacccccttgaaggaa

SEQ ID NO: 55315 - DNA, 564 bp, Triticum aestivum
  Clone ID: PAT_TA_55315
ggaagcaaagcatcacgcctaaggggcgcaaaagggctgaagcccccaaaggcatttattattagggtatcacaggggaagcaataacccttcaagtctcaggctttcgcattaacactctggaagctacagcctttgccacaatagtggccaaaaaaaattagcgcacaccctcaagggggccagagctgaagtaaaccgcaaatctttcaaggggaaaatgtcaaaaagtatggggggccaaaggaaaaggccatctttttcgctgatccatccgggcggctctttttactatggggaaaccgcaacggggccctcaggaaaagcaaaaatgggcacaacaggggtatgcaattttaatggtatgtcggagccggggacctttttctttgtcgacctgctaagaaccttcctcaccttatccgaaagcacaaggatcgagtcatcttcatggcttatatgggacagggccttctccattgaaaacaggtagcccctattatccattagggccactggctgaagcaatctgctttgccatatcctccaaagcagcagggccaa

SEQ ID NO: 55316 - DNA, 636 bp, Triticum aestivum
  Clone ID: PAT_TA_55316
ggaaagatcaaacagacgaaactgaattagttacaatgttactactacaagcattcctggaggcagtaacagaaaggaacagaaacagggtaatgtaagctttggacaaaaacaacgaaggtgtcaaaagattcaagacgggcaaaacaagacgcgcactgggcggttgctgtgcgggacaacatcaaaaaaataaaaataggccacatccagggtggaagcacaggggggtaaatacagctgctcttttctcctcctggtaaaccatgaccgatctccaaacaaactgttcatccgacggggtttcccttttcacctcctgagcattgccatgccattccacgcaaggaatcaactttccttccttggctgtccactcccacgaaggtgaaggggggatttatatatccggcgaacttttcgttttgtccatttgcttctggcaagggcccaagttgtgatgcatgcgcttcagcaagcggcggaattggacatatccttcctggatctgttgtatttcatgtggctctggaccagatggccggctgcctgagcagagatgagggacagctcgccagccaggaccgcaccagccaccaccgtggcgagcagcctagcattcgatcccggggattc

SEQ ID NO: 55317 - DNA, 619 bp, Triticum aestivum
  Clone ID: PAT_TA_55317
ggacaaaaagcctcatttcattttatagtagaaaaaaacatatacatataggggccgggggaacaataaaaaaataggcaggcatgacacgtccggtctgacccataaacaaggaacccaaactcgaaaaaacagggattgggagctagctaaattagtggagggggacctttccaaccatgccggccccgggggggggttcgaaaaaaaacccgaagggcccggccccggggagggggacggaaaaggtctcgccgggggcgttgaggaactcctccggggaaatcttggaaacccccaccccggagggcacggggtcctcgtaaaacaccacgttgggggggccccggggttgtttttgaaggggagggtctccccggccttgaccctaaagtcgttgggctcaaacaccaacaccgccgccgttggcgcccagaagcacgtcctgggccatcgccgacccgcccagaaaaatcgggctcggggccatggccacggccgcgctggcggcctttttgcccagggacgcgcgcaccaccatcctgttgttgctgctggacatggggggtggcggcaaaggaagggacggacaccgctgcaaaggaaaaagcggccatgg

SEQ ID NO: 55318 - DNA, 734 bp, Triticum aestivum
  unsure (1)..(734): unsure at all n locations
  Clone ID: PAT_TA_55318
gacgtcgcatgggcacgcnngtacgtaagnncttggnnactcctctagagacgnngccgccctctttcttcttttattatttattttatttatttattttattttatttttattttttttctttttatagcaaggccaaaaactgaacgcttttttttttaatttctaggaaataaattactagcattataagccaccatactagggatgatctttttttcctgggctagggaagcagcatgtacatccacagattaacaacaggtatcacttatgaaacgttgatccgcgcaaaaccaaaaaacgaacatggggtccccactggtccaatcagtccatttcgtccataaatacacaaaactgacgcacaggggccccacgaaaactcgacagatcaagctagcaggaccatgttcagccaatgcaccaacaaggggatcgacagggcccttttcccgggacacgacgatcagacggaagggaaaaacttgttgaggttgaagggcagggagtaaaactcctcgctcctggcgtcctttttgaagctcctgaacttgtcccaccaggggtagcccctgtccttcctcaccgcgctttggtgcaggtgcatcgtgttgtccaggaagtaggccaccagccccgccacaaacggtttgttcgaaaagggcacgttgatcatgtcgttgaactgcccaaataacaaagggtcagtggtttcaaagagctgatgaatg

SEQ ID NO: 55319 - DNA, 405 bp, Triticum aestivum
  Clone ID: PAT_TA_55319
aaacaccaattttcattgcactccaaaccactggggaaaattcataaattcactggacgaaaattcgaaaccaaacacttccagcaaacaagctggcttttcctgttcacaacaagaatctatttagcacaccaagctggtaaaccatttaacatctacatcgccccatctccatttttttttttttttggcaaggaagcaacatttttttgacttcatccgcccaccttttgccctccgaaaaaacaaacttccccgtcctttgcataaagacagggcccgccctcctgacgggtacgtcgcccagtctccattttttttttttttcgggaaggagccaacatcattttgagggcgggacctgacttgatgacttcatccggccaccttttgccggacgcgggg

SEQ ID NO: 55320 - DNA, 489 bp, Triticum aestivum
  Clone ID: PAT_TA_55320
ggacttgcccttacccaattaattgtttaaaaaaaaagggtttgttttttttgcctttttaggcccacttttaaaatttggggagttttggaaacccttggggaaacaaacgatttaacaaatttttcccgccgggtcaaaggggaatccaataatccccctttttttgggaaaccccccccaaaaatgaaaaaaaaagggggaaacaaattacccatttcttttcaattcccttgggtaaccaagggtttggtttataacccgcccccccgggattttcttggaggggtgggacttctttcccttttggaaaaaaacccggccgtcctttaaatcccatttggggggctcctttggaaattactgttgcagtttctttggggagctgaacttaaaaatttgttttggggggtttattgaaaggaaataatattcctttttggtggacccaatttttttttttttaaccgttttgaagaaaagggccct

SEQ ID NO: 55321 - DNA, 465 bp, Triticum aestivum
  Clone ID: PAT_TA_55321
ccccggccaaaaaaaaaattcaagggtaaaagggcccccccccccggctccaggaaaaagaggggggaaaaaccccccatcgaaaaaaaaagcaggccccccgggcccaacaacttttggggggcccccaaatcagggaaaaacccgggccccggggcaacccaaaacccaaaaaaccccccggggccccggaacaggagggcccccccaggcccaaaaaacccccccggggggataattacgggccaggaaccgcattcccgggggcaaaaacccccggggccgccaaaaggccccgggggggggggggaggcaggatctttttaggccgggggggcccccaggggcgggaacccgcccgcccgggaaaaaaaaccgaaaactggggggggtgaatccccaacggggacccggggaacttggggctggagcattagggcaacatcttccaaaacaggttttttt

SEQ ID NO: 55322 - DNA, 550 bp, Triticum aestivum
  unsure (1)..(550): unsure at all n locations
  Clone ID: PAT_TA_55322
tgaataaaaagaaatgtatttagatgtattttagttttagatacatcattttttttcattttgattacaagtattttcggacggagggagtacgtacgaatgcgaaagattaatagtggagaccattattcaaccatgactacagtagtagcagggcaggcgaaacacaggtatcgtagctacagtggtatttattcagccatgaactcctccgtcgaacacttttcatgccatcacttcacgccaaaccgcatgcacgcgtcgcaccatcggttcgtccgccggtcggtcgctcactgtatcttgtcgcagtcggtgtgggggctgacggggatggagatgccgagcttgcagagcgcgggaagctgccgggcgcggtccgggagcacgccgaaggacgggccggactgctccaggcacctgcagagcgcgcggcgcgcgcccggcgttcccgccatcctccgcagcccctgcgcgccgnggnagcagctctcgctcgggcgccccgggacggggcccaccaggaacgacccgcacgggatcagcgcgc

SEQ ID NO: 55323 - DNA, 562 bp, Triticum aestivum
  Clone ID: PAT_TA_55323
ttttacacttaagtttggtattttgctttatttacttactgacatttctgggacaagggcagattcattggcacatttaaatggtagctaaggcatgcacagggggtggggataggatacacatgaatctttggctggagaatccgaacctggaatagatatacatgaagatggagtgagggctactgtttatggactgaagggagtcctgccttgatcttgaccatggtatgggcggaaaaggtactgtagccactcttcaggcaggccgtgcctactcctgaacgaactgaacgcggattgagccaagggcaccgggaggatgtggaattccttctgaaatgtggatcttgcggaggtccatgttcgcaagaaaaaaccgacttgttaccctaaatgcagttgcaaatacagcatgaagggccaagccctgccattgacatgggacttcgcccgaggccgggaccacttgatcaaaaatgaggccatttgcacaagagcattactggcaactgaacccttacctgaagagaccgacaccacgggtagggcagtggttgac

SEQ ID NO: 55324 - DNA, 475 bp, Triticum aestivum
  Clone ID: PAT_TA_55324
aaagccccaaagcacccactttaatttctttggggggataacaggaaagttacggggacaaaaaaaaaaaggatagtaacttattaaaagcaccacaggggggaatcgaccacaggacccacattatagcggggaggggcttttatggggggcccatgaaaaaacaaaaagtttacacaaaaggggccatccataaaaggctgggtttaacggggaaacgggtcgccacctttatgccgaaaaatttggaaaactgggagaggaagtcaacccaaaagacccggagctcggggctgaccttggggggggcgagggcgtcggaaaaacggcccaaaaacctgtcctggggggggggcccccaggtggggaacctttccccgggctgaaaaaaggggttctcctttttgaacctgggtttctccctttttccaacaaagggccgggggggcacagggaaactggcccggacccgggg

SEQ ID NO: 55325 - DNA, 634 bp, Triticum aestivum
  unsure (1)..(634): unsure at all n locations
  Clone ID: PAT_TA_55325
tatgacnngtcgcatgcacgncnngtacgtaagncttgngatcctctagaagcggcncnngcccttttgttttttattttatttattttatttatttttattttttattttttttttattttttttttttatttttttttttttttttttttttttttttttttttttttttttaaaaaaaggaaaaaaaaaattttttttaacccaaaaaaccccccaaggggttccggccccaaaaaaaaaaaaaaagccaaagggggcgaaaaaaaaggggcaaaaaagattttgttggggcgggggcaaaaaaaagcccccccccccccgtaaaaaaactccccgggcccggggtgaaggggggaaaaaaaaaaaaaaacaacttaaaaaaaaaaaaggggtttaattttgggggggggcccccgggtctaaaggtgaagtggggaaagccccccttggccgggaaaaacccccccggggagggaaaagggaaccccaagggggcccacccccccaaaaaaaagttttttaaattgggaaaaccaaaacaggggcccccctttgtgggggccggggggggagggaaaccctttgcggggggaaaaaacgccttttaaaaggcaaggggggggtttttttt

SEQ ID NO: 55326 - DNA, 560 bp, Triticum aestivum
  Clone ID: PAT_TA_55326
ccccccccccccccccccccccccccctaaaacaaacagatatgaagttgtctgtaaatggttatataggtgatacatcatagcacattatttttagaaggtcgaagcataaaccaactccacgagaatagtacatatcgctggaagaaatatcaccacaccgcaattaatcttctacacttcaaaaccacgttcaaatcttcactgtgtcgatagctagtgtccccctagcaaaagtttcgaagagttttgctatgtagcattagttgttgtcttcctgtaccgcctcggtcttttctcatccaccagctctgacagtggctcaatctccttctccgggttcatcgtgtagaacatcaccaaagatagccgctctttctccacattggtcacaaccctgtgaatcgggctcttgaagaatccattgctcattatctccattacatctcccacgttcacgagtaatgtattcggaacaatgggtacgttgtaccagacgccatctttctgaagctggagcccgctgacattatcatcgatgaagacgatttgtgatcacc

SEQ ID NO: 55327 - DNA, 535 bp, Triticum aestivum
  Clone ID: PAT_TA_55327
cgggccaacggggggcaccggaaaaacatatcccgggagagagaccccccaggttcaaaccaaaccaaaggcgggcagggaaattaaaaaaatcccccggccgaaccattttctcaacctaggaagggttccggccccaccacaagaaccccccccccgggggggcccattcccttgattattacaaccatatttatttgtatagccctttcagggctctcaccatttttacagaacctcaattcaggggctggaccaggttcagggagaaggggtaaatcgaaaaaaaaacagctgggaaaccccccccgtcaacctttaaccgtaaaaaaaacggggcaggggccagggcccgttttttgccccccctttttttttagggccaggctgggaacaaagggcggaaggaaaaaggggccaaaaaaccaggcccgttttttccggttccgggcccccctcaccggggttggttccgtgctgaaaccggagctgccctccaacacaaacttcccaggtggtggggcaacggtttggt

SEQ ID NO: 55328 - DNA, 631 bp, Triticum aestivum
  Clone ID: PAT_TA_55328
ctcctcccccccccctccccccctcccccctttcttccctttttttaggtctaatagccgattcatgatgccttaggggggattataccccaaaacaaaaatttttttgttgatgcccggtctaaaaaaaatcaacaagttcagggatacaaaagggggtatccggtaacatgctggggttaccagctttttaacaaagcctacaagttttttttttttgggaaggggatgcctacaagattttgaaacagagagactacaagaacagatctcaacaagctcaggtcactttagcctaccccgtttggactcaggcgtgtcgccgccaccgacttaaacttaagtttggcaagttgaaactgcagcggcatcaatgatttcttgatttcctcctgcgtttagcttttccgcaacggcatccgcagttgagcggaaagccggtggcagcctccaagcgtgaacaaaacggggggcgatgcttttgctggatagctcctcaaccagctcgtaaagctcgcactgcacgaccctgcggtcaggcacgtcaacgctgaacaggtgcctgtccaggaaaaagtaaaccacgttcggggtccctgggatggatgaccgcaaccaccggaagctgcct

SEQ ID NO: 55329 - DNA, 111 bp, Triticum aestivum
  Clone ID: PAT_TA_55329
tggtactcgtcaaatgatcatatgcaagcaagattcatcgttaaaaaaatgataggcccatccatgaagtgaaaatcctgcggactgttgttaaagattgcggacgcgtgg

SEQ ID NO: 55330 - DNA, 188 bp, Triticum aestivum
  Clone ID: PAT_TA_55330
tctcaaataaaaaatgattgtattgcatggggaaataattgtgctaggaacaaacaaatgcagtaagaaaaaaagaaaaaaaagtgaaatagtacacaagttctactcgagagatttgaaggcgaagttctactaagtgaagcataagactgccacaccttgatgtgaggtgagggtcctggagtgct

SEQ ID NO: 55331 - DNA, 459 bp, Triticum aestivum
  Clone ID: PAT_TA_55331
ttttctggagacacatttttattgattcgcgctatttacagaacaaaaccgctccagtttgcatgcaacctgcgcaaaaccatggaagcgcagcagcctaccgatgctagctagctatacatgctgccggtcgcagaattactacgcggccttgggtggaaccacaatggggctccgcacgatgtgatcgtcggagacccacttcaggttgccctcggcgccggcgacgctcggctgccccgcccaccgcaccgtcaccgtgaagctctgcttctccttggcctccgcgaaccgcagcatcggcggctgcaccgtcaccgacacgtctctgggcatgtccaccacggcggtgtacacggagttcggcttcccgacgttggtcaccgtgcggttgaccgtgatcggctgggccagcaggttgacgatgagggacgggtagttcagctctgcctcggtggt

SEQ ID NO: 55332 - DNA, 615 bp, Triticum aestivum
  Clone ID: PAT_TA_55332
tttttattttttttaacattatcagataggacttgataaatggaccacaacatctcaaaggcgtggcaaatagttccaggggtggatgcaaacatccaactgttataaatgaaaaaccccaccaaataatgtgcagatcatatacatcccaggaccattcaaatagttctgacaggttctgacggttgatgaataaaccaccaaatgccggtgcacccattctttctgacataaagcttaccaactagacatcgtctacaaggacgatgaagacgcctctgaatcgtcacattaggcttgttagcttgggcggctgtcgatttgctccacaagtgagataagcctttcttcagacaccttttcagatattccaccaagtttgtgcagcctctcagcaaaacatcctccactcctcttgctttatcaggcttgaccaaagctatgcgggagagcatttgtctagcttcaaaagatagtatctgaaaaagcatcatctgtgggcgttcctcagattcctgctttgaatcttactgagccttttgttgccctgcattttgagggcttgccgaaccaccacactttatcattatcttttgcagtccactctgcctgatg

SEQ ID NO: 55333 - DNA, 736 bp, Triticum aestivum
  unsure (1)..(736): unsure at all n locations
  Clone ID: PAT_TA_55333
atattgtttcaacatactcccaccgtcccataacgtaagacctttttttgacactagcggtcttacattataggacgaagggggtatcatttttttcaagggttcacaatttgtttggctaggtccaagttttgaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccgnagtgctgcagccggcaatcgccggcgcgctgcgccgnccagtcctgcgcaaacctggccacgttgttgtcccatgccacggngccgacgccgtccacggcgcgggcgcc

SEQ ID NO: 55334 - DNA, 478 bp, Triticum aestivum
  Clone ID: PAT_TA_55334
agagccccaaaagggcatactcattccatctgggcaaaaaaccggggcgcacaagtaactgaatttcacaacagaagggcccggaacaccacacatttacagaaaaacctatttttttagctaacacaacacactacactcatgtcaaattgccagcaagtatacaaacaaaggggcaccgagccacttcagcgagcaccttggttcctccacacacacacagcaatgcttttttttaatactgggagggtttggcgaccaaggaaccattttaattcccaaaccaacctcaagccttgatatgggggggaggatcacatgacgtagcgggaggtcacgtattctccggcgacttcgctctgccgggggatcttcaccacctgcccacgcttaatgccggagtatcttgctaccggatccgtgagctgaatcctcgggagctgagtttcgggggcagggtatttttgcagcaactcct

SEQ ID NO: 55335 - DNA, 647 bp, Triticum aestivum
  Clone ID: PAT_TA_55335
agggcggggggtaaatagtgcataattttttactgtagccaacctggcatatgttgacggactcaatgccgtgcggtgtacatgtgtctttggcatgatgcgcgtgacaagagatgcaactgggcagcactcttgcgcctgctagtatacttcagcccgcactttttaatcgctagcaaatacgggcatcatggagcagcctcttctacaaaatacagtagctggatacctgcttggcatggatcgcgacgagcactgacggagctgattccggcctgcagatagctcggccgcgacaagtaattccgaacggagggagtagatatcacttccccggtcgcagagagataaattaacgaggatatcaaccaatacggctagatgttcaacagaaaagtcattatagcaacatcctgaatggactattactaaatggacaactttaactagtgtgtccatggtattccaagcacaatacttcggttggttccgtccatccaaaaatacaaccaggatcaccaaccattcttcttcttctaaaattttgtttgtcccctttctgcccacgtttacacatgaaagccacatgagagggggtgttgtcatgtcaaagtataagtggattgcccaaccttcaccatcagttc

SEQ ID NO: 55336 - DNA, 424 bp, Triticum aestivum
  Clone ID: PAT_TA_55336
gaaacaaggaaataacgggccaaactttacgggggcaggggggtcaataaaaacaccccaggggatttttacccggcaaaacagcggccccccatcaggcattaacaacccaaagggggaccagcccccaacccccccaaatcaggattaacccccaaaaaaaaaaaaggggggacccccgaaacagccccacaggaaaaaaggggagccccccagtccaggcaaagggggggaaaaccccatggccggggaaaaatccctggaggccgggggggaatgggaaaaatggcccctgggcccttttgccccccccgggcccgggggtcttgccccggaaacagggccatttttccttgtggccgggggcccccaacggcccccatttgccctcgggcaaaaaaatccccccgaacccgggggccac

SEQ ID NO: 55337 - DNA, 494 bp, Triticum aestivum
  Clone ID: PAT_TA_55337
agacaagagggggaaaaaaaccccggggcgacgttttaggaaacaaccccccatgaatttaggactacaaatcgaccaaaccctgacaactttttattttaattaagggaggaggcaaaacttttgcctccgtttaaaaaaaaaaaacactgacaacttaattttgcaaaaagggaaaattcctcaaggggtgggacacccaaatccattttaaccggcagacacaaatgaaccaccctcaaaaaaaaaaaaatgaaccccccccgaaaaaatagggcatcccatgggtaacagggcaaattacttggggccgaggtccttgagcgcattaatctgctcctctcccaggggggacaagaaaaaaaccaccaggtccttcctttaaaaaaacccatccttgatctggccaaggggggtttcatcagttgggagcttgagggcatttttggggttaccattatcaggcagcaaactcacaaatccatcctcaaaaa

SEQ ID NO: 55338 - DNA, 172 bp, Triticum aestivum
  Clone ID: PAT_TA_55338
ggcaacgcaatcagtcactaggaaccggacatgttcataatcagggcatcgcatgggcctaaagttccggcggcacacacctcacaggtcgaaaaatcaacactttaccaaaaattctaaaaaaaaatcagccactcccttggagaactgccaccgaaaagcggacccgggg

SEQ ID NO: 55339 - DNA, 241 bp, Triticum aestivum
  Clone ID: PAT_TA_55339
aagaagcaataaaagggaagcctttcatatcgaaccccctgctcagtgtgttctttgcgcctcatcgaatacaactgcatgccatgcatcatgcaagcagtaatatcaaacacaagaccaaaattctacagtactcgccagtcgagtacaatccgtgtggaggccaacttgagattacagatgcatgctaagtcaatgtgtatatttagcccatacgcaccacgcgtccgcggacgcgtgg

SEQ ID NO: 55340 - DNA, 515 bp, Triticum aestivum
  Clone ID: PAT_TA_55340
gcccggggaacccattttaaaaattaacaaaaaagggccatgtacttggcatgggaacacataatggccacaaatgcttttaattgccaaacaatttgggggggaattaacaaaaagaattaccgggataggggaaaacaaaaaaatttggtgggccccctgggacattacatgggagtttgaaaaaaaaaaactgaaaaaggggaacaaaggggcgtttgcccaaccccaaaaagaggatcattcgtattttgggggatgggcatcaaacttgggaaataaaaaaaaggggtatcatgagggggggaaaaattaaaagccaccaatgggaaagggggaggggaaaagctacctgtaaacggagccaacccccgctggggccttgggagggggggggggaagggcaaactcaaactcaggaccccgtccttgacctccttggacccccgggggaagggccgcccgcggcaaaggggaaacgatggggaaacaccttggccacgggctaaacaggg

SEQ ID NO: 55341 - DNA, 636 bp, Triticum aestivum
  unsure (1)..(636): unsure at all n locations
  Clone ID: PAT_TA_55341
gaaaactgaaacagatcgctcgtacatgcctgaagcaagcatgtcttctcgactcgccaaagaatacattctgtacagtgtctgtcacgatgcaaaacaaatatgattcggcagatacaacagcagctacaaaatcggtggcgcgaagagagacccggtcagtgttaactgtttacacctcgacagaaacagctttactgtcgccgttagaagaagccttcaccttcttgctacttttcttgcttgattggcttgttttgctggattttctcttcttgcccggcttttccagtgtctctagtgcaggctccgtcggcgcgatctcaacattgtccattgacgagtcgtttgtaacatctttggttgtgcccgcatctacgtctgggtctacgacagacatccgagtcaaggtgtagtccaacaaaaatgtgctgcgtacaagtctatcgactctgctgaagtgtctttgcgaatatgggatgaggccctcaaggagctcgctgatgccttttatctccaggatatcagtgggaggcaagctcctcaacacccgaaaaagcacaaactgcgcaacatgacagaactntggctttgtattccattcccgtatatactcaagaagcacgcgaagccctt

SEQ ID NO: 55342 - DNA, 511 bp, Triticum aestivum
  Clone ID: PAT_TA_55342
gggcggggaaaaaaaaaaaaaagccaacccaaatgggaaaacccacaaaaacgaacgggtccccggggcccccaaacagctacccccccttaagggggggccccccaaaaaaaaaaaccgaacccggtaaacgggccaaaaccctcgaacttcccccctaaaaaaaaaaacaacccgggggggggacaaccaaaaaaaaaagccgacggccttgcccttaaaccaccccccccattttggtctcaccagcggaatcccccaggggggggagggggggggggttttaaggccccccggcgcccccgtaaatgcccaagccaagcttgagcatgcgggggaacccgggccccaaggggggggggccccccaggctaaaccccggggggaacagggggggcttaaaaaaaaaaaacacaagggccctgacaaacttggcgtttttgggggggggggcccccttgcaaaacccccccaagagggggttcccaggggggaaccccaggggcttttt

SEQ ID NO: 55343 - DNA, 550 bp, Triticum aestivum
  Clone ID: PAT_TA_55343
ttttttttttttttttttttttttttttttttattttttttttttttttttttttttttttttttttttttttttaaaaaaaacccaggggtctttattattctttcccaaaccccggaaaaaaaagccggttggggaacccccccccaaaaaatatgaaaagggaaagggaccaagcgactaaaaaaaaaaacgggccctcacccaaaagtttcagggccccaaaaggggaggggaaaaaatttgaaagggccttaaaaaacttaaccctggccccccaacaaaaagacccggggggagcggcccttaaagggcaaaaggtttttcccccttcccaagaacaaaaagaaccccttttgacaaacttgggaggggggaaaccaaaaaaaagccctgcctttaagcaaaacccctggcaaacctggggggccccccccccccccaggggaaggggggattatcccggccaaagggccccgaaacagcgggcttgaaaaacccggttcccccttttttcaaggcccggggggggctgaaaaccccgggcccg

SEQ ID NO: 55344 - DNA, 416 bp, Triticum aestivum
  Clone ID: PAT_TA_55344
ggaaaaaggaaatcttttgttaaaagttggtccccttttttttcaggacacaatcgtataaaaaaaaagggaaaacggggcccagttttaaaccgggtttagccccgggcaaaattaaaaatgccccggacggggggggccaaaatttatttacattacaaaccccaacagttcccattttggggaagggacagaggcaatatatttcgtactgaaggcacccggggggagctgacaactaaaaaaaaaccctttaaaaaccgcccgggaagagtttttcctgccagggaaggccttaaaaaaatctcatttcaactaggaaaaaccgaaaggctgccaaaacacatgaaaaaaaaattccgggtttgccttccttttgtaaggaaacggggcaggggattttttcggacgcgggg

SEQ ID NO: 55345 - DNA, 294 bp, Triticum aestivum
  Clone ID: PAT_TA_55345
tttctcaaatgaattatatcgcactgaagcttaaaaagtgccaggatactacacaactgtctgtcttgatctgattgaagcatcatgaaaagaaactcatcacttgaatacaaacaactaagtccttgatgaacttccactttcaccagggctgagatcccgcacttcaggtgattgaaggggggttctccaaacttccacagaggtgcaacttgggcgcacttctaaaatggcttgaacatctaggtccgagtcacatgagaaacaccaaactgaaggatcactgaagctcaa

SEQ ID NO: 55346 - DNA, 279 bp, Triticum aestivum
  unsure (1)..(279): unsure at all n locations
  Clone ID: PAT_TA_55346
gggggccgggggggtttttatatatttttttttttttttttttttttttttccccaaacagtttgctcattggggcggacgcggcataccacctagagctaatagtttattcagagaggaatagccgggccggttgttttacggggcccaatttctggggggagggggctgtgtttttttcttaggcggggctttctgtgggaaatttttgggaaaggacctcgccctggtgcggagaatnttccgttcgccttgcgggggggttggggaggtggtttt

SEQ ID NO: 55347 - DNA, 472 bp, Triticum aestivum
  Clone ID: PAT_TA_55347
agtagaaagtgcataatgcatgttcattaaaatctcattaattcatcaaataacggcctcgtggcacaacggtaaaagaaacttgcgtgcgcgtggcacgagccctttgagattgtattcctcttcaaaacaaattatatcctcattagaaaattagtgaagcctacaatacaataatgtcgcggtctgtttacatcggcggaagcccacgccattgctccctgaggaccctgcttttcctcgtacgcaacccatccatccactaccaaaagagagcgcagggagcattaaacaagtaaaaaccagatatactgcatttcctcactcgggcgatggttttgcatcatcgtccatttgatcattttcaggaagcccaaatttccttaagttatggtccatagagccgatggcgatatattatggtgtcagagccaaacttcgcaaaaaacacttttccctgttttctgacaaa

SEQ ID NO: 55348 - DNA, 344 bp, Triticum aestivum
  Clone ID: PAT_TA_55348
caagaaggatttcaagatccatttttttaaaggtcccagaacaaagactttttttagggcaaaacattttccaaggaaatcgtttaaacaaaaaccctccttaagattctggaaatggcccaccccagttttaaaaaagctttgggggatcgttggaaaccagtttatcgttttttggaaaccccaacagtttttcctttcctgccggtggtcttggggggctgcccacggcccccccccccccaatagtgacccaaaccacgagggttcctgatttttttggccctttaaaggtcatccttgagctttatgtccacggggttggacacaacctggaaaaacct

SEQ ID NO: 55349 - DNA, 148 bp, Triticum aestivum
  Clone ID: PAT_TA_55349
gttctttttttttaggcaagcaaactcatttcagaaaatttgcaaccaggtacgactcttactaggtttcaacagctaaatcacaataacagtagcacatgacacgaagaattcatagatgagacagattctgaaaacatcagctagt

SEQ ID NO: 55350 - DNA, 486 bp, Triticum aestivum
  Clone ID: PAT_TA_55350
ggtctttttttttttttttttttttttttttttttttttttttttttttttttttttttttttttttttttttttttttttttttttttttttttttttttgggggacaatgcctttacacgggggcttttttttcaggagtaacaaaacaaagactggggggggaccctcccaagtccgtaagggaacaaagtcaggggcaaaaaaaaagggtttacacataaaggggaaagtttaataagttttgtttttaaatgccaagggcataaaaaattttaacttctaatggccccaaaaaaaaactgggacttttaagcagtttggaaaaaataaaacaaaggtggggccctcctcactcactataaaaaagctttaaaaagcattattttttttttttcgttgaaaccccgggtaaacttttttaaaaattcccttactttggacgggggggagtgcattaaaataacccccacttgtatggggggg

SEQ ID NO: 55351 - DNA, 625 bp, Triticum aestivum
  unsure (1)..(625): unsure at all n locations
  Clone ID: PAT_TA_55351
ttcctcttcgcacttcgcagtaccatcggctgcctgcgagattcccctccctcccccaccccgctccactccggcctctccgctctcccacaaccactaccaccaccgctgctccgcccccctcctcccgggaagatggccgcggcggcgctggcgaacggggacgtgcgcgccggcggcgggggcgcggtgccgcggccgacgaacccgatggtcacgcccctgctcaccgacctctaccagttctccatggcctacgcctactggaaggccggcaagcacctcgaccgcgccgtctttgatctttacttccggaagagcccctttgctggtgagttcaccgtctttggcggccttgaagagtgtatacggtttattgccaacttcaagttcaaagaagaggaaatcaattttctgcggactgcactgcctacatgtgaggatggcttctttgagtacctcagttcgattgactgctcagatgttgaggtttatgccatccctgagggttctgctgtgttccctaaggttccgctgatgataatcgaaggaccagntgcggntgttcaacttcttgaaactccatttttaagtctggggaactatgcttcggtgggtactacaa

SEQ ID NO: 55352 - DNA, 620 bp, Triticum aestivum
  Clone ID: PAT_TA_55352
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggaacaatttaaaggaacaaaggtttaattaggggggcgtgctttttgggggttttttttttgtggcccttattttcaattttttggcctttttttttccccgtttattttgggtaaacccctgggtttttccacctttttggctttggaaaacctccgcttttccccatttggcttttttgcgaaagggccccctttttgggggtttccaattttttggggggcctgaatgggtattggttcccccctttttccgcccctttaagcccggtggccctttccttttccccgcaccttttaccctttcccttttcgggggtctttccccccggtccttttttttttttccgtttctttttgggccggttcgtgggtttttcccgttaggttttaacccgggggcccctttttggcccccatttttgtgttttgggggcccttttcccgatgaacttttttttgtttgagggtccccgcccccggccacccccttggtggcgggtttt

SEQ ID NO: 55353 - DNA, 787 bp, Triticum aestivum
  Clone ID: PAT_TA_55353
cccgaatcccctcccacgaaccctagcctcctggtgccgccaccccttccttcccccccccccgcgtcgtgagccgctccctcctcttcgtgccgccggccatcgcggcgacgtagagtggcccagatgtggccaccccgtggtcggcctcgacgagcacggcctcgatccggcctcagtaggaaaaccttgagccgaggagcgcggcctcgatcgggactcggcagctcgggcagcgatggaggaggggaaaggaggggagcagcggccaggtgtccaggaggaactcgcctgccgactttgagaagaagagatgacaggtggaggtgggaaaaattgcgctaggaggatgaggcgtgggcatgttcaacttaattaatgcgccttttagccgtgacttttgcccaaacttttgaaaggagcgagctgatctctctatcagttcaggtggatgagccgtgtcccgtgttctaacgagttcatctatgagggcgttgttcctttgttctcccgctgaaggtttgctcacttccttctacatagatgctccattatttcttttcttacgtagttctgttttgtggaatggcaaacgctaaattctgcaatggtactttctgtcctatgcttatggtcaagcattgtgttagatttttcctctggttttctaaacatgaagtgtacagatctgaggatgaagagaataagaatttagctaaagaggtgaagaagatcaaggtggttttactcccctctttgaacatttgttcttgcattttgatgctat

SEQ ID NO: 55354 - DNA, 603 bp, Triticum aestivum
  unsure (1)..(603): unsure at all n locations
  Clone ID: PAT_TA_55354
ctcggagcaacttttacaagggatgctgggcgtcgtgggcggcacgtcgctgctggagagcgacctgttcaagacgggcctcgcggaggtgcttgttgagaccaagtacggccgggtgcgcctctggaaggccgacaagaccggcaagtttggccgcgacattgtcttttgccagcgccaccgcgccgaccccgacggcggctacacgctcccgcacaagattaaccgccgcgccattgcgctcgcgtttgcgcagatcggcgtcaagacggtcgtggcgttctactcggtcgggtcactgaagctgaccttcccgccgggcacggtcgttgtcccggacgactatgtcaacttttggggccaggacaacctccacgacgagcactcgtcccacattgtccccggttacaacgcggaccttcggcgcgccctcatcgagatcctcaccgaggccaatatcaaggccaccaccaccgccgtgtatgtgcagacgggtggcccgcgcttcgagacgcccgcagagtgccgngtgctgggcgggttcggggacatttttggtatgacggcccccctccgggccaccatgttaaagggggcgggcgt

SEQ ID NO: 55355 - DNA, 744 bp, Triticum aestivum
  unsure (1)..(744): unsure at all n locations
  Clone ID: PAT_TA_55355
gccggcgaaaactttggcctggggatgaaaaaatctccaccagtttccacccccaactccccaagcgaggctatgcccatcctccgcgttgcgctccgtgacacgctcggcgaggccgtgagcgccgttggggccgtcgccggcctggcgtccctgtccaaccacgcacgcgaggagatggccgtgcgcgactacatcgagctgctcgggtactccgtcgacgagctcgggtggtcgctcgacgccatggccgagccccttgacggcgtggatccggagatgaagaccgctcacggcgctgcgccagggagcgttcgcagtggggcgcacgcagaagacgacctgcacgcctggctcgctgggcaaccaggacacggcaagaacgatacgacggcgtcgaagaggagctcaagcgcgcccggagctggcgcggcggctcgagtcgctcgccgcgcgggaggtggaggtggtggccgcgctctgcgagggggaccagggcgcgccgctggccgagctaagctcgtctgagattgagaggggtcatgcacctgatgcagaagaggcgcgggacctggcggcatcgaagacgagctcaagcgcgtccattcctggcggcggaggccaagtacgcggctgcctcgccgaagccctgcggcggaggccaagtacgccgctgccgaactcctnccctgcttccctatcgttgtcgctgcagctctgctgctctgcctggttgctgccgct

SEQ ID NO: 55356 - DNA, 653 bp, Triticum aestivum
  Clone ID: PAT_TA_55356
acatacacagcagtagttactggctgggctgagggaggtcagtcagtcagtcagtcagcacccaaaaaaaaaacaccatttcagagctaactctagttacttacatacaacatgttttatagcataaatatacaaacgtgtctagtgggaaactataatttacacagcttaatgaccacgagcttctgatgtctggaactcatcgcgaccccgtcgtcacgggggaggatggttctctggacgatgtctcgagccatggaagggagttgccaggtacattttacttcaaagtgtaaaacaacaagtcctccttattcttagcatagagtaatactgttgataaattatccatcataaacagcctaaataccctaaaaaagactcctccctgccgatactaccatgacagctttaaggaaatgcttctttcctcaacagtttgagactgctacgagtctgaacggatcaactgcggcaccgggaccttattaattaaaggtctcagagtttccatgatattagcaaacgagggcctccgccatggctcgttcgcccagcaggattcaattaatacagctacttgaggatttaaatcctttggaatttcaagtcttcttcctttaaagccaacagcagcaaccacctgggcagga

SEQ ID NO: 55357 - DNA, 258 bp, Triticum aestivum
  Clone ID: PAT_TA_55357
agcaccggcgaggggcgggagaatccatttttttcagactcttcaaaggggggggggaaaaaaggagcgcgggcgggcttagggggcaaaagctggggtggagttaagcccacaaatggccaggggggccaggacaaatgcccagattacacacaccggggaatcatccacgggctttttgggaattttttttgcaaaaaacacgggggggggcaataagggggggccaactggtttttttgggcctggggggcctaa

SEQ ID NO: 55358 - DNA, 536 bp, Triticum aestivum
  unsure (1)..(536): unsure at all n locations
  Clone ID: PAT_TA_55358
aaatacgaatgtatgaaacattttagtattagatacatttgtatctagacgaatctaagacaaaaattttaaaacggggggagtaattgtatgcggattttctcgggatttcatggcatccctattctgctcacacatctcatcgtattttttggaaatggacacatctcatcgtatgatagcaaacatttttttatgccatgggaattgggaacttggaccaaaatcacaagaccagaccatgtgctctgtcttcttacgtatctgcttttgcaggccctgcccgcacactctcctncatgctaagcatatgttggctacttcagcagcactaccccatattttcatttctctagtagatccgtcggaagaaaagaagtgaagactctgttcttcgccttcgtagcctccttgtgccagtcggtgcagagtgtgatggccacgaacagcaagacctgcaccagaataccgaagatgattccgatccaaagtcccatcccgccgacgtgcagcacgaaggcgagcaggtccgccgc

SEQ ID NO: 55359 - DNA, 268 bp, Triticum aestivum
  unsure (1)..(268): unsure at all n locations
  Clone ID: PAT_TA_55359
aatgcaagattctgccatggggggactagtcttgttcatttctgtccttgtcatgcgaggagctacacatggttgcatgacattgcatgggtggccgggccttggttgtggtaccggtggttgcagagggccggctgctacgggggggggggggaacttactacngatcgcgggcgcnggcagcgncggggggggggagggggggggggggggggggggggggggggggggggggggggggggggcggggggcgggnggggggggggg

SEQ ID NO: 55360 - DNA, 490 bp, Triticum aestivum
  Clone ID: PAT_TA_55360
agaagagatcataagtatatattattagttttaaaagcaagatcattgtatacacggtaaaatatgttgcctcggcctttgtttccagggagcaaacaactatgggaagaatcacaatatagggaagtagtttggttttttatgggattgtttcggtgcacaaaggaacatatattcaatatgtcttctgatgattgaaatagacattacctaaaagctatagatacctttttccagtatgcagtataagtgatgggttcactgaaaaagtacccccatgcacaccatggaaattttgtgactatacaatagcaggcaaaaaggtatgctctatcaactcatcatcactatcaacagaacttagagcaaatcccaagttattagatataacccatctgcgtgcaaatgctttcctggaggtggcaggagtgattgttctgcataaagcaacagagtgcctgggcggtgacctttggcaatggattgtgct

SEQ ID NO: 55361 - DNA, 623 bp, Triticum aestivum
  unsure (1)..(623): unsure at all n locations
  Clone ID: PAT_TA_55361
atcaaaccatgctgtttattccccagcagagaacaacacatagtaccacatatgtacctgcagggacaaattacaactcaatacatcacacttcgcgcacaaacacaaacacaaaaagaactataggtgggaaagccagcagcaccacaaatatcttctctccttttttggttcatccaaatcctatactataccgggaacacgacatgatagaaatctgttcacgctttctgtaaacaccacaagctgatcagggacatagcattggcagtgttatgcttgtccctctaatggggggtgacaagcatcaagtggccggcaccagggacctccaaacaaccgcacacaccaggggtaggcaccatgctgttctgaacagaaccatccctcccaagtacgctgatcagatagaaggctctatagcacatccgataccagccaaagaacaggcgaaacgaagagaagcgcagtgggctgcagaccagataggctttacattccttagataaatgtcaccgtctggcactttcggtcatcaagcacgaatgtacatcgctggagttatatgtgcctgtctgtcagcgaggctgttctggatgcanaggtaaaaagatgaagaaagt

SEQ ID NO: 55362 - DNA, 382 bp, Triticum aestivum
  unsure (1)..(382): unsure at all n locations
  Clone ID: PAT_TA_55362
agcaacagaataggagggggcaaagcgagtctcgctcgtcacagtacaagttcaggaatacaatacgtacgtacacattatcttatcttacagatccgggtgcccggccagttttttttttcaccgancctctttattgggggggaataactttagctgctctgcttccggatcatcgcgtccatggcgtgactgttcggcggccagatcacttggtcgcgatgaacagcccccatttgtgctcgccggcggagctccggttgagcttcgcgctccagccgttggcgatgtgggcgggggcctcctgggtgaagggcggcgggaaggcctgcttgggcttgtggggctcgcccgggtgcctgtgcaggaccctgaggaactg

SEQ ID NO: 55363 - DNA, 402 bp, Triticum aestivum
  Clone ID: PAT_TA_55363
cattcggccattacatagtcttaacaaataaagtgaggactccagcaacagcaacatgagcagcagcgcctccctcctaagcacataaaaccacaggctagcaactacaaaaattcccaaaacatggcttaataaatcccaaaggtgtccacggccacgactttaaagtagagccccataccatttatcacttgaacccccccacccacagacaagcaaagttcggagatacttcatcacaaacaaagccctggcaggacccgattaccataggtgctcgacagactaccccatcacagaaggtcgacatcgtggtctggtatctgtcaaaccaccacatgggggaactaattgaacggcaaacaggaacctgtgatcttgacggctgacaaatggggtggg

SEQ ID NO: 55364 - DNA, 685 bp, Triticum aestivum
  unsure (1)..(685): unsure at all n locations
  Clone ID: PAT_TA_55364
aaaaatatgccaaataaaataaaatagaaacaactgaagtcaaggtagcaacaacatagtctgtgaaaactagagtgaaccacttaaacttatactttgatacaatagttacgatatcatcaatacacgttggcacatcacaaacatagtaaacaagaaaagaaaaactatctaggaattgcgacagatatggtcatgtcgttaatactacatgactctgtggcagtagactcctcttcatttccgacccttatgttgaaatatgccggctgcttaggttcgtcgatgttcatatcgtcggtgcatagcattgctgtaacatctgtcatggttggccgatcggctgcgttctcttgtacacataataatgctatattaatgtatctcataatcttcggcgattgatctttgggaaccaatgatgtatcaagaaggtcaattccccttccttcttcccataattgccatgcatatccaagaagattgatgaaatcaccatattgctggctaccagaattccgctttccgctaagtatctcaaaaataataacaccaaaactgaagacgtccgatttaatagagaagacaccctncgaagcatactcaggggacatgtagccatatgtaccaaccactcttctagtagtgtttccttcactgctatctgagctggaaattttgctag

SEQ ID NO: 55365 - DNA, 462 bp, Triticum aestivum
  Clone ID: PAT_TA_55365
aaaaaaggtcccaaaaataaaaggaaaagaaactaaaaaaggggttttaacaaaccaggggaggacaaaaaggaaaaaggtttttttagttataaaaaaaccctcaaaaacattggaaaaggggtaccggcctaaaaaaagggaagggccttattttttttttgaatttccgggcttggtttttttaaaaccaaggattttttggggccgggttttcctttccttgaacgggtttggggacttccccacctttgaaaaaaaaccgttcctgaagaggggggacttgggctaaaactttttgggggactcgagggtggcgaaaaaaaaaacaaacccggaggacttgccccctccaaaggggggggggaacttaaacaaaaaaaagcaggggggggccttgaccttaaaaaacttggggagccttttcttgagctcccccttgaaaacattgccccggccggg

SEQ ID NO: 55366 - DNA, 356 bp, Triticum aestivum
  Clone ID: PAT_TA_55366
gggggaaaaaatttgggtttataccacgaaacaaatcccggtacatacccgggggaaccaaaaaaaaaatcacccctgggaggccaggggacaaaaggggccgggcacaaacaagcaacccaaattttaggggggcaaactcaaaacttaaattttaaaagggggctagcccactttatttggggagggtttacggggttcccattttattattttgcaaaggggggcaaaacgggacctaaactttaaagtagttgccgggggaagggcttaagggtgtccgggcagcttttccttgattttggccaagaagccttttttttccccggcgccggtggggccgggcgtccccgtgc

SEQ ID NO: 55367 - DNA, 364 bp, Triticum aestivum
  Clone ID: PAT_TA_55367
gagcaaggaaacaaattcgcggggcttgccgccccaaagccccagggggttttttttcatcgggcaggtggggtcaacccccccttgcataccccaggaagctaggaaacaaaacatgcgagggggccccaaaatttactgaaaaccattggccctgcccacagggttctgggggcaaacaagaattttctgctttgcccaagctaggggacttaaaacaaggggagcagggctcaggggcccccaactatcggctgcccccaggatttgcatcaaattcaagaacaggttgataatgtccagggaaagggacccggcagcccaaatgtacccatcgtacctggggcgcttgatgaagttgccc

SEQ ID NO: 55368 - DNA, 509 bp, Triticum aestivum
  Clone ID: PAT_TA_55368
agaacaaaagaatgatgtttgtactcttactaagcaatttactcccgaatatagatacaatcagacatccatcaggccaacacacatataatcatcactggttcatcaacaagcataataatactctaacaacaacatggttttacacagatgagacgaaacgaattactcgtggcacatgttgaagcctatcacagcaggacatgataagtagaggagccaatgcaagaccaccaccgaccgggacatgagcacattgttgcacctcactcactttttgagcacactgaaaaatggtctgctttagcctcacgttggtattcttcaaatctgcattggctctatccaccttggcatccatttcatccatcaagggaacttgcctatccaattcctcattcatatccgatgacatgttcttcagagttgccagcccttcaccaataacattcaaaccttcatcctgcttcattctacgcatctcatattcctgacaaaatttatttgat

SEQ ID NO: 55369 - DNA, 560 bp, Triticum aestivum
  Clone ID: PAT_TA_55369
agaccaaacatcatttttagaaatcttgggtcggtcacttacaaggggtatgaaagattttgagcaagagctcacaaggcagcatctaaggctcccttgcttattgaaaataaatgcacaaactccacatacaattcacaaacaaatcaagcagcatttttttagcaactcagtggaaattgttgagcctcctgcagttcttcctgatctccccttgtgacccagtgagtggcgagatgttgcccatgttcaccattgactgggcaaagtgctggaagaagagatgcacatcatttgcatatgccttcacgagcgccgccgtctcggcgctcttggtgagcaggacctcgtcggagctgagaagacccctgccggccaggatgttcttgaagtagaagttgtcgaacttggtggaggtgacgatgtcgagtgggaagaggttgtcatcgccaccagagcgtgggcacccctgcctcagctgagccgcgtaggacacgtccagcgtgttgtcggccatgccgttacctgactgggtgtacaacctctgcctgaaagctgtg

SEQ ID NO: 55370 - DNA, 618 bp, Triticum aestivum
  Clone ID: PAT_TA_55370
ggctaggtccaagttttgaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacgtttgtgtcccatgccacggggccgacgccgtccaaggggcgggcg

SEQ ID NO: 55371 - DNA, 509 bp, Triticum aestivum
  Clone ID: PAT_TA_55371
caggcacaaacatcctcatcttagcaggacaagctaattcatttgcatgcagagcaacaataacaatactcctaatatacaaagggacgtcacattggaaaaacaatgcaaccaacgtgttctctctagtggcaaaatcgacaatttttgaactagcacgacatataaacaagaactacatgatacacaattttccatcatgcacctgctatcctgaacataaatgaaatgagagaagggtatgctgaacatccaaacaagaacttgcaattttttccatcatgcacccagaggttctgccttctcccccagccctagtatggttggactagtaatgcaagcactgctcccaaggttttagagagatcagtagccatccaactatgaaatgcatccaactatgacattgcggcgggccgtctgcacacacacggtcacactccaccgtgccccaatctccacctcgctgaactgcttagcgacgaactccagcttaagatgtatcctgt

SEQ ID NO: 55372 - DNA, 567 bp, Triticum aestivum
  unsure (1)..(567): unsure at all n locations
  Clone ID: PAT_TA_55372
acttaatcactttattagttccacatactaataatcgaaggacagaacacaacacaacacaagatggaataattaacgggaaaatcaacctcttattagctcctagctagtagctagcagctgctgcaaattttaaatcatcattatttcgaattggcaaggatgccgacgaacgtcgccgtttactggtcgtcgacgaccatcttgatcgcgggagatacgttctggcccgtgacgagtgtgccgaagttgacgggctcgccgtacttggggccgttgccgtagaagagggcgaccacgccgcgctcgatggtggcgtgcgtggggtggagcatgtcccagaacatgtagtcatcgtgctcggcggcggggcacgccgtcgtgcccgggtggctgcacatcacctccgcgttgagcttcccggacccgcagcacgccgtcttcacgtgcctcagcccggctacgagggagttgtccatcatgtcgttgaggatgttgtagntggcggcgatggagaacttgagctccttcatgggggatgcggaggcctaggagagcttggacctg

SEQ ID NO: 55373 - DNA, 449 bp, Triticum aestivum
  Clone ID: PAT_TA_55373
gaccgggtgcaggggcacccgggcaccgaaacgccgttctcacactggggatacttatttaccggaagggaagcaaacacatgcagagtttgcagtaaacaaacgggtacaccaaattcacacacggggacggatgtgagcgacggaggctcaaacccattggatggggtaactgctatagttgggccccttggcctcgaagcgttcccacaccatgacccccccgtaattggcccccttttgcgccacctgtataaccctttaaaaaaggttttttgggggaacgtaaccgaccttttgtttcaacaccggaagcccgaggtaaatctgcaccaaaggggaccccaacaaccacttgacccactgaaactgacagatggcgggtcacgtgtttgttattaggaacctggcgaaaattcttaccaccagccccttattaagcgccccct

SEQ ID NO: 55374 - DNA, 484 bp, Triticum aestivum
  Clone ID: PAT_TA_55374
cccgaagaaattgatggcattgcacaccgaaaagcaagggggacaacgaggtggaaatatcaacagtcatcgcggccttggggcagaggaggcgatacgaacgagttgaggggtggtggtggtggcgggttacggcgaaagaaaggtgaaaccagacagaaaagcagaagcgcaagaaagaaaagaaagcacggaagaaaggaaacgaggaagaaagagagagagagagagagacgtgatgtgatgtgtaagagagaatgaggcaataacagaattggcgggacataagaaaagagcgtcttctaggcggccgggaaatcgaggctctggaggagcgggaggagctctgtccaagtcgcctttgtgacggtgaaaaagtccacctgagcgcgaatgtagtcaccgaagatggcgcggaacgcggtcgtcttgctgcgattaaagaggtcgagctcctgcatgacgagcttgctgaacgcctgct

SEQ ID NO: 55375 - DNA, 427 bp, Triticum aestivum
  Clone ID: PAT_TA_55375
cccattaacactcgatgacattctcgaactattatcatttacagtgtcattttacagtgttccccccgataaatactgacgtcgccagatagataggcgcgccactggattgatacaacattgactacactagtaaagaaagaaagagctcttggtatgaatgaaataaataacactgcagtgctggattgcttgaaagggaatcacactggtgaacagtttcaccaggagttttggttttcacgagaccgaggaggctcgttcagaactctgcatggcttggtaggtcgatgacgtcccgtcggggcgttccgctccagaaggaaccggagttctggtagaatacgtgtaacaggacggctgatgcaaggaagagcgccaagagtatgagccagatttggcatccttggcagtcatcaggcacatt

SEQ ID NO: 55376 - DNA, 536 bp, Triticum aestivum
  unsure (1)..(536): unsure at all n locations
  Clone ID: PAT_TA_55376
ggggggggggtttttttttttttgtgtggggttttttgggggggaatttttggtattttttttttgaaatttttattttttttttttatggggggggggggtaaaaagggggggttgggagggttttttttttttaaaaaaaaaaaaatgggaaaaattttttttaaaaaaaaattttttttaattttttggaggggggttttttaggggaattggggttagaaaattttttgatttggaaagttaaaggtgaaggatttttttgggggggggggggaaaaatttgattaaggttgaaaattttggttaaagggggttattaagggggggaatttttttggggaaaattttgggggagggtttttgaaaaaaaagattgggttaatataaaaatggttnntgtatataaaaagggtttttttttaaaggggggagtttttatggaataaaattgggttggggaaaaaaataaaaaaaaaattaattggggaggggtgaaggtaaattttttatatatttggggggggggaatttgg

SEQ ID NO: 55377 - DNA, 424 bp, Triticum aestivum
  Clone ID: PAT_TA_55377
gctgaaaattactattaccatagtgctattgtagaacaccaggatttgacagtttacatttatctgagcagttgcaaataaaatagctccgataataaatgctaactgaagcgacatatgcaacttctattattgcaggatcatatcattctagctcgaatggagccgtggctccccttttgttccatgttccccaatatgcttaccagcaaatgggagatatgcatctctgattgcatgcatctctgctgctgcatttcttatcaacgtccgctctcgaggctgtgtctttgagcaggatatgccaagcctgaagacagaaagcaagcactcctggattctactagtggtaatatcatccttcggttctccatgtagccagattgttgggtcagctatctccatggttctgtcaggaagagca

SEQ ID NO: 55378 - DNA, 468 bp, Triticum aestivum
  unsure (1)..(468): unsure at all n locations
  Clone ID: PAT_TA_55378
gatgtcaaagagttttattcagacacatataagcagcaacactcaacaaatgagacatgccagtcacaaaagggatagaaatgagacgtgcaacaaagagtgaagaaaagaagagaatcatgaaaatcaactattagcagcacacagcatgcagcttatgtttcaatcaatctcaatacaaggttcctcactgaataagactttatgagtcaggcaaatgctttaatgctttacagccaacttattactttccgaatcgagagcaattagggttccggagccagtagtaggatatatcgacaagggctgagagggccttatgctgaatggagcctcgggtcctattgtccttctactcgccctgcctaacaaaaaaagggaactcgacacctacaaaaatagaagttgataacacggacagcgctaggttcgattcttnagtctatgctnatctgtactcctagaaca

SEQ ID NO: 55379 - DNA, 418 bp, Triticum aestivum
  Clone ID: PAT_TA_55379
aaagactataggtcgaaacagtggcctttatagaatccgactgctagggatctttgaagttaacagttgggaccggatacacggtggctaatggcattcttactttttacacaccactaacggatactccctggccaacgccaaccctaacagaccccgtacccacaaactgtgacacgatctcaaaacgttacactcaaggcagtgacataaagttcgtaaataacatggcttttcacagaaaaaaaaccatagcttcttcggtgatttgcacaagccagaaatgctatttggccacagctgcaatcttaaaagttgtggttttagctgaagcacttgaggagaatcatgggctatggctaaaagcactcatgttccttgaccatacttaacgatgaatgccacctgacctgctgac

SEQ ID NO: 55380 - DNA, 378 bp, Triticum aestivum
  Clone ID: PAT_TA_55380
gaaacaagggggggggccaaaaggcccccaaactttttttggggttacaaaacgggggaccaagccaaagcaacaggccccacaaaaaactgaaaattccaaccccgcccctgaaatatgcaaaaaggcccccaaaaatttgaaaaggaacccaattagggccaagccactcccaatggaatcaaaactggccggggccggggaaaaaaccacttgggccaacaagtttttcaccggaaaaagccggaaacattgagctaaagaagccctcccccccataaagcttaaaggctaagaaaaaaaggtttggcccccctttgcccaaaaaattcgggggggcggggggcctaaaagccggttttcccccgggagccccaa

SEQ ID NO: 55381 - DNA, 586 bp, Triticum aestivum
  Clone ID: PAT_TA_55381
aaagcgcacaaccaggtctatgtttcaacttgactttcgagcgcaagagtttataatcatcgggaaagacgtgcgttgcacgtgcacgcttacatagtagatataagttttttttttttgcaccacagacctcgtaagtccaatcctgatctcgtcctccgtgtcccgcaacctgagccaccaccgccggaccgtggcaatgggtgtatggaggaacggaacgtaaagatggatgtacgggttgactgtccgcccgatctttagcacctgaataataacagacaagaaagccaggaaaaatgacagtgagtaaagattgtcagcagcaaagttgtaaactgctaaaggaagtgttgctagctggagaatgatagttactagggtacacataatcatcttggataacgtgcagcaaaacacaccaaattatgcctcacgttattcccacatctgacgcgaatgcatagaagcaatgacaaggaagagataaagatcagatgtgcagaagacaacttacattccagtacatgaatggcttattattattattattattattattattattattactattactattact

SEQ ID NO: 55382 - DNA, 136 bp, Triticum aestivum
  Clone ID: PAT_TA_55382
attcacgaaacaacatatcacaactcaaatcgaagagagggcacgcctgggccttattcatgaccccgacccactaaccctcgcaaaaagaaaccggggggggtggtaacaggtgaactgttggcgggaaaaccgg

SEQ ID NO: 55383 - DNA, 451 bp, Triticum aestivum
  Clone ID: PAT_TA_55383
aaaaggcaaaccccgacgaccgaatcgccagtttttaaatggccacatccacagaaataaaaatggtccaggggcggggtttcagtatcaaatagagtccatttttcaggcccagcccatgaaaccaaggggacggggggttttagacccgggcccccaaaccaaaggcgaaacatagaagaggattatcaggtcccattcatacaaataagggggcctttttttttttgggtcccaaagggtggaaccttgcccagcccctttgccctgggttaaaagcatgcccctgggaggggaaaaaaaagccgccaccctgcccggggaagttctgtctgggcccccaaaggaacttttaagtcttctcccccagcagttaatctccagggctgtctgaaagggggggcacccatccatgccattcagaaggccctggggatgcattgaagcaacc

SEQ ID NO: 55384 - DNA, 531 bp, Triticum aestivum
  Clone ID: PAT_TA_55384
ggaggggagggcgcgggttggactgggacttacttacactgaccaaaaaaaattttagttgcccacataaaaaaatgtatgctaaggcataaagacaacactccagggggacaaaaaggccgggccaaaaaccaaagaacacgtaacgtacatggggaaaaggggcgcgccaaaaaacgtagcaaaaaacacagggaacttattaaccggacacacgaataaaactggaggggtttcgccctgaccaaactcacccacgaagacgggctttaataaaaagggggcgagcacaaatagagcccccggggggggggggacaaggcccctcatcgccggcaggagggatcccccgggggcgccgggggggattgggcctcccgtcggggagccccccgcgaccgggacggggacggggaacttaatgccgctggcgcaagggccggggacgtcccaaatgaagaagtgcaccccaggggtcgtaagcgtaatggtggtggcccccctgtcgtcgttgctaaacgagttgccccc

SEQ ID NO: 55385 - DNA, 495 bp, Triticum aestivum
  Clone ID: PAT_TA_55385
aaccgaacccaccggaagggggcgggctttattgattgaaaccccaaaggcgcggaaaaactgaaaaagtttggggtaaaaaaacataaaaatagcatcgaccaaaaaaactatttatgcatggatgtatttgcaaaattaatggccaaaggggacacctcagggggggggctgggaaaaaatttggtggaaaaaaggaggccgggggccttaaactcgtgggggctgggggaaggaaattgggccctccaaagcttgggaaagggggggtttttgtccgggaacccgcccttaaaaaacgcgcccacccacttgccgtccttaacccaatacaacccaaacttgggcttggccaaaccgggggcggaattcccaaaaaggaaggggtccccaacattggccccgaaaaactgccataacagggcaaacaaccccaaaaaaaaatagggcaggtagtcttactcctccacgggggaacccgcctttttccccttg

SEQ ID NO: 55386 - DNA, 507 bp, Triticum aestivum
  Clone ID: PAT_TA_55386
gggaacaaaagcaattgatgcattttccaagttaccgcgtcatcatagcgcacaactcaccgatgaaattaacaacaaaagaggcttaaactagctcaatatttctcacacatgtactcctatattgacaaaacataaaggagaacttgaagacctttgatctcgaatgatcttttcaagttcccaaacatgactagcaagtccagttcccttcgatacgggcaagggatacggatgaaaagaattatgacttcatcatgtagcccaggaagatcccgatcaaagctacaattatgacaattacaaaggaaaaccctccaccgcgcctcttgctgacttcccgtctcatcatatcctgggacataaacaaaaaaacatgatagaagtgaatcacagattcgtgacagaaaagtgtagtaaatataaattgtttcaaacaaacatctctcttcttctattagctttagcactagatagaataatagtatgcatagcctatattttagg

SEQ ID NO: 55387 - DNA, 564 bp, Triticum aestivum
  unsure (1)..(564): unsure at all n locations
  Clone ID: PAT_TA_55387
nattgggtgagcggccgccctgggggggggttttttttttttttttttttttttttttttcggggcattcaggattaaatagaaaattaagggcgaccaacacagcaggcttaatacgattcaattcgttagaacaccacccaaacaacacgacagattgtttgctacctcgaccgggggggggggggaagcaacaacaacctgagctagtttttggaactgaaatgaaattcatcgaccggtcctgtatctttattacaccacacgtgaaagtaaacaggaccagggtctttttttagtcagcatccatcttttccaacgccgcctgcgctgttgccttggcctgctccaaaaaatcactcggaaccttctcgggctggcggttagattcctcacatacccagctcagttccagctaaaaagatttgtctttcgcttcgtcgggtacaccataaattatcttggcaacctaaacgatgccttccctgcaggttagctcaaaaagcttcaatttctcaatctccgtttttgcagctggtcttcctttacccagagcaggaccaa

SEQ ID NO: 55388 - DNA, 209 bp, Triticum aestivum
  Clone ID: PAT_TA_55388
ggaccaacccataaaaaaatcgggatggttttaaatcccacccaaaacaggaaaaactttttgagttcaacctaggactggaacagtttacaaaaaagggggttcattttgttggcaaacatgacttggccccgacttttaaaaaaacccaacggggaacttgcggggatttttgggcctaaagtgggggccccttgcacctttttttt

SEQ ID NO: 55389 - DNA, 385 bp, Triticum aestivum
  Clone ID: PAT_TA_55389
aagagaaagtagcggccagagcagagccaactgtgctttattattattataagcaccatgagcggggagccagcgaagacatacaaggcaggagcagggaaaacgcagccgccgggaaggcgccgggagaccatcaccgggcggatggatcggctatttagctatactacgtacgtgcaccagacacgcaaacaagaaacaacaggccagggaaagcagaggatgaaaaaaaattgaagcaacgggagcccatgcgtacccccaagggggtgggggcgagaaccaacttggctttggcttggctcaggcggctaaagggcgaggaccaggccggggagggagttggggacacggaagggacgagaaaattttgcgaaacccactt

SEQ ID NO: 55390 - DNA, 565 bp, Triticum aestivum
  Clone ID: PAT_TA_55390
ggctaggtccaagttttgaacaacaaaacaaaagtaaagatgtttgcatacatttacacgctccacagagccgcatggatacatgcaggccggaatgtgtgcttatttacgtacgtacgtaacatttgtagacgtataaatattcgaacgcacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcgggcgtccacgactgcccggaaccccagaagatgttctcggcgaacggtccgacggagtgctgaaaccggaaatcgccggcgcgctgagcctcccatcctgggcgtacc

SEQ ID NO: 55391 - DNA, 501 bp, Triticum aestivum
  Clone ID: PAT_TA_55391
gcgcacactgcggcctcagaagccaatccaaaccagagccggctcccacccttgcaagcacaggcatgaggccgcaggcgctggtgctcgagttgggcgtcgtcaacgtccaaacagcgctgaccctcacacatggtcaaggggcaagcccgcggccgtgctgggacaagtgtggcaagagcaccaagtacagcccaaccacaggcaggcggcacgtaggtaaacccgaccggatgcaagtatggtggccagagcagagccaggtctacccacgggtaacagagcaaggacagcatcaccaacttatggaagcgccggtacgcacccatcgcgacaaagagccggggctcatctccaggtgacgcgggcctgaataatgaccgataaacatagagcctgcactctatctgactaaagccgagcttcctgggaatgcaacggggaggagatagatgcctagaaaagacgagggtcagaagaaacatcggagtttgctgcaac

SEQ ID NO: 55392 - DNA, 513 bp, Triticum aestivum
  unsure (1)..(513): unsure at all n locations
  Clone ID: PAT_TA_55392
atcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccant

SEQ ID NO: 55393 - DNA, 685 bp, Triticum aestivum
  unsure (1)..(685): unsure at all n locations
  Clone ID: PAT_TA_55393
caaaaaataaaataaaattgcattcaaagttgtcatagttaatttgcactgaaaacttcactttaccctttgtactgtacatatttactgaatttacactttggacgacagagagagatgtgcatgccctcgcatgcacaatctccccggcactaggaaccttccctagacgatgacgtatatacatattccacacgtcagggtcaagcaccgccgccgacggccggccagccggcagcgcgtccaatcagttcccgtcacgcacgtccgtacgcagctgcgaggaatccgccgggcagccagctttgagtttttgactaatcccccgtcgctttcgtctccgggcagtgattagtcaaacccaagaaccggtcgccgcgggcgcgcgcgcaagctccaccgttcttccacgaccagtcacgacgagccatcgatcaccgcgatgtctggctccacgcccagggcgacggcgtgccgacgacggcggcggcggaggggccggagaccggtatgcccatggcgacgcggcaccagccgggctgcgcgggcggngcggggtccgggcggngggcgacgcggacgtcgccgaggacgcgcacggcgaggtggacgacgccgtgtcccggcccgccgcggcgcgggcagcggaccgagtagctgaccctgcncancgcgcgcggcgggc

SEQ ID NO: 55394 - DNA, 308 bp, Triticum aestivum
  Clone ID: PAT_TA_55394
agaaaagaagcagcttagctgcccaagattttaaatagttcttctttctgagtagttccagaacaaaaatgggcagacggcaacatagagacccacctcacatcacagggaaaactactcacatgcttggcgatagttctgctgttccatatcagaaaattgcagacaaactgcattatgatcaaacatttgttttttccacaagacgatgccccctctcattgactgaatctactcgtgtgctgagttggtttttctaccctttcgcgagggaaaaaaatccctatgattcttttggagatcaaaag

SEQ ID NO: 55395 - DNA, 556 bp, Triticum aestivum
  Clone ID: PAT_TA_55395
ataataattgactcccattttattatgtgagaaactagcacaatacgtttttgattggagcatcgcaattatttaagactcagaaacacaggatccgcttatttcagttatatgtacagcttactgctggagggacagtcaaaccccccatgaggatacacttgatggtggggtggaattggccaatgcgataccgaaccagcaacagtacatgtgcctagggcagcacacgtgaacatgcgcccaacgcggagcatagaagctcgatgtcctacccttgtgtggtatgatcatgagcaatcaaacgtcgtgccctgagaaaaacaatcaacacttgaaacatgccattcttcgacatcggctaacaacacgaaacaacaaacattatatgcttatgcagctttgttagacgctttagcagactcaatgggtcttacccggcaattacataccgggacccagaggcattcgcatctttacctatagtgacaaggaattacatctaggcgactgaatgcaaattgctatgccctgtgacaaatagctatccattcac

SEQ ID NO: 55396 - DNA, 537 bp, Triticum aestivum
  Clone ID: PAT_TA_55396
gttgggaacgaaggaatagggggaagggggggaggggcaaaaaagagaaagggggggggaaggaaaagcaaaaggagggaaggaagaaaaaagaaaaaaaaaaaaaaaaaaaagggaaggggaggaaagggaggaaggaaaaaaaaaaaaaaaaaaacaaacccgaacccaaaaaaaaaaaaagagaaaaaaaaaacaaaaaaaaaaaaaaaaaaaaaaaaaacaaaccgaaaaaggaaaaaagcagaaaaagggaaaaaaacgaaaaaaaaaaagaaaagaaaggttcaagaaaaggaaaaaaaaaagtggggggaaggaaaaaaagcaaaaaagcaaaaaaaggaaatcttgaaacgggcaaaaagggaaaccgcagaaaaaagggaaaaaaaaaccctggccaggaaccccccgaaaaccacgaacaccaagggcacccgcaaaaaaaacttaagggaatgtaaggcagagagccccaaaaactcgaagctggccgggttgggggggggccgggctcgggccgtaccaaacgaa

SEQ ID NO: 55397 - DNA, 420 bp, Triticum aestivum
  Clone ID: PAT_TA_55397
gggaaaacaaaaattaaaaagggataattggaaaagttgctttttgaaccaaaggggttttatttttgtttaaaaaagggggggaaatctaactaaaacttggggggaaaaaaaaacaagttttggtgtaaatgccaaaaacccttttcctaatccattaaaaagctcccgataacatgaaccatacctttaaaagggttgccccccctgggaaactggggcctttatgggaaaaaaggaaaaacttcgggggccctcggaaaaattttcccgggcaaaaaaaccagggattttttcatgcaggattggtagccttttagtcttttaccaaaagggcttattgctccgggagttcactgtttataccatttttgccaaaaaccttttggggggggaaatttatttatttgctgggaaaaa

SEQ ID NO: 55398 - DNA, 262 bp, Triticum aestivum
  unsure (1)..(262): unsure at all n locations
  Clone ID: PAT_TA_55398
gacccacgcgnccgcacacaccacacacccngancncncactgcgcgcgcggggacgccgcgagnagcaaccaagggagaaaaggcgccggngaaggggnncgggccggccangncgaccaacgcggcccgggngcnggngngccnggaggagggcggcgccgagnccgagggcgncgacagcganncaaggccggggggggggagcccngagcancncgncagaaacccgnncggccaaancccggccccccaggangggg

SEQ ID NO: 55399 - DNA, 451 bp, Triticum aestivum
  unsure (1)..(451): unsure at all n locations
  Clone ID: PAT_TA_55399
gacccagcgnccggcagnggggggacggcncagccagcccggacgcccaaacgaagcaaccccaaaacccnagaccacacgcgccgccggccgagccccacgacccccnccgccnccgccaccgcccnccccgncgcccacgaggcggnaacccnaaccgcggcanccgccgccgccggagcaggaggaggacgacgagggggcgcgcgagancancacganacaggnggggcaangcgggaaccagancggganggagnncnggaagcagcncngccncgagcacggcancggcaaggacggccnccncgaggaccccgccacgcagggaggagacaggaaggangnnnnnnncnaccaggcggangancagcacnacanacccagggcncnngcganggancnagaaccaagagggancaagggganacagaacagggagggcaagaac

SEQ ID NO: 55400 - DNA, 685 bp, Triticum aestivum
  unsure (1)..(685): unsure at all n locations
  Clone ID: PAT_TA_55400
cgtnttcttcgtccgtcgcacgcacgcacgcacgcgcatacctcctctcatccccgtctgacgaggagcaggggatcgatggatgtaaggttcggcttccaatccatccaggacgccggccagtccaccgggggagagtccaaattgtgcacgcgaaagccctaggcgccgcgcataccatcttcgccgcctcgcccagctcttgctcgccttagctcgcggagatggagcaggacgcgccgcccgtgccgcaccaggcccaggacgacggcgccgtggacggctgggcgcgcgacgacacggagccctcccctacggcgtcccggcggagtgctccgaggcgtagatcctcctccttgccgccgcctccgtgcagccgctcgtccgcaccctcaactacgactcggtggggaggagccctgggacgacctcgacgcctgttcccgcgaccacatccactgcgtccgccccgcatgaaagccgcatggattggggatntgtacttcggtttgggttcatctcaaggggcctttgttgcgcctttgtctcaactgtcggggatctcaagttcccatgggtcacgctttgatcaagtgccttctggtgctgtgttgattgcgacggcaattgctggcggccggagccttcgctgcgatctttgcctccttgcgaaatctgctagggt

SEQ ID NO: 55401 - DNA, 522 bp, Triticum aestivum
  unsure (1)..(522): unsure at all n locations
  Clone ID: PAT_TA_55401
gacccacgcgnccganacaggnaagcagnaagcagngaagaacagcgagcanccanggcgngcancaanaccgggcagagcngcnccangnncaaaggggccaaggcngaggccaggaggggcagagccagcggcggcgggagccccgggggccgggcgnccacanncangganggaagcgggcnccggcncgggcgcgacgagaaccccgacgccancancnccggggaggggcccgagaaccccncccttcncagcnacgacgaccnccgcgcgnaccnccagncccagcagcagcagcaacagcagncgccnncccacgcngccgancagcagcgggggccgcnccngcgcgaggccangnncacgcccgngcnganggncacagcggagcaggcgccggnggaggnngaaagccacnnncagcncgngnaaggccccccggnngncgacagcgcncgnagangcgncggggncaacgnnaagagcgancgcgngagggcnnnacangggnnaaagacg

SEQ ID NO: 55402 - DNA, 414 bp, Triticum aestivum
  unsure (1)..(414): unsure at all n locations
  Clone ID: PAT_TA_55402
cccccacccacnnngagcgccgcaggagagcaaagcancaancaaccccagggcgcgggggcggccggcnccggccggggccgcggcgacgagcgngangggancgccggcnncnnnnccacgggagcngcngnncgnggncgcgggcgcggccancgccgggggcgccgngcgggcgggggagngggcgnggnggaggccccggcgccgggaccgcgcgcngcggncgcagggcccccgcggcacgccgnaccgcnccgnggccggngacgcgccgnnggccgagaggcncgacgaggaggcgaggncccggnccaggccggngggcngccacgacggcgggccccgggccnngccgcngnnccaccngaccaggaaggagcacggggaaagggcgancacggggggggggcc

SEQ ID NO: 55403 - DNA, 426 bp, Triticum aestivum
  Clone ID: PAT_TA_55403
ggatttacaaataaaacaaggccaagtatacaaaaaatatacaaggttctggccttgaacttcagaatccctaggtctgatgttagtgctctcttccaactgagcaatatgcagagcctctggtacgcggctctgtcgccgccacctgctactttaagtcggccaacggcctcgctggaaactggggcttatccatatcccgactcaatctccgcgtcgccctcctcgctgttgcggatgcatctttgcgtgcttgttctgcttgagcccgccgtctcgccgtgaagccctctgctgcagcctctcacttcactgtcgacgacactctgcttgaacctgtctctgtgcaggaccggacaaacctgttggaaagacacttgagatggaggcctgattgttgtagttttaatagtttagggagcacct

SEQ ID NO: 55404 - DNA, 448 bp, Triticum aestivum
  unsure (1)..(448): unsure at all n locations
  Clone ID: PAT_TA_55404
cccacgcgnccgcccacgcgnccgcaggagcggagccaacaaanccccacccaancncggcggcgagcgacccgaggcncgncgaanccccaccgccncaagnnagcagaannngngaagacacncacgggcaagaccancacccnngagggggagncgncngacaccancgacaangncaagggcgggagccaggacaaggagggcannccgccggaccagcagcgacncaacnncgcgggcaagcagcnggaggacgggaggacccangcngacnacaacanccagaaggagaccacccnacaccnngaccngcgaaagcgnggaggcangcaaaacgacgagaagacccagaccggcaagaccaacacaaggaaggaagagagcacngacaccaaaggcgacggggggggcaagaaccaggacaaggagggcgaggcgccgggcc

SEQ ID NO: 55405 - DNA, 467 bp, Triticum aestivum
  Clone ID: PAT_TA_55405
ccagggggaaaaagggttaaaggccttttaattttccaacaaggcccccccatggatttttttgggggggggggaaaccctggggaattcgcagttttttttccccatcctttttttggaattggccccggggaaccaaaatcccaaaaaaatccccttgctggtcattagaccggaccggggggcccctgtttatttaaaattttcgccccccggaaatgatgggccccgggcaaatcgagaaaaaaccgcccttcatcatttttttttgataaaggggggcatggatttaacattttgggttaacctttttcacccaaggagaaaaagggcgccgtttaatgatcctccgggagggccatgagggggtcaacccccccacgggccgaacccgagggaaaaaaaatcatggggccctattggggcaggtccgggggaacaaacgggggggggggcccagggccggg

SEQ ID NO: 55406 - DNA, 249 bp, Triticum aestivum
  Clone ID: PAT_TA_55406
acattagcggacgaaactctgccatcgatcaaacagttgcacctccccaaaaaaaacagttccaccctttgcgttcccgtccaatcaactacagaaaattagccacaattaatgggaattaacacgtctgcctcacaataaatgtctaaacttatgggaatcagctcgatctaccagcctttgcccacccggacgtacgtcgcagccgcccagcctgtcctgcgccggacgcgtgggcggacgcgtggg

SEQ ID NO: 55407 - DNA, 584 bp, Triticum aestivum
  Clone ID: PAT_TA_55407
cttatctttttgttatggatcaagacacgctgaccgtgctgcatcaaggccaaaaaaacatcaaaaggcaacagatgggctcaccaggacaaacaaccatcaaatagcgtgtacttgaacattggttccaaacctgcaaacaaaggcttgtagtcgaataggcaaaaaaggtaacatgtaccttccataaccatttagggactatgacatctgggacgaaactgacctctgccttccagaccgcattgaatcatgaaatgctcccctatggcctgcagcatatgtaaaatatgcaccggctggggtagattttcttgctgagagacctacctggaggatcaactagcgctgaggtaacattctcactgagaaacctattaggaggagcattatgggcattagaagaaggtgaaggtctcctccttgaaggaacacaatgggtactagcatgacctgcatattaattcttgggaggagcaaacccaacatgagacggacatgaaaatgacctctaacatgtggagacaacctcccatcatgaatctgaatcatgagacctgtatggctaatgctggtactgaact

SEQ ID NO: 55408 - DNA, 537 bp, Triticum aestivum
  Clone ID: PAT_TA_55408
aaaacatgttcgcatttttttcatcgaggtcgctgactgactgaaagtgactctcaggtggagcacagccagacagcttcagagttcagactttctgttggtaaatgtaaagatgcacgagtggccaatctagcaagccgcctggattttttacgatcccattgtgcctggctcgctcgatctgccgcacctacagtttatttatttcagcactttcttatcaccattggggagcagagcactccatgaactttctctgttttgcagatgcacaacagccgggtcagggtccaccggtgcaaagcccttacacggccttatgtagttatgtatagcgcatgccgtcgacgatcaccgtagcagggaggcatgatcgatcggcgggcagcacacgggcagctacaaaatgtacagaggtgcaaatcggcggcgcggcgcgccgattagcagatgatgcacgagttggggtcctgctcacggttgtaggcgtggtggaacgggtgcgggtggatcggtggaaacacgaaccaaaactgc

SEQ ID NO: 55409 - DNA, 344 bp, Triticum aestivum
  unsure (1)..(344): unsure at all n locations
  Clone ID: PAT_TA_55409
atgcccatctgcggcagcatgccgaggtggccgtggtgctggtgatgcaggtgcgccgcctgggcggcgaggaggtgcgtgctgccacggagagcggaggggatggggtgcgtgtgcttgccctcgtacgtggtgatcaccaccgccgggtcctggaacgaccgctccactctcttcttcaccacacacttctgcgtcgngcatcggnagtagcttctgggatatgggctgttcttgacggccttctggccgtacttgcgccagcggtagccgttcttgaggtggncgacctcgctcttggntatgaaggcgaaccgcggttgccgtggacgcttctcgnnctt

SEQ ID NO: 55410 - DNA, 255 bp, Triticum aestivum
  Clone ID: PAT_TA_55410
caaaaaagggaaaggtttttagggtgtccccaaaggaaaattgggccggggggggggggggggggggctttgggtccccccggttttctttttagggtatttccaaaaaggggggcttttccccggtgttgggttttgggggggtttggttgttttagaatcccccgggtggcggttcaggccgatcaacgggttttggatttggggctggggatcagggaagccttttgggcctggccgggggcccgggctcgg

SEQ ID NO: 55411 - DNA, 233 bp, Triticum aestivum
  Clone ID: PAT_TA_55411
gtctgggggtcactttttcatttcttaacggttcccccgcggccgtttggaccaacggataacctgggggcccccttggtgctgaaacccacacagggggcgggcccgtccgggaaaaccggtcaaatggtcgtccgggcccccccggccggtcgtaaaagggtgatcctgttgggcccgcgcctgggcgttttctggccaccgtggtggcggtgccccctgtgaagggtgga

SEQ ID NO: 55412 - DNA, 579 bp, Triticum aestivum
  Clone ID: PAT_TA_55412
cttcattaacttgactgtgaacacttcattaatttgaccgtgaacaccacaactgacaagtaatagtacaggcaaatatgcatgcatattacaggcatgcagctcgctcacaacagcaagccacagacatgcggaagtacgtacttgcgtgcaccaagcgccacaatttatggcatcacaacaaaaccacagagcataccctgcggaccgatcgaacagatcatacatactacgtgtacgtctgccgtattaattagtcggcgatcagcacgggctggcctcgacgacctcgacggccacggccggctctggcatggccacggcgacggcggcgccgaccctgggcacggtgacggtgagctgcacgccgtcgtcgtccatggcggtcctgtcctggcccaaggcggtgttttcggggaggtggaacctgccgaagaaggtggcactgttgcgctcgacgtggtggcgtcgtttgctcttgggctagcttcgtaggtaccgtgtcgtcggtggtgtccaatgccttgtcgatctgctatcacctgtaccttgtcctgctttcggtcgcgttgttttttc

SEQ ID NO: 55413 - DNA, 337 bp, Triticum aestivum
  Clone ID: PAT_TA_55413
ctggggcaatgctccctttccctgtccctttcaaagatcatcgcggggctccctaaatccggggaaaagggggaaacttcgcggcaaaaggctctcccccaggggggggcttgctggcttccaaagctggcgccctcgggcgcctgcgtgctcagcgtgccttgtgccgtctgcctggctttgtggacgtcttggggcacgtagttccggttgcccgcgtgcaccatcatctatctccgtggctccttttgcccggctccctgctctctctcttgcctgcgatccactcattccctaccggtctgcgccgggctctgttcatgctcactggcgatgc

SEQ ID NO: 55414 - DNA, 251 bp, Triticum aestivum
  Clone ID: PAT_TA_55414
cgctcaacacaattttttcatacatttgtcgtgtttccctgttacttccacttgggttggaggaagatcacatggggcgctcccagggggcttttggccaaaaggatcacaggggccagccctgcccggcctttccttaaacaactccctgatcctcaatgggaggggcaccccgcttctctttgcgggccccccgtgtctctttgcggaaagcctttttcgaccctcccgtcccggcgccgaccgcttgg

SEQ ID NO: 55415 - DNA, 550 bp, Triticum aestivum
  Clone ID: PAT_TA_55415
ggacagggacccccttattaataaaaagcatcaggcggaaacataagaggggttaaccaaaacaccaaaccaaactggggccctaccacaagaatccccacgaacaaacttattccaccgacgacgacccatccgacgcctaaacccctgataaaccaaccaggtagctacataaaaatttcaaatccaaacatacatattgggcctaaagcttgaggaaaacaaactcctcgatcggggggatctccccaattttggtcaggggggccttggtgggctcctaataaacaccgatcgccatgacagccgttttggggggagcgatcctcccgacgctaaaaaagctgacgttaacgttctcctcgccaaggacgcttccaaccgacccgataatgcccgggtggtcaacctgcctgcaaaggatcaggctgccctccatgctcacatccaccttaaacgctccgaccttggtaaggggagggatgccgtccttaacccgccccttcaccgggataaatccggactcggatatcgcactggggaatttgga

SEQ ID NO: 55416 - DNA, 696 bp, Triticum aestivum
  Clone ID: PAT_TA_55416
acgtgcttgtggaaacagtggactccatagtatttcaaagtcatgtcaccctatatccacactaaggcaatgcattatttccatcctaccgaagctagggtcctatgttttctgttgttcctcaattagatcctcctagaccattacaaaaaaaaactgttacataatcccacgacaatttgatccagcaagtaaaagaaactctttgatctttggaacttaatgctttctcctcgtaatcgtaatcacaaaatcgtgatgaaacgtaagccattgtgatttgataccccaaggctttgccgactttgccacctcagcatcgaaatgtcgaaagaactgagcgatatacaagtggagttcgacaattgccaaattcttccctatgcagctgcgactgcccataccaaacgtcatcaggagagatttctccttcctaattcgtgcctcgtcgtctgggccttgggcaatccacctctcgggtcggaactcttctgcatccgggccaaatatctcccgtgaacagtttactgctcttgaactagtgccacaagttgtgccgggaggaagaaaatagtctccaacctgagccccttctgatgggacgttacggggtagctgatactggattgaaaggtgcacccgattgctctcggtgatgacagcagacagatatgggagcttttctgcttgcttgaa

SEQ ID NO: 55417 - DNA, 533 bp, Triticum aestivum
  Clone ID: PAT_TA_55417
gcccccccaaaatggtggcctttcaagggagggaaaaaggggccaaacaagaagcacaatggccattggtttgctcactaggggagggcgggagggcaccatgcctgcctgcctaaaggacaaaaaggcgagcccccattaagggggaaaaaaatgggatccccccccaccagaccacaccaaaccttaccttaaattaccacacatgttggcatggacaacacccccccccaaaaaccaggggaaaaccccctaaacattaccaaatctttgcaatcgtgccaaagcaatcgggtggaaaacactccacggggaaggggggccaacccgcaagtcggttgcttgtcccggtgttcaacaacggggccaaaatctttaccaccaagctcatttttggcccgaaaattgcctcgttttgcacccacaagggaaccccttgaaccattttggggaaaacctttggaggggaaaccacaccaaactttggatctacacattggcccaccctggctttacttaaccctgggggaacc

SEQ ID NO: 55418 - DNA, 515 bp, Triticum aestivum
  Clone ID: PAT_TA_55418
ggcgggaacaaacatgatgggtttcaagatcttcatttacaaatctagattttgttagaaaaaagggggacaaaatcatgccctgggctcttttccccagaaaaaaaatcaaacatcaaaatccaggaacaaacatgattggccccaagagagagggggaacccatcatgttctttttcatgggggagctgccatgaccctgtccaaatcgattgaaaaaacttggatggccgccatttgcccgatcgacgagcgcccccagtttttcccccgggcacgaacctgccgggccctttttttccatggggggcgctgccattttagtcgaccccccacaggccggtggtgcccttccatccaccggtacccacgctaggcccccgtcgatgacgaccgttattttaatccatgccgtaaacacctggcttgacccggcccctactcccgccgccgtttgccattggtggaaccgtccccctgggcatggatgggacaggggaccccatgggaggagg

SEQ ID NO: 55419 - DNA, 596 bp, Triticum aestivum
  unsure (1)..(596): unsure at all n locations
  Clone ID: PAT_TA_55419
ccccactcagncctcggggcccgggccggnncggnnccgnncggnncgngagggggnagnagcggggaagaggaaggcatggcggacgncgagnaccgcngctncgngggcggcctcgcctgggccaccgacgaccagnccctccagaacgccttctccaagtacggcgacgtcatcgagtgcaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcggcggcggcggcggcggcggcggctacggcggccagcgtcgtgaaggaggaggcggcggcggctacggcggcggcggcggnggctacggaggtggccgcagcggcggcggcggtggctacggcagccgtgagggcggcggcggctacggcagcggcggcggcggcggcggctacggcggcagccgcggcggctccggcgggcgcaactggggggagngaatgggggggccgctcgc

SEQ ID NO: 55420 - DNA, 573 bp, Triticum aestivum
  unsure (1)..(573): unsure at all n locations
  Clone ID: PAT_TA_55420
ggaaaccgagagaggagggcccaccaagcnnaccagagggcgcaccgggaancnccggaagggcnaccaancccagcgaacggacanacccngaagaaangaggcagacgggcagancnacaanngangngaggaggggggagcncgnggncagaagaaaccgcngcccnccgcggcagggcggccacacaangaaacggccgcncagannngncgncaggcngggcnggngaagcgnaaagagaagacgggcaagaggcgggagaaggccgaggaagacaacggggcaanggggcgggcgggggcgggaggaaacangggagcggcgcaggggcggaagcgggaggggnaggagaagggngggggggagagaggggccggggggggggaggggggggggggagcggcganggggcggggcggggcggggggggggggggggggggggngggggggggggggngngccgccgcgcgcggggccgggggggggcgggggggggggggcggggcgggcgggcgggcgcggcgcccggggccgcgggggggcgcgggggccggngggggggcgggg

SEQ ID NO: 55421 - DNA, 681 bp, Triticum aestivum
  unsure (1)..(681): unsure at all n locations
  Clone ID: PAT_TA_55421
gtcagcttcttcattcgctctccaccacagatccatttcacgaacaatctttcgcgagctagcttcttcaccggttatacagccatggaggggccgtcggtggaggtgccgccgtacttcctgtgcccgatctcgctggagatcatgcgcgaccccgtcacgctcgccaccggcatcacctacgaccgctccagcatcgagcgctggctctccgacggccacgccacctgccccgtcacgcagcaaaagctcgccgaggccgaccgggaggccacgcccaaccacacgctccgccgcctcacccaggcctggtgcgccctgcacgccgtcgagcgcttccccaccccgcgcccgcccctcgacgccggccgcgtcgccgagatcgtcgaagagggccacggcgcgggcctgcagaaggagctggccgcgctccgggagatcaaagccatcgtcgacgagagcgaccgcaacaggcgctgcgtcgaggccacgcccggggccgtcgagttcctcgtctccgtcgtcaggaaccacgccaccgtgtctaaatcggctcaagatttgctagaactgtcgctggattccncgacgtccaccagctcgccggaggaggacgcgctcagcgtcatctgctcgctcaagccgtccaagaagagcctgaaccggatcctggagaaaaac

SEQ ID NO: 55422 - DNA, 537 bp, Triticum aestivum
  unsure (1)..(537): unsure at all n locations
  Clone ID: PAT_TA_55422
cngctcctcaccccaccccgccncgcgaggcgcggcacagcacggaggagncggcggagagggcgggcgngacggcgngagaggacaagaagcccgcgggcgacggcggaggcgcccacancaaccncaagggcaaggggcagganggcaangagggggncnnccgcancaagagancgacacaggggaggaagcngangaacgccnacngcgaccgacagacngnggancacaacaccaaggcaaaccgngacgaaggacgaaggcaccgnggngagcagaccccngangagcnggagaaggaggaaggcgacgagaacgacgccangcaggaccagaccggagggagcaaaccacgaccaaagaaggagcaggcaggcaaacagacggagcgaagacgggggccaccgggggaaccgggagggagggggggaagggaaagaacgggcgaggcganggcgggggggcacaacccgcgggggcgcgccggcgaaagaacaggggggggccggggggggggcggggcggggggggggg

SEQ ID NO: 55423 - DNA, 152 bp, Triticum aestivum
  unsure (1)..(152): unsure at all n locations
  Clone ID: PAT_TA_55423
cccanacctcctcccgggaatcggaaccgcgtcccagccagccccaacccattcgtcgctcccctgatccatccggcgacgcggnggagcgaggaaccaaggctcgagcagcgggcgggcgggcggagaggagncggagagatggnggagaa

SEQ ID NO: 55424 - DNA, 345 bp, Triticum aestivum
  unsure (1)..(345): unsure at all n locations
  Clone ID: PAT_TA_55424
aaaaggacanagcnnnggaagagggacaagaacaanaaanncggcaagaanagcnancccagnaacccccagaagggaaggcnnanaggnggcgcnacacnaaaggagagcanaccannaagngagcaagaagaacncanngncgggaggagagcggcngcccncccaacnncaggaagcngnnnggnngaanngagaaagaancaaggcaaagganaagggggcagggggganacagaacaacnagggacacaaanagggggnggaggaacaaaagcnggggggcagggcacccgggggggggaggggaggaaaaaacaacgggggggggggggggaaggggga

SEQ ID NO: 55425 - DNA, 485 bp, Triticum aestivum
  Clone ID: PAT_TA_55425
acacaacagggatctccaaccccccaaaaaaaaaaccaggaatctccacataaaatcggacgggaaaaaaatcgcccattgaacttaattttcatatgcatgggccccagcgaatgcgattatcatttgtatgccccctctggtcccagatgcatcaaaaagcatgtactgtatgcatgccaagtccacccttactttaaccgatcaccggaagtttgaggctgccggctgtcaacgtcggccaaaaacctggaaatcgccgcgcgcaaaaagcccccgtcgctccaagccggggccgcgcctttcttgtgtgccggggcccttgcccggagctccatgccatccttggagtccatgaccagcctaaccttgccctccaccttgggtggcttgaccagcccccgtttccacccgaacattttcgggggaactcccatttcccccaccatgcgcaaggtgttcattttttgttccgggtacagggg

SEQ ID NO: 55426 - DNA, 402 bp, Triticum aestivum
  Clone ID: PAT_TA_55426
cctgggcaaaatgctcattactgaattacaaatgatcctgcacggtactagttactcaacaaggcttcccaatatgtccggctaaactaaagcaccgattccaagagtggcaacgctctattgatcctgacgaacagaatgcaatcaagcagccttgggcttgggctgaagtctcttcagttgtgagtacaggaaaactcccgcaagagcgatcgcggttccgatagagttgattggagacacaggagtcttgaagaacagaacagatgtaacaatgaccaccacacgcttgacgcagttacctaccgaatgggtaactggtgacacccttgcgaggatcatgtatgacacctgagggtatgcatggaaacaaaatgcgataatcaaagaccttgagtacac

SEQ ID NO: 55427 - DNA, 369 bp, Triticum aestivum
  Clone ID: PAT_TA_55427
ggggcaaaacttgggttttggttcccccatttccagaatttgattttgttcccgggggaagggggttgggtggttttaacaaaggggccctcggcctaaaaaaaaaatgcttttttttaagtggggacaacttttccccaaacggttttttttttgggggggcccccgcaaccccccttgggctaattgttttttcagagggcaatagccgggccggttgttttcccggcccccaccgccaaaagacaaacggggggggcaatttccccagactgaacttttggcgggaaatttttgggacaggccccccccctccttcaaaaaatccttccttccccttgccagggggttggcaatttttccttcctt

SEQ ID NO: 55428 - DNA, 387 bp, Triticum aestivum
  Clone ID: PAT_TA_55428
gaatcacacaaaatccatcgaaaacacacctcgactcactagttttgttacagttctcggttcgagttcagttcaaattcgaatgacatatggcatgtccacgtagccacgcaggtgacatacgccacggtttctacgctagtctagcacgatggcgctggacggggtgtacccgcccgccctctgccggatactggacgggatctcggcgcgcaatacctgcaccctgaacacgatgccctcggcatcggaccgcaccaggtcgaacacgcaggcattgacaaaccttaatgcgttgttcattgcgaaactcacaccacctgactacaaacaatgaatgtgatctaaactctgtgaagaacattttgtaggaccgaccctgccgtg

SEQ ID NO: 55429 - DNA, 136 bp, Triticum aestivum
  Clone ID: PAT_TA_55429
gttgtaccaatgcatgttttatagagcagaacatgaatgtccggcaacacagtatgataagtcccaattacctgcatattcgtctactaggtgtaaaaccagatgcacctcgtacacacgcttttcatcgcataaa

SEQ ID NO: 55430 - DNA, 559 bp, Triticum aestivum
  Clone ID: PAT_TA_55430
gccaaagagaccccggggctcagacccaaacggggggggggccgaaacgacccggcccctaattcaaggccaggggggggggggggggggcccggaccatgaaaaaaaaagggaaacgaaccccctaggtctgaaagggactggcaatttcaagcccagggccaaggccccaaccaatataaaaaaaaagcccccataggccaaacccgaacgggaaagccggaacaagagccaggaccggggtccccgaacgaaagggaaaggaaaaaacacttacaataggccaaagagggccttgaccccaagcaaaagctcacgagagccaaagccccggtcccggccacactcaaaagggggcgggcccccctaacccgggggaaggcgaaacccaccaggaccagcaccttttccttcatgccggggggggcggggtttgcaaatgccccggcccaaggccaagcaggaccgacaaaggggaacgtggcccccaaaacccggggcgggagaacaacaccctggggctcaagaggggcaggggccaaaacaaaaacaagaaggg

SEQ ID NO: 55431 - DNA, 526 bp, Triticum aestivum
  Clone ID: PAT_TA_55431
ataattgtctgcaataaacaagtattacaggctgtttctaaactacatgcaatttctcatggggagcaatatttacaatcaattaatcagtgtgaatgttggtgaaaatttgtgtaggcaattatagtgagaaattaaaggagggcagatgtgctcctcctcctaattagcgacaacgggtgtgacgaaattagcaagggtaatactcttcctaagaactacatgcacagaagcaaacttgttttggattgcgctacgttactagctaagttatcccaactatgaccagcttaattaacggcgatcggcgtgatgaaatcagcaagggtaatacgccttgaggtgcacttgcaagcatggggagtccttccaaaccctagcgtgcatcttgagcagctccttggccttggccctggcccgctcgccggcgtccacctgtagaaccagcagcagcttcgctaccaccccgacggccagcatctcctgcagcacggacggagtcaacgagtgcgtcaccacggcgtgc

SEQ ID NO: 55432 - DNA, 484 bp, Triticum aestivum
  Clone ID: PAT_TA_55432
ggggggttgaaacccccaaaaagacttggggttaaaggggtttaggacccgattcaaaaaaaaaaagaaacagggccccctttgggcaaggggaatggaataaaccagtttaaaacaagacttaccccccggggacatttatttaaatcacacctgagaagaaactgggagcaagctggtaaaagaccccgggtttttgtttaaagaaaaactttttgattatgtttgacctgccaagggggcaaacaagagccggtaaccctaaagcacctttggctggggccccacccccgcaaccaaaggaggaacgtttgcctttacatccaggaaagcagggatctggaaaaacagggggaaaataaaaatccccttgacgaaagggaaaagcttggcaaaatccatgggggtcctgaaagggtttgccggcaaaggaattccccggttttaaatcggaaaacccattgagagggggccctggggatcg

SEQ ID NO: 55433 - DNA, 691 bp, Triticum aestivum
  Clone ID: PAT_TA_55433
gcatacgctgtgcccacgccgccgatgtttccgatgaacacgacgatgttttgagattccgacaccgaccagattacgttgtgctgtccacgccgcttgtcacgagcaccgcgtcatgtggacagtgatgcacgacggcgcctgctggcctcgcgctgacgccatctgcctgcccctaccctgatgggaagacgcgcaacaccatcttctgctaacccaggacatgcaccaacgcttcaggccctgctggcagccttcggcctcggtagccgccggatttccaggttctgaacgagggctgcggacatgcgggcaccaacgtgcggccttagcatgtggtggcttatgcataggcttgagcgggtgagcggtgctgctcgacagaggaggaggacgcgtccaaggctcttcttcttcactcgtcggatcccgactgacatctttctcatctgcgtgtttaacacggggacaacgacacgccctcgaccagatgtcaactttccccatgcccttgggagcatgctttttcaggttaatcatgctcgcacctcctgtactagtcggtagtaatataaactactaccaaattactatggaacacctcttgtattaccattagaaaccaattcaaaattgaatcgtaaggaagtttaccattgttactataaaatacgtagtggttactatcaaa

SEQ ID NO: 55434 - DNA, 546 bp, Triticum aestivum
  unsure (1)..(546): unsure at all n locations
  Clone ID: PAT_TA_55434
cgcaccttcaccgtctcgccgccgccacgggcggcggaggtggataagaagaaaaaaagagagagaggaactcgtcgggagggctcgagatctgtgtcgggagagagggaattcttgagatcggaatcggaacaagcgggcgcgctcgggatcggggttaccatacaatttttcccaggaacctttggggggggggctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatgtcggttttggcatccccttctcgtggtttaggatttttatgcggtggtattgtgactgtgttgtgccaccagtgtggtgtgggtgggtggtgggcggtggtgggccgggggtgtaggtgaggtggctgtggggctgtgtggtgtggtgtgggctnggccgngggcgggggggggggggggcggggggngnngggg

SEQ ID NO: 55435 - DNA, 494 bp, Triticum aestivum
  unsure (1)..(494): unsure at all n locations
  Clone ID: PAT_TA_55435
cccacgcgnccgagcnacgcagcacacaacggctcgccacccccagcaanccanccacccccaccccccnnnccccgccccgcccgagcgcggcaagggcaaacgcnncgncaggagcnggganccangangacggcaagcngaggggcgnggagcncaaggccaagaggangcaccgcggcgggggggcaggcnggagaaccagaaggagggcaggggggaccaaacgggggagcgcgaggccaccaangaggaccggaccaagacccngccngagaacgacggccgaggcgcaggggggggcngggggcnggaccacccgggaggangggccaaagagcaggaacggcggaaggcgggggggcggcggacgccggagggggggggagcgggagggcgggcgcgggcgccggcgggaagggcaggaggaccggggggcgggggggcgggggggggaggcggggggcggggccggggggcggggggggggcggg

SEQ ID NO: 55436 - DNA, 530 bp, Triticum aestivum
  Clone ID: PAT_TA_55436
cgtccgcctgatacccacttcctacgcaaaccagtttgctccaatggcgtcccagctggtcgagagccaccgcgccggggccgaggtcatcaaggggggcgaagtctgcaagaagaagtccgtcgagctccttgaagagctcggcctcccgaaaggcctctttccaatgggcgacatcgaggagatcgggtgcggcccgctcgcgggttcgtgtggatgcttcagaagaagaagagtgagcacaccttcaagaagatcgagcaaaccgtctcctacgacaccgaggtgaccgcttttgtgtagaagggcaagatcaagaaggtcaccggggtgaagatcgaggacgtgtctttggtcgaggtctatgtggatgagtcttctgctgataaggtcaccgtcaagaccgacaccggtctgtctgacacccatgatgcagccgcgttcgctctcggagaatagggagctaaatagaaatgtcacaaaataataaagtcagtgaatggttcgacactatggttcgcatgttatgc

SEQ ID NO: 55437 - DNA, 361 bp, Triticum aestivum
  unsure (1)..(361): unsure at all n locations
  Clone ID: PAT_TA_55437
caccagcagaagaggccaaaaaggaggannngcgggggacagaggacccnaaagggcngaacgcacnccannncgcngcaaanaaggggncccgggagannngcaagnnccgggnggaggacgngggggncgangncaacncggnancaagcgnaggggcgggggggggggnnnacgcngcacncaagggaaancnncaggnngccaggnancnncncgaccagggcagcganccggcgaaacccagngagaggggcnnaacgccgcngcacaangcagcagagcaggggcanngngagaaagnaaagcnggngcngnccaaaggagnngacgnggangnnancaangaccgagggacacc

SEQ ID NO: 55438 - DNA, 389 bp, Triticum aestivum
  unsure (1)..(389): unsure at all n locations
  Clone ID: PAT_TA_55438
ccggaagacanccggnggcannnncggcgggcactggcagagcaacaaggngaaancgctaggagcngcggggccaaancnngacanggnngagggngnaggnaangaaaagangcnaancancnggancgngccgnngnagcnnggggagggagccnnngaaagnnanggngcaaggaaacacgaggggagaagancaaaagcggagcgagccccnaaagngnggagcnggcnaagcangngaaacnagcnggcccaaacngaanacggncaggacccangacaanagggangaaagaaaacnccgcaacaccggaaaagggaaggcaggggcaaaggggaagccggaagagggcaaggcccngggganaccgacagaacggagggaa

SEQ ID NO: 55439 - DNA, 354 bp, Triticum aestivum
  unsure (1)..(354): unsure at all n locations
  Clone ID: PAT_TA_55439
gggggggggggggggggaacannagaaanacgcgggggggagnnaaaacanngnaagaaacaacaagaaancancaaacacgcagggcggcaaggcancganccacaccagagagcagacagaggaagcnccgaacgagggagagaaagngaaggcgggggggggggggcannanncaggcaagcgacaacaggaganganccgccgngcaaacacgcggcgggcgngcagcggcgcacgcagaagagggngaggcngaccacgcacgggaagccggcgggggaccngacgcagcacgggcaagccgaggggcaaccggacggcgacacaggccggacgcggggggcggcccgg

SEQ ID NO: 55440 - DNA, 294 bp, Triticum aestivum
  Clone ID: PAT_TA_55440
tcgacccagcgtccgccccgcgtccgcccacgcgtccgcccacgcgtccggggaggcgccagaagaacaatgatggaagctgatcttgtctgttgttgatgcgcagcttatcttgaagagtttgtaactacgtgaatgaacacacaccgcatgccgcatgtatacgcaaagttttcaccattattatttttcatgtcaagaaaaaaaattggaccatgaatggatctaatgtaacgcagtaaagatgacactctttgcaattgagctcatatgtcaaatggaaatgagaatacc

SEQ ID NO: 55441 - DNA, 737 bp, Triticum aestivum
  unsure (1)..(737): unsure at all n locations
  Clone ID: PAT_TA_55441
cttctgcatagattgagctcccgtgtcgctcccgcgggcggttcgggagcaaaccctagccgccgccgccagctccccatcgaccgtccctcccccctcgccgccgccagcggcagtcgccgggcaaagcccgcgcggctcggcggcggcggggcctttcttcctccttcgtcaggggccggcaggcgcgggccggtggcctcgactggagccagagcggctgcgcacgctcggggcggtgctgctagccggcgaggctgcgcatggtggcgctggggcttctgggcgcgcggagctggcgcgtaggagatgcgctggaggggatggctcgaggtcgcgtggatctggcgcgttctgcgcgcggtggtgcctggtgaccgcgtccatttcgcgggctcggtgggtggcggcatccagaggagcgaggcgacgggcgcgcgtggctcgtggaggcgccgcgagctggcgctgcgggcgcatgtggctcgcggagccgcggagggcgcggcgagctggcgccgatggaggcgacgggcgcatggctggactcggcgcgcgggggcgctcgtctgcaggggagcgcggcgagcggtggctgcgtcatgacgcggcggccaggtccggngcgcagcgtgtggatggtgctctgccgtcgcccccgcacggatctgcggtgctggtcaggggtggcacgtgtggggccccgggacgcccagatctagcggataggaggcgag

SEQ ID NO: 55442 - DNA, 290 bp, Triticum aestivum
  Clone ID: PAT_TA_55442
cgacccagcgtccggccatgttgattcaccatcctttttaaagaggatacaaatcttggattcgtcttttggaaagctattctggggccgtccttttaattcttgagttattagaggagtgtctccaacaaaatagcttctctccaaattactagcctagactgaaaataatcttcctgtcatatgacatggtttatgtcatggatttagcttctacttttgtagcgaaatatccttgtgttgcctgctaagaggatttggtggcacattttatatgatttcttagattg

SEQ ID NO: 55443 - DNA, 670 bp, Triticum aestivum
  Clone ID: PAT_TA_55443
gccacgcttacgcaccacgcgtacgaagtgaactgtccgtggaacatgaggacggataaggacagactgtgtgacctgatggaccataccgatgcagtttaccataggactttccgatcacaatgccatacagggactcaacctcgagtacctcaatcattactacctgcctgtaaatacctgaattgtcaaccgtggtcactacattttggataactgcaaccactaacctaacaagcctatacgatcaacggcacctggaaccatcatgaagcaatggcatttatactcctctaacaatacacacggaagacggcacattgtactatgctgaccattacatagttctactaagcgcccttaacaacactgacaaaaattgctttctatacgagatcatcttgaatgaacatttcactgaacaatcatgcaattgttaccatgaagacgatagaagacaccagagagaaggatgagacgatcattattgagtgatccataactatgctaggggttgattgcgaagcctactaccggtacatgggctcccttataaaggatgcaagctaacaggcggttatatgcgccgtcataaatatggtcacgagcatcctagatcaccaactgaagcttctcacctacgacgtccatgacggctaagacatgaacg

SEQ ID NO: 55444 - DNA, 345 bp, Triticum aestivum
  Clone ID: PAT_TA_55444
gggggcaggacccaaaggcaattttagggtttacttccacagggaaaaagcatcgttttgttacacaaaagaggggaactcaacttccctggtgaaagcaaggcccccatggcatgacagccctttgtgggggggaacattacaaagggggaaactggggacataaccatttatatcaccccgatctccggaaaaccttggacgcccggtacttcctagcattttccaccttcccgtacccgtttaacagttggtttcaaatacagccaggccttgtagctttgggccttccaagcgcgggttcctttaaacaacttcaaaaggaatgggctgagcacattcctc

SEQ ID NO: 55445 - DNA, 702 bp, Triticum aestivum
  unsure (1)..(702): unsure at all n locations
  Clone ID: PAT_TA_55445
cgcagcacaggagaccacggncacggacaggggcgacctccttccgagcgncgctttaccgccggccgnagaaaccctgcaccgccgccgnnnggnnncgaaacagaanngaatcgggctctgnngatgggcagcttgcgcgctccgcctcagctcgccggcggcaccagccttggtcgcggttacggggcctgtcttgcctcttccggggtccccaaatccaaagtgttgggtgttagctgcgcgatgaagtcctataggctgtccgatctcagtgatgccgaggttagcggcctcaaggcgcgccctcgcattgacttcacctccattttcagtacggtgaatccgattgttgaagatgtccgcgccagaggtgatgctgcggttaaggattacacagaaaagtttgacaaggtcactctcgataatgccgttgtgcgtgttagcgatctcccagatgcagagcttgatccagctgttaaggaagcctttgatgtggcgtatgacaatatttatgccttccatgtttcacaaaagtcgccagaaaagacagttgagaatatgaaaggagtgaagtgtaaaaggataacaagatgcattggttctgtcgggctgtatgttccagggggcactgcagtcttgccttcactgcattgatgcttgctgtgcctgcacagattgctggatgcaaaactgtggttc

SEQ ID NO: 55446 - DNA, 243 bp, Triticum aestivum
  unsure (1)..(243): unsure at all n locations
  Clone ID: PAT_TA_55446
caaggcccgnccctgcaggggggggagggcnccaccnccaagacggggaagcagggncacgcaaagngncacnnngnngccanngacancnnnaagggaaagaagcnngagganancgnnccnncancccacaacggggacgncccccangnngaccgccaagannancagcgggggggcggaacngangangganangncagcccccnaaccgagagnggcaacacgaaggangaccngaag

SEQ ID NO: 55447 - DNA, 671 bp, Triticum aestivum
  Clone ID: PAT_TA_55447
cccatctcgtcatccggaggcagcggcagcgacgacaccggagggacgacccggcggcatagactacctctctggcgcgcagagtactatctttccgctctcatgcggtagggactcagaggtgccgtgggtggtgtaaggtccgggcgagctcggcagcgacaacggccttctccggcttccctctccaccgccggcggtattatcgctagaattgaaattctgccaagcaatctaggagtagaagaatatgtatgcaagggacttggagacgaggcaatggtgcgctggtgagaacactatcgttctgatgggttaggaacttaggattggggttctgctgctcttcagtttgttatatcaaggttttgaagctttgggagcctgcggccggttcgacggatgacatcagcaagcgccggcccgcctcggcacagctgcgggtggttatatggtgggcggagcacacgagtgagcttcgatgttagggtatacgttccacatgcttgtgaggtacacattttgtaggtccagatgtaagtgtttgcttgatttgtcgctcaagtttcatgttcaaatgatgctgcttgacttgaatacaatgttgcacatagctggctgcggcggggagcatggcgtgtgcattctgattggaagggggggtgaggatg

SEQ ID NO: 55448 - DNA, 421 bp, Triticum aestivum
  unsure (1)..(421): unsure at all n locations
  Clone ID: PAT_TA_55448
aagggagggnccacgggggaggccggngcacaagaacccagaggggacgggggngagcnnanccagaggggnccgacgccngagccncncngncaagnnangcnncgngnnggngaccnngancgggcnancangnncnangagaaggcccnngggangaagcnncggagggggagggaggngccncagnanaagnacaccanggccangangggcnangcngaggaggacaagaccacngnncnggagnngacanacaacnanggngncacggaananaacaagggcaaggcagangcncaaggggcnangggcaccgacgangngnacaagagcgcngaagcaggggagcggggggccaaagaaccgggggggaagangcnggggggggcaggggcgcgggcggggcggggcacggggg

SEQ ID NO: 55449 - DNA, 520 bp, Triticum aestivum
  unsure (1)..(520): unsure at all n locations
  Clone ID: PAT_TA_55449
cgccgggnnnagcnagggnncnacccacgaccaccgccgccgcccgccccgccgccgccgcaggcanggccggcgccggcgccggagaggaggacgcggcgngggagcgcgccancagcgcggccgncaagagcgcgccgcncncccccnncnccgcccccaaaacccnaacccncgacggcgccggggggggcgccaccggccgccnccccncgccggcgcncnncgaccgcnnccccncgcncgaggagcncnccgncgcgggcgcccgccncnccncgcncgccggcccgccccgccncccggccccccgccgccncncccnccccgacaaccgccncgccggggccggcncccncgccgccgncgccgagncccgcggcgggaccanccgccaccncgaccccggcaacaaccgcnncgccgcggncgaggagcccgccccgcncgcaccgcncggggncgagncgcnggacccgggccagggccccggcgccaagcncaaggggngcagggagaa

SEQ ID NO: 55450 - DNA, 511 bp, Triticum aestivum
  Clone ID: PAT_TA_55450
gaactgattacggcatttgcattctatagcagtttagctttcatcacacaagtagctttgcaacagataactacctcgacatattgtagcctcagattcaggtttaaaaaaatattacaggagtagctacactgaaccactgatgggggggaaatttctactatcacgacatatccttaaatcatagcgtcataatcatccaatgcaccattatactccatgatcttcttcttgatcttcgaggaatccacccaggtgatgaagtcctccatgttcctggtcacaaggaaggctggatcggtgaccgtctctgggcctactcgcacatgcccctgttcaatgtaggtgacggcctctttaaggtgttcagcaaacttgagcttcaccataattgttgctagtctccgccttgcgaaggcgctcactgaaagtttctcacatttaaccaagctcttgtttgttggaattacacccatattatacagcttatcgatgagcacggacgcgtggg

SEQ ID NO: 55451 - DNA, 396 bp, Triticum aestivum
  unsure (1)..(396): unsure at all n locations
  Clone ID: PAT_TA_55451
ggggaaccaatacaaccattggtggataatagtttatgattggttacatcatcaagggcatgaaaaactggggtcttcaaccaatacaaccattgggaccaccatagtaaaatatgtagcccgtgggggggggaacagggaagttagtttttttgtagcaatcgggccggtgaactaactggatcatgggagttggaatggggagccgagcatggccgagggggtgggggatgtgaatatgctggaggggtgcgggggggttgtgatgggggtgatggggggatgggccactggcgattggggggggntgggggtggtggggggggggggcggnntgcggggggggtcgggtgggggtgcggtgggggggggggggggcgggggggggggcggggg

SEQ ID NO: 55452 - DNA, 751 bp, Triticum aestivum
  Clone ID: PAT_TA_55452
ccaatttggaatttagtaccatgcatatcagcatattaagagaagcctgattggttccattgatttgctatagaacgttttattagacatgaaggtgcctggcctttcttttaaaaaaatagggtaagacctactttgaagaaaaattgcttgttatgtttacgagtggagcgagaaaacaattgctaatctcctttcatatagtcatttttgtagcttagttgtccatctacagatattggtggtcatgcctttcccctcacttccctccaagcttgtcgccctcgcccccctctttgaggcagccgcccgctgctcatctcggtggcgtcaggtgcggccgtacccaccatggcatcggcgtggccctccctgcgaggagcggcgcctccttggtacgatcgcgacattgattcagccggatcggcgggggttagtaggctcacaggctggcgtttcctcggatgcatcgatgttctaatcatgatggcatgaccatagatcatatgagtctagaagactttggggcggctcatctgcgtggatggttgtggctgggcacacaatccattaataagccttcaaattttcacacagaaggtcccctccttttcctttttgcatttttttctttttaattttttagattgcttgcgttggcaaatggaataaagactcagaatcctagatttctactttctatcagaagcgtgtaactgatctgtaagctcacagccaagctgtccatttg

SEQ ID NO: 55453 - DNA, 336 bp, Triticum aestivum
  Clone ID: PAT_TA_55453
cgccgctggactaaactactgtagtcgagtggttaggagtgccgctgctacttaccaggagtttggctgatgtgcgctctgtgtggaggaagagctcgcgagctagcgtcaggagagagaggctggcgctggctcgaggaatgtacctcccgatcgaggatagtcaggcgagccacggcaaatgcaggagacagatatcttgagtgagccgcatcgagaggcttggagagcgctcctaatagggctgagcccgctccgagaactgctaggccactcccctgctactagaaataaaggcagcgctcgggcgatggtcttagagaactcatgcttata

SEQ ID NO: 55454 - DNA, 353 bp, Triticum aestivum
  Clone ID: PAT_TA_55454
gggactgtagcctcctgcgctgccgacgacgtcgtccagagaatacagaagcccctgagctcgccggatccggtggccgtcactttatccgagctacacacagacgacgggctcaaggccctcgaggcgcatctcaggcggcaagatctacatgtccggctatgggatcaccaaggacgacatgtaggtgttcgtagaggtgcccatgaagcccatctccgatatcccgaacgctggcagctggtaccagaccgtctccgggattgtgctagaaggctctgtggccgttgtgagggggagtctcttatctggttctgctagagctgctactgcctcttccagggatgaagatg

SEQ ID NO: 55455 - DNA, 411 bp, Triticum aestivum
  Clone ID: PAT_TA_55455
agggaatcctcaagtggtgcttgcaggatacgcttactatgctcaatcacttggatgagctcttatggcgaggggcagactctctatctgataatcaaagacagagaccaagcaagagctctcatatcagaaagagcagtgcgattgctaaagagcctagcatcaagcgagcatgatactgctgctagcctagagaaagcatcgggacaatatgctctgagaactgcagtagcttgaataatgagcctgcataggcaagcgcgtgagctctgactatgctgcatcatatcaaaggtcagggatctggagttgtatcctataggcatcagaataatctggagcgctcgcgtatctgtggagagtcatgtgctagagccatgaggctcagaaccctacagcccagcaagccag

SEQ ID NO: 55456 - DNA, 790 bp, Triticum aestivum
  unsure (1)..(790): unsure at all n locations
  Clone ID: PAT_TA_55456
gagcagctgacgaaagtgatgtcgaggacattgctgaagatgaagacgatggcgaggttatcattgaagacgacgctaccgacaaaaagacaaagggtggaagggatcttgacgacgttgaggatcttgggcgcatgattcgaaaggatgatggctcaaccgttcaaaaagcccctctcgctgttgatttcaccaactatggatcttccacaaagaaggcagtccctcaaggacccaagaagatggttgccgaagaatcgcctacatacaaagcacttaccaagcaaggttacgccattgtcggatctcactctggagtcaagacatgtcgatggacaaaatcagctctccgtggacgcggctcctgttataaatggtcattctacggcatcgcaagtcatcaatgtatggaaacgaccccttcgctctcctgctcgaataagtgtgtattttgctggcgccacggtacaaacccagttggaacaacatggcgatgggttgtggatcctcccgatctcatctttgacggcgttaaaacaaaccattacaagaagatcaaaatgctgcgtggtatgcctggtgtgcgagctgagcgatttgctgaagctatgcagatcagacactgcgctctgtcgcttgtcggagaacccatcttttatccctacatcaacgagttcctgggcatgctacatgctgaacgtatttnctccttccttgtctgcaatgctcaacaccctgatcagctcgccgatctcaaggccgtaactcagctctacgtatctatcgatgc

SEQ ID NO: 55457 - DNA, 125 bp, Triticum aestivum
  Clone ID: PAT_TA_55457
gctgaagatgaatctatggctaagtgattatcgatgcacgatgctatctaccaggagataagagagtcaggcatcttgtcgaggaagaagatgctaggcgcatgatgcataagagatgctggcgc

SEQ ID NO: 55458 - DNA, 310 bp, Triticum aestivum
  Clone ID: PAT_TA_55458
gcccgaatttcccggggggaccctctcctcccgccggagctgcgggtaggagatggtagtactctctagagcagactggtagcctacttcagagcaagggccacgcaggcatcttgacttgcatcggcgtcgtaggcctctagagcgcaccattgagggctgcccctacatgagggcagtccctgcgcgtgagctgagggcagacagagcccactgcctgcccctcatccagcgatagcggatgcaggctctacaaggagccagaggccttgagcgggcatgcacatcatgctgccaggacgacaacgcc

SEQ ID NO: 55459 - DNA, 736 bp, Triticum aestivum
  Clone ID: PAT_TA_55459
atacagaacaacaaacatcaccagcctgctcctgccctctattcgattccctggttaattggcacccttcggtcggtcggagaactgaagatggagcttgctatatctgcagtagcaggtgaactcgtgagccgattcgtttccttcctcgccaacaggtacctccactctagctgccgggcacagtgggaagagaagcagctcaagaagctgcagctgctgctcctgagagctcacacggtcgtcgaggaggcggatgggcgatacatcaccaactccaggatgttggcacagctcagcatgctcgcggacgccatgtaccgaggctactgggcactaggtgcgtccaggtacatctcactcgaagagtccatggaggagggggtggttcccaatccatctcctcacaaacgtttttgcatggttcatggaagtgctagaaagaacaaggccacatccctcgtcgacgtgcagggcgcgttggagagcttggaggatgtagtcgctggcatgacggagtttgttgttcttttgggtggatgcgaccgtatgctgcgtcgaccatacgatgcgtatctatacaatgacaacatcatgtttggacgtcacgccgagaagcaaaagctcctgaacttcatgttgcggcacaactctcctggtggtggtgcaccggctgtccttccgatcattggtgcttctgaaagtcggaagagggactctgttgcccatgtatgca

SEQ ID NO: 55460 - DNA, 627 bp, Triticum aestivum
  Clone ID: PAT_TA_55460
gataaaacctgaaatttgatctttctggccactctgtttgacgactatttacaacacgaccttctaagtgcgaattaccctttcttcccatgtgcatggcttctgggtgaaatcacgtcgtggtcgccggagctactacttttcttgccatgtgatctgggcgagatcacctcatggtcgccggagctgctcttcttgccatgtgatcctctaggcgaaatcatctcatggtcgccggagctgcccttcttgccatgtgaaggaggcaatgacgcccaagtaatcttctcgccgatcttcttgtcgctcgccttcttgccgagatgcctgccggtcttgcccatggatctcggtcctccatcctcgccgttcaagatgggcacgaggtaccaccagatggaggtgcagcagatggcgaacatcctcccgaacacgaccaggctcaccagcagcagcatcgccacgaacggccagtactggctcggcctgatcgccttgtccgcccacggccacctcccggcggccgaagccttcttcttcgccggcgccgcggcgacagccggcgccgtcgcagccgcgacgtgcatgacggcgtcgacttctcctctcgggctggtggactccgtc

SEQ ID NO: 55461 - DNA, 639 bp, Triticum aestivum
  Clone ID: PAT_TA_55461
aatgcaatacaaatggttctttagataaaacccctaagagacaatcctacaaattaaacatcttacacacacaaaatacagttcataaatacatgacttccaagaaggtttccatgattaaaagatatgtattgaacaccatgtaaatatttaaattatctatttgtaaactgaggaaatacttgagattccaactcttcgaaatccctgtagaaatcgtctgaatcaaaaggccttacaaaggcaccgctgcacgcttcctcccagacaggggagtactctgttccaccacacctggagcaccatctccatttggaacgaaatgaacaaacgaggtgtaaggcggcaatcttgattcccatgcaaccacattgaaatccccctgcggccgaactccaggatccatcactagatccccaagcctcacccttggtagagattccctttccgtcgtaacctcagtgcggctgctgccactggtgtaggaaggcacgacgcggagcggagaagcggcgggatgcaagacgaagtccctaagatctatctggtggtatctctgaacgagaaacctcgggtgctccccaaacatggagaggtttctctcaacgacccttctcagcctgctcagcatgccggccc

SEQ ID NO: 55462 - DNA, 774 bp, Triticum aestivum
  unsure (1)..(774): unsure at all n locations
  Clone ID: PAT_TA_55462
gtccgagtcgccggaaacgtcaactcaccagaaaccagcgtgccgccgccgccgcttctggatcccgcccagccgcggaccggggcggccaggcggaggcctctcggctcccccgccgaacgatcccgctgatggggatggtggttgagacggaggagtgggtgctcacccccctcgcttacccgctcctctccgccgcatcactcgccgccgtcctcctcctcccccacttctcccggccacacgccgccgtagtcaccccttcctcgccctccccctttgacgtgggcaccacccccttcctccgcttccgccgcgccttcctcctcctcttctgccttgcatccgtggcggaggggatccactcggtgttcggggaggatgagttcgtgcggtgcgggttcggcagggagcagatggccgcgcgccttgccgcggccacggccgcggttctctttctcggcggtgcatctggcgttgtctccgacaaactaggaccacagaatgcttgcatattctactggatgcttcagcttgcagtgggtgccttgaagagtttcagtgggcttcgttgtgcatgggtcaacaatttcattttggctcttgcatcctcaatgttctccttctgttttgagacatggattgtgctggagcatgagaagcaaggccagaaccaagattcgctgtttgataccttctggctgatgacattcttcgaatcaatatccctttgttggaagtcaaggaatcacanacttattgcttgatgatgat

SEQ ID NO: 55463 - DNA, 258 bp, Triticum aestivum
  Clone ID: PAT_TA_55463
gatcacctcggaagcaaagagcgccatggtccgcgccatagattccagcagagcagaccctgtgcctaggaatgatgacggatgcatcaagcctagtgctctgggagagtcagatctaaatgatcaatctctagagaacgacaccaactgaaagctagctgcacagcaagaaccactgcaatagggccatatgagccttaggaagatattaccaagagcagcaaggactttgttctatagatgcacaaggatgccacc

SEQ ID NO: 55464 - DNA, 115 bp, Triticum aestivum
  Clone ID: PAT_TA_55464
atgacgcgtacgagatctccttgagtcagcagacagcactagtctcacacccctagcagataggagatcaggtcatgactgatcacccagggatcgaagacggagaaggcctgta

SEQ ID NO: 55465 - DNA, 763 bp, Triticum aestivum
  unsure (1)..(763): unsure at all n locations
  Clone ID: PAT_TA_55465
cggacgcgtgggccgcgatcgcgaccaaggggccaactggcggagctggtggttctggatcaggacgaccggctgtcgcgaacaagccttcatttcttaccggaggtgctggagctggaggccatctgagcggaaagcgaggaaccgaggatctcgacttctttatcggtgacgaagcgatagcagcttccggaggacctggatatggacttcactatcccattcgacatggtcaaatagagaactgggaccacatggaacgattctggtcaaactccatcttcaagtatctccgagtcgagcctgaagaccactacttcctccttaccgagcccccgctgaacccgcccgagaaccgagagaacaccgccgagatcttcttcgagtccttcaactgtgctggaatgtacattgccgttcaggctgttcttgctctggctgcttcttggacatcttccaaggtccaggatcgctcgctgactggaacagttattgactctggcgatggtgtaacccacgtcattcccgttgctgagggctatgttattggctcttccatcaagtcaattcctatcgctggtcgagacatcacctacttcgttcagtctctgctgagagaccgtggcgagcccgattcttccctcaagacagctcaggagatcaaggaggagtactgctacgtctgtcccgatatcgtcaaggaatttagcaagtacgaccaagatcgcactcgatttgctaacacgntcgtgtcgcaccccac

SEQ ID NO: 55466 - DNA, 466 bp, Triticum aestivum
  Clone ID: PAT_TA_55466
ataggaacacaaaaattaatggaataaaagtgactaaaaaagcaccttggggggaacgaaccattattgggttggactagggcagttttattgaaacgccattgttaaagaatttaaaaaggctttattggaaggtttttcgaataaaaaagccgattgaatatgcaaaagggctttggttgtagaaatccaggttgtcgccgtaactgaagccgaataggtcgaaaaaacgcttggaaaaaccgatccggggggaaaaaagggcgttctggccgggcccgcatttgagcccaacgttgatgatgttagggatcaaaccgtacccaggcacccttcccgccgcctggtcggggcccgaggggcttcaccggcccgaaataacgtcgggggttaaagggttaggggactggggggttattcaaaaccacaggggcgttttaaaagaaagggttggattcggcgacaa

SEQ ID NO: 55467 - DNA, 457 bp, Triticum aestivum
  Clone ID: PAT_TA_55467
cccacgcgtgcgcccacgcgtgcggtggagaaggcgcacgacgagcagcactactgcaatctgccctgcaagcccttctatgaggtgggctcgtggagctacatagtgtacggaccggccgtgattatggtctgggagggcaagagcgtaggagccagtggacgcaagatcattggctccaccaaccgcctgacctgttagcccggctccatacacggagactgcgccgtcgagattgcagggaatcatctccctggtgcccactctctagagagggaggcgctggacatgcccacgatgaaccttctaggggcagagggaaggccacgacatgctaggactgcaccgctgaaagacgctccctgagaggccactccggactgatagatcaacggacagaccacagactgcatgcaggcctgaggagcgggcactcacccattcccgatgatggtga

SEQ ID NO: 55468 - DNA, 506 bp, Triticum aestivum
  Clone ID: PAT_TA_55468
tcggcatacccttttcctccattctatctcacgcctgatctagctcgtgccggcgatggccgacaccaactctgggcgctataccgcatggacggccgatgatcctatctttaggcgtggggactcttcaccgatgagccgtatgacggcgcggggctggagacatggccggcggagctggtcatgcatgagacagtcacatatgctacaaccaggggtggtggatgtttgcttggatagcccctttgcgctgtcatgcatgaatggtggttatcacctaccgatgctgcaaccagtaggacctagcgacgaatatgacgacctgctgctgctttaatagttctctgtctaactggaaacatgatcgctgaatgctgggacaggctgtctgttatgatacaatcaatcactagggagtggttcctcaagagcagctatgcttgagccggccgttcaatatgtgctggaaccagatataatattttgctacaaccggtagaaggagg

SEQ ID NO: 55469 - DNA, 757 bp, Triticum aestivum
  Clone ID: PAT_TA_55469
ctaatcgcgagggccgcccttttttttttttttttcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccgcctcttgagatttctcccccgaaaa

SEQ ID NO: 55470 - DNA, 441 bp, Triticum aestivum
  Clone ID: PAT_TA_55470
cggatttcctggttggcccacacccgtcgcgtgactttttgtccgtcctggtagaacgccagggcacaggagccgcagctaaaaggatcggagatcggccagggctataacacacagcaccacaagcagtcattcaatgctcacaggaacgggatcaataagcccatgcgatcagagccaggcctatcaccaaggggatggatcctgaagttcctgaggaacctgatgttctcgacgaagcacaatgtcaggttgctgaggacagaggttgtcaagtgagatggacagtttctgtggtcgatacgtctactgtatccctaggatatactggtgcgaacctgttaattcagtgttctgtatgaccaaatttttttctatggggttaccgaagaccagtcatgctgcttgattggaaatgatttttgcagccttatcagaatt

SEQ ID NO: 55471 - DNA, 266 bp, Triticum aestivum
  Clone ID: PAT_TA_55471
agcagagaacgtaccctgctcggatgcatgcggttagctctgtcggccctctactcttactccttgccagcgttggcaagaggtccaatggaggaggacggcgcctagccgatagcctggccatgcctgccggtctggagtaatgctattggagggaggagcttactcctgagctgtactcatgtcaaggcgctgcaagacaggctcgcagaggtgatggtctgcatgccgagctaggaagatctattccggccgttagctccagc

SEQ ID NO: 55472 - DNA, 363 bp, Triticum aestivum
  Clone ID: PAT_TA_55472
gtgaagggatcaggtctgtatcaattcacgggagcagtgtcgcgccccagcagcagccggagacggccccattaatgatcacccagggctcgaagacggagatggccttctcctcgactgtcaaggattacgctgttctgcgcggcaatgcggacggaccctgcttcttgagcagctccgacgcgctctacttagataaagacatgccagaactcggctgctgtgagcagcttcctcctcggaagatatacttctagctccctgatcggatgctcgggcgatccctgtcgagcgccgacattccggccatggcggtgcaagctagcgaggcgctggcgatgagagtgcagtcgatatagagga

SEQ ID NO: 55473 - DNA, 687 bp, Triticum aestivum
  Clone ID: PAT_TA_55473
aacagtgtgaagacgtgagactactattcaagctttcaatcatacaggaatccttcccatgcagcagaaaaagtactagtagtagttgtgatcctatcactaacctcttctcagtctgagactggtctatccagacacctgtactgacttttgaaatgtaaatcatggctaaattttctttgacaagggtggtttttggagaggatattcacgtggaaccggcttatgttctgcctctacttacagcgggtgatcatcacaggaagagacggctggcgaaaccgctcccgggtggctagcagcagcagcagcagcttcgctgcatcggctgataccttcaaacgcctgcacgcatactcctgagaaccccgtcagggcatggaacacgttcggaaggctcgtctgaagatggttcagcgtcatggctcgactggtcctcaaggagttgatgtacctggccttctcctcctcgaccctctttctgaacacgtccagcttcgggtcgtccttcgacactgagtagctcctggtgtgcgaaccctggtctgagctctgcattgcgttttcgctgtgtttctccaactgggcgtggaacttgctctcgatgttgtctgatttcttcttcagctgacgctcctcagcctgctgtaacacgatagagtgtatgactgacagaaagcttttatt

SEQ ID NO: 55474 - DNA, 133 bp, Triticum aestivum
  Clone ID: PAT_TA_55474
taatagtacccctggagtaccggcccgcgaattccgggtgcaaccacacccttccagagtgccttctgccaataagtctatatacgcacatactagactaatggaccacaccgataagctaacttcacatcac

SEQ ID NO: 55475 - DNA, 156 bp, Triticum aestivum
  Clone ID: PAT_TA_55475
cgccgctggacttaactactcgtagctgagtgtttaggagtgccgctgctatctaccaggagtttggctcagtctggcgctgtgtggatgaagagcactccagctagcgctaggatagagaaactggcgctggctcgaggagtgtacctgccgatc

SEQ ID NO: 55476 - DNA, 322 bp, Triticum aestivum
  Clone ID: PAT_TA_55476
ttggatgagccttatggcgaggggcagactctctatctggtattcaacagacagagagctagcaaggctctcatcagataggcattgcattgctagagagcctagcatcaggcgagcatgatatgctgcaggcagagagagatcgggaaatagtcgaagaactgcagagcttgaataagagagctgataggaatggccgagctcgacttgctggatcatatcaaaggtcagggatcaggagttgtatccttaggacatcagaatagatctggagcactcgcgcatctggggagagtcatgtacgagtgccaatgatggtcag

SEQ ID NO: 55477 - DNA, 621 bp, Triticum aestivum
  Clone ID: PAT_TA_55477
aacgaacaatctttacccacatccgacaacattcgttcatagcgaacagggcgcacttgtatagacattattgacttatagcacaatcttgaagcgtccaaaataaggccacagcgcggatgttccatgcccaacccatttttgccacttccacaagttcagggacaccttctcagattacatacacagagatgagagctacactagtcaaaaactccacacgaccagcaacaatgcaacgaacaacaaatccaccaactatacatacggtgggtggatcactgcggaacattatcggatgggcatgctctacttactggccgtacgagcgtgtgcctttggagctacagtgataaaagaaccacctcttgatgttcctggacgattcttggcatgagctaatgaggagcccaacgcctataccaactacaacacagactcccaggccaatgccgacgacaaccctaacaccaaaggagaaccatgctagttgaccgtcgtcgagaaaggataccatccttcagggcatgccctgggtcccatgtccaaaccactctcatctacattacacatagccaccaaaggcgctaatcaacgggtaaccaacccgccatcagactg

SEQ ID NO: 55478 - DNA, 720 bp, Triticum aestivum
  Clone ID: PAT_TA_55478
aatatatagtaaattatataaaggagctagaattagtataagtataatatgtagctatagattaaggtactatttactaaacgtagggtactatatacttaactcccttaagtaagtgtcccttttaaaatcccttcaagagtacatagtctagcatattgacaaagtagtcaacagactgttgggtaatgcagagcggcggtttaatcttgagtacattctgatgatccccagtgggttgcataattactcccagttccagcagccggttgcagatagctctagtctcctttgttgccggttccaggctggtgcggtctcgcacaaattcgaggcccaggtagaggccatcgccgtggacggtgcctatgagggggtgacgtttgcccaacgcctgcagccgtgtcttcagacaggcaccaataactcgcgcattctcctgcagctgctcctcttggataatgtccaagacggtgagtcccacgactgatgacagaggtgatccaccagtggaagagaaaaagtatccctggctacggtattgatcagcaatggtgcggctggtaattacggcacctaacgggaagccaccgccaatagatttagccaccgccacgatatcgggcacaacagcctgttgttggaagccccagaaccaagagcccagacggccaaagcccacctgtacttcatcggcaatagtcactccacccatgttgc

SEQ ID NO: 55479 - DNA, 693 bp, Triticum aestivum
  unsure (1)..(693): unsure at all n locations
  Clone ID: PAT_TA_55479
cccacgcgtccgcccacgcgtccgcttggtttcatcatgaaacactgtaagggaacaccaaaattcaacttttatagttacatgatcagggctttggaggttgactttaagaaagtcgttggtattagttggtacctttgggccatgttgatgatattcctactattgaatgttgaagggtggtatgtctacatttggatcaccttggttccattcattatgttacttatggtaggaagtaagatggagcacatcataacggaattggcttatgaggttgcccagaagcacacggctattcgaggggatttagtagtttctccttcagataacttcttttggttccaccggcctaaattagttcttctgttgatccacatcgtgctatttcagaatgcatttgaaattgcatttttcttctggctcttggtgacatatggttttaaatcatgcatcatggggaaaccagcatatgttattactcgagttgtcataagtgtaatctgccaagtcctttgtggttacagcaccctaccactatacgccgtcgtctcccatatggngaattccttcaagaagactatatttgatgaaaatgtgactgaaggccttgtcaactgggctgaaaagctaggagaggcacaagaaccccaataaattactacagatgncagtagttcaccaattgatgag

SEQ ID NO: 55480 - DNA, 602 bp, Triticum aestivum
  unsure (1)..(602): unsure at all n locations
  Clone ID: PAT_TA_55480
gtccgttcgttttttgctctgttgctgccgcggccggtagctgccgcgtccgtcgatcgtcccttatccccgtcgtcgccgctgccgccgacgctggcggccatgcagctgcacgcgcgccggcggcacgccgtggcgcggtgccgcctgctgatcgccgccgcggccgtcgccatgtcgctcgccgcggtcctctgcttcagccgggtcgaccccgccggcctgctcgccgcgcccgcgcgcgcgctccagctcgtccagccccgccggctgcacgtccgcctcggcgccgtcaaagggactactgcgaccgccacgcccgcagccggccggaagtcgcggtcgccgccgttggagactgaggccgtgctgctgccggactgggaggtgctcgtcttgctccgccccggcgcccaggacgacgttggagggaacgcgacgtgcgcgttcggccgcagcgcgtcgtccctggcgcgcacgctcgggaggctgccggcgtncggacgccgcgcgtacctctgcgtcgtgcccgtgccggcgcgcangcagaggcggctccgcgcgccacggctcgtgatctcgtcgtcgtcgccgtcgatcga

SEQ ID NO: 55481 - DNA, 321 bp, Triticum aestivum
  Clone ID: PAT_TA_55481
cacggcagagagcgagagcgtgagggggagctgctggtgctcgaccggcatggcgaagggaggcgtggaggaagccctcctgctcgcgagccgcgacgagggcctggggctgggggtgcgcgacgaggtgaagaagcagctgtggctggccggaccgttcatgggcggcgcgctgctgcggaacctcatccagatgatctcgggcatgtgcgaggggcacctcggggagctcgccctggccggggcctgcatgggcaggtactgcgccaccggggcctgatagagccttctgctccgggtggggagggcgctgggcaccct

SEQ ID NO: 55482 - DNA, 772 bp, Triticum aestivum
  Clone ID: PAT_TA_55482
cccacgcgtccgcccacgcgtccggagcagagttcagaagcaagtaacagagcataccatcgtactgtacgtatttgcgctgcacaatctgcatccagtgcacacaagatagtagcgagcaagatggtggccaaggaggcgatcccgctgctgacgccgcacaagatgggccagttcgagctctcccaccgggtggtgctcgcgccgctcacgcgctgccgctcctacgccaacgtgccgcagccgcacgccgcggcgtactactcacagcgggccaccagaggcggcctcctcatcgccgaggccaccggcgtctccgccaccgcgcaggggtacccggagacacccggcatctggacgcagcagcaggtcgacgcctggaagcccatcgtcgatgccgtccaccgcaagggcgctctcttcttctgccagatttggcacgttgggagggtctccaccaacgattttcagccggacggacaggcgccgatctccagcactgacaagcaaataacgcctgatgccgagtctggtatggtctactccaagccccgacagcttcaaacggacgagataccgctgatcgttgatgacttcagacgcgctgccagaaacgcaatcgaggcggggttcgacggcgtggagatccacggggcacacgggtacctattggagcagttcatgaaagacagctctaacaaccgcaccgacgagtatggtggcagcctcgagaaccgatgccgctttgcagtagaagtaatcgatgctatcg

SEQ ID NO: 55483 - DNA, 704 bp, Triticum aestivum
  unsure (1)..(704): unsure at all n locations
  Clone ID: PAT_TA_55483
cccacgcgtccgcccacgcgtccgcccacgcgtccgcttgcttcttaccggcgtgctcttcttagtcaatggaatctcgacgatgaatgctgcgcgagaattcagaagaggttttctgtttttctgttgtatggtggtgttgaggcaagtccgccgagcttggcttcacaaaccgaaggttcatttgtccctaagaataatttggaagaggcaatcctgctgctcatgatacttttgaagaagtggtaccttggaaagactcactgggacccctcagtgatggagcatctaacctttgcattgtcactctgtggccagacatctgtgcttgccaagcatttcgaagaagttttgcctggaatataccctcgaactgagagatggtatagtctagccctttgttattctgcagcttcggatgatgaagcggcattaaatttgctaaagaagtctttgaataagaatgagagtcccaatgacataaatgccctgcttttagctgctaagatatgtagttcggactattatcttgcttccgagggtgtagagtatgcaaagagagcaatcggtgacgacgaattattagatgggcatttaaggagtgttgggctccatctcttgnggagttgtctggctaatgagtctaaaattgcttcgtccgatcatcaaagatctctcttgcaggctgaagctttgaaatcact

SEQ ID NO: 55484 - DNA, 336 bp, Triticum aestivum
  Clone ID: PAT_TA_55484
gacgatatcgctctacaatagggtcaactactataatggcttggagcgaagttataagtgacataaaactaatagcacataatcattgatagctaaaactagagcgataaggactcataggcgggaggaccaccatcagatcctcgagaagcgcgtaatatatctactggagagacgcgccaatgcatgcgaccctaccataagccgatgcgacgtccctgccagtaaaatcaacgataggattgacaccagcgcggctgggaatatttttgccgacgagttccatggagaccttgtcaatgactagctttgaaaccataaacttaaaagggtgga

SEQ ID NO: 55485 - DNA, 538 bp, Triticum aestivum
  Clone ID: PAT_TA_55485
gcaactgatcgttccgctatattaatcacttaatatcgatattatactaatcagtgccagcgatattagaggagaggaatcacatcacaccgccctacaggcaggacgtgacatgacaaattcgtcccttaagtagtaggagtagtgcctaattacaaagactgttagcttcagagttgagagccatagcttcactcgccactgctgactgcttccatattcttcttgattcttcctatgtacagatccttgttccgttcagcgaagccgactagaactccattttcatctggcctgtttgcagatcaccgtggaagctctctgctgagaccccgttatcctggctctgcctgttgtccacatgaaaaacgctctggagatcatcctcccagaagttcctctgctgctggaggttcgtgctggccgtggccgtcccatcctggaaggcgtactgcgctgcgttggtggcctgggacagagccaggtccagctgattcagggtgcactggctctccatgctgctgggcaggaaggactg

SEQ ID NO: 55486 - DNA, 693 bp, Triticum aestivum
  unsure (1)..(693): unsure at all n locations
  Clone ID: PAT_TA_55486
gacgagcaccatctcgccgtcgtggttcatggacaccagctccacgcgcgcgggcttcccgaacccgaagtcagccgcctcgtaggccctgaatcgagggctcgccgccacgttggtcagccgctggaacggcagccgcatcagcttctgcatccaccccttgtccgtcccggacagcggtgccgcctccatctccgccaccgcggcctgcacagcccgcgccgcgcggaggatgcccgcctggccgaggagatccgccgcgtcggcgcagctcgccaggcacgcgcgcacgcagttgccgaggtaagcctcgctcacacacgggtccaggcgggagcgcaggtcggcgaggaacgccaggtacatgtcgtccccggcggcgagccccttggaacgaacgaacgccgtccagctcagcgccgccagcgccacgaacgtcgacaccggtttcggcttgggcgcgtcgccaccggcctcggcggaggcgaggtcgtcgatccgccgcctaagcgaccggatctcgtcggcgccgaggtagaacgttcggcgcgcgagcaggaatcgctggctgaagtcgtactgccccctcacctttgggagatngngcgcgacggtctttagcatctcgcgggcgagctcgtcggcgttcgggtggtggatgacgtcnncgctgtagtgtggcgggccgaggac

SEQ ID NO: 55487 - DNA, 462 bp, Triticum aestivum
  Clone ID: PAT_TA_55487
agatgtacatttggtcctgaaccaatcatgagcagccaagtggagccaactcgaccaagccggtcagcgccgcacttttgcatttagctacctgtcgtttatcgatttcaactcgcggggaaatcatcttgatgccaaccaaaacaagcaacaattacaccactaactaattcatcggtaatcgcctacagctaatactatagtaccagctagtgctactacgactgtacaagcatctgatctatcaactatcatcctccacctacgtacatcagtggacagttggttgccattgacgggagcagagcaacttcctctgtttgctgccgtcgctactcgaaccagaggccgaggctgtcgaggacgcggacgccgaagaaagtgaggtagatgatgatgaggcccaccccgtgcacccggtcgagccgcatgccccttaccggcaccaccaccagcacccac

SEQ ID NO: 55488 - DNA, 515 bp, Triticum aestivum
  Clone ID: PAT_TA_55488
atataagataataatatatataatatttgtttataataatagtacatggtgtgtgtatatttttacacccgactgaggacacgattcattcatctcaccaatatttgtacactcacaactcgcaactctataacagacagacagagagagagagagacaatacatacaccacagacacaaccgcaaccagtagagtatacattcctcccaccgatcaccagaaccagaagcagaacccagccccagccggcgatttctttttcttctacttggccgccgccgctgccttggcctgctggttggccgcagccgacatggaccggagccgcgccgtgatctccgtgaaggccggccgctgcgacgggtccggcgaccagcactgctccatcagcctcctacactccggcccgcagttggccggcacaggcggacgcagcgtgttgttcacgatgccacctattattgcgccatagtgcatgttggcatagggctcctctccggtcaggatctcccac

SEQ ID NO: 55489 - DNA, 227 bp, Triticum aestivum
  Clone ID: PAT_TA_55489
ggtaaattcaaccagcacatttaagaccactctcctccacagcttattgttaaagagtacatatctagattttatgaaagctaaaaactgatgtcgtttacaaccaacaatatctaattggccctactgggttacatgtaatgaattatgaggcgcgcttaccttagcttcatatggataactaccatgatgagctggcttccgagggagaagctgcattttgagaa

SEQ ID NO: 55490 - DNA, 152 bp, Triticum aestivum
  Clone ID: PAT_TA_55490
attaacaggggaagcttaccgccacacagaattcaggtacttattaacaagtcatatcttggctcagtcccaaactagggtgcctaatcattaaggaaagggtggaagctcctctagatcggacaatgaccactcaccaccctggttagata

SEQ ID NO: 55491 - DNA, 281 bp, Triticum aestivum
  Clone ID: PAT_TA_55491
agccaaaatatgctacattttgtataataagggcaaaattggttttggttttttagacaaaacaaacaaacacagaaagaagctgggacaaacttgggccgggggcatgcactcttagaagacaacgacctggaaagtttactcctgttttagggcggatgcaacacaaatggtagggggcagcgaccaaagaaaccggaggcgtgggtagaacccaaaaaaaacggaccgggacctggaggcttaaaaccgttccctagggggagcccgtgaaagctggg

SEQ ID NO: 55492 - DNA, 400 bp, Triticum aestivum
  Clone ID: PAT_TA_55492
gaagagaaggctcgagactgacagggtatgtatatagtcgaagatcataaagcggcagcataaagttgtaactcgggcttatctacgccttggacgtgaacgataatttgcacagtatatatgaatatcatccatcagtaccgtacatgcacaagttcaccttcttggtatcatttttccccagcgctgtgagaagaccgatatatctagtaatctaggcatcatgtcgtggctggagtgcagatgctaatatgagatgatggaatcacatgacggtgcaagcggtaacgtcctagtcggtgaacatgctcatgtacttgacctccggcgcggtcgggtaggccatggcctgcggcacgttgcaaaccaggcccgccggcgcctttttgtcttaggagcc

SEQ ID NO: 55493 - DNA, 467 bp, Triticum aestivum
  Clone ID: PAT_TA_55493
ttttttttttttttttttttttttttttattttttttttttttttttttttttttttttttttttttttttttttttataaaaaaaaaaaattgcccaaaacacggcggggatacctttgttctaaaacattggggctatatatagccggggacccggggcattaacaggtgaagggtagtaaattactaattgggagggggggctagtaaaaacaaaaaaaaaggccctggggagggttcatctaccatatatgtttatacattaggaagggggggggtggaatcccctccggcgccaggatacttgttttatacacttagtaatacatgaactgctgctgttgctgctgctgctgctgagggttgacactttggaacccccccgaaaaaatggccttgggggcgccggcccccatatccaatgggggctgcctaaagggggggtggtgacccaccaggggcgggt

SEQ ID NO: 55494 - DNA, 467 bp, Triticum aestivum
  Clone ID: PAT_TA_55494
gaagttttcaatcatataattttgaagtcacgcaaaataaaaaaataaaaaaaatccaattctggccagcgcattacaaaactgaactttcatcataaattagacaaattaaatatgttttatatgtgaaaaaaattatgccattttcttattcggcaaaagctcttagtggtattactttaagtcatataaaacaaactaaatatatatttagtcttatttatggtcaaagttgtattttagaatgcgtgagcgagggagtatgaaatttaaagcaacactcaggtgatgttataagaaaccaggcaggcatcgttccctattgcacactatgatatcaccatgatttgagcaaatctatacctttttatttgaggaatatgactctctaatatctattatctaactaatcaatgtaatctctattaccttaaatgataatacatgttgaacaaggacgtggtccg

SEQ ID NO: 55495 - DNA, 554 bp, Triticum aestivum
  Clone ID: PAT_TA_55495
gctgcagcaggaggcggcggaggaggaggccaggaggaaagccgaggaggaggaggcggcggccaagaagaagaaggcggaggaggagagccgggcggcctcgctggacctggacgaggtcatggccgtgagccccgtggggctgggccggcgctcgcggcagctgttcgacgaggtgtggcgcaagttctcgcgcctgggccagatgtccagcgcctccgccaccgaggcgctcgccgaggcggagcaggccgtgctcagccgcggcgggcccatgtgcgagttcaccgtccccggcgcccaggacaccaccgtcctcgtcgtcggcgccaccagccgcatcggccgcatcgtcgtccgcaagctcatgctccgaggatacaatgtcaaggctttagttagaagggacgatgccgatgtgatcgacatgcttccgagatcggtggacatcgctgttggcgatgttggtgaccctttggctgtgcaatccgccgtgtcaggttgcagcaagattatctattgtgccactgggcgctcaaccgttaccggggacc

SEQ ID NO: 55496 - DNA, 494 bp, Triticum aestivum
  unsure (1)..(494): unsure at all n locations
  Clone ID: PAT_TA_55496
actgcaaacaaatctgaattactaattactcctctctctctcccggggctacaatcacaaatattgctcactcagtttctgttattttatgctttcctccttggtctcccatgcacccgtgctctgagcagacacagatcgatcagatccccggctggctagatcttgtgttgggatctgcaaagtttccctgtttctcctatccgggtcgtaaattctggaaaggagtgacttgaatgttgtcaccaaacccatcatcaattttacttacggtcttgcactgctgccctatctacacattcaatgtccggcgtcccttcaacagctagcacacacgaatcatgcatggcgcgtgcccgtgccagtgccaggtcttctacgcgcatggcgctgtggcactcnctgcggcggcggtggcggcggccccggcttccaggccgcagggctcgtcaaggacgggggcgaggtcncgcggacgtacctccatccgtagc

SEQ ID NO: 55497 - DNA, 404 bp, Triticum aestivum
  Clone ID: PAT_TA_55497
ggggggaaaggggccccacacatttttataaaatgcccacgggcaaaattttatcaaaggggggaaggggcaaaaacaaaaatcgggaccaaaccaaggtttcataccggccccgccaaaagacaggcatttaacaaaaaactggatatataggggcccttaaaagggcgagcaaaccccatggcagtttaaattttaaagccgcctttgaccctttattttgggaggggggagcgttgttttaaaccatgctaattttttggaggggggggggggtgacaacgggcattggaacaacactgttttttgaaagggggcctttcctttcacaaagctcctgacagttcgcccaatagtggaaacaccaggggactatgcaaggatcccatggaaagttctaaaaa

SEQ ID NO: 55498 - DNA, 449 bp, Triticum aestivum
  Clone ID: PAT_TA_55498
aaagcccaacccatttttttatgggttttcgatcgggaacggggggcaacagggggggggcgaacccatggggaagggggcaacgaacccctgcggaagcagcaacaggaaacaccccggggggggtagctttccataaaaagccgggggggaagatgccgacaaaaaacttagggaagggggcaaacccccctagacaaaagcccaacggttagccccacttcttacttaataaacgataaaaggggtaacgaaaaccccctttatacagaggggttaaaccactaggggggacccaaagggtcttatatttcttgggagagggaggaaaacatattctttcaaggggggaggggaggatgtacttgttgcaattgaccttggtgttgtttgggaaaaaaacggaaaccccccacttgccggggatggggggggggttccccatgctg

SEQ ID NO: 55499 - DNA, 414 bp, Triticum aestivum
  Clone ID: PAT_TA_55499
gagacggaaagatttcatttttcaccaaaatatatatttttgtctcaaccgggagacattcatcaccaggtacctgttgcttttttggcaaagacgggaagaaaaccacaccattccaacccataggaggggaaatttcaaaattccaacctcaattctacgaataatcgggatctttttgtgcgggcgagtactacactcgggcgaaaagcagacaaagaggcccccaaaagttctcaaccctttccaaatgcggataacggtgaatatcggaggccccaacaagctgccctctggggaaaggtgcaattaatgcttcaagggataagccctcccatggaatttcgcaaacgcctcattcgggttgggggccacaaaactcgactgggctttcgagtttaaccttcacatgag

SEQ ID NO: 55500 - DNA, 398 bp, Triticum aestivum
  Clone ID: PAT_TA_55500
aaaaagacccaaaggggctccaaatttttttgggttggggcgggaaaaacttcaaaaacccattagaaaggggggcaattaaaaaaaaagggggggaaaaaagaaccgggcaaacgggaggggcctgccaaaactgggggaaaggcggggcggtccgcccccccaaagggccccgggaaaaaggggggggggaaaaacggggggatcttgtctaaatggggcccccaaagaaaaaggggcataaccttggcccttttggcgtggggggggacaaagccattctccgggggccgccccattttcctccccccccccagacagataaggggaaagggtttcctttgtttgccgttgggccccggggccaaaaaaggcggggacccggggggcaccccgga

SEQ ID NO: 55501 - DNA, 470 bp, Triticum aestivum
  Clone ID: PAT_TA_55501
gggggtccgaaaggggcctggccgagggggacatttaagctggcactcacttttccactgggttccattgattacaggtcgtaagccaccgagcttgcgttggaagggtcgccgccccctctcggcctaacgaacgtattaaggaggggccggcaactacacaactcccgccctccatgcccattcaaagttcacagttcaaggaggaagggaccttcccagatcgagatcatgggtggggtcggaacccgagccagattttttccaaggcgcaccccaagggagagctctgctcgcggacattacccaaaattaagggcggccccccccccccgggcaccccggctgcgcccgttcgtcttgagacttcttggacccgggccgggcggattggcttgggggcctcaccggaccccgggcccgccggcaggaagtggttctacaccgggagccgcttttaaggccccccc

SEQ ID NO: 55502 - DNA, 515 bp, Triticum aestivum
  Clone ID: PAT_TA_55502
gggccccagggggcccttttaaccaaaagggtggccccaaaaaaaaaggggggggggttcaaacggagggaactagggaagccctacacggacctacttcgggtacggcccgaagaacacacccgaaaggggcaccagtttggtaagcatcacaacttcatcgcccatttcccactgggggggcaggatgggtgaacacttgggcactaaaaaccccaagaacccacatgtttttgcgtccaagggggggtcaacagcgacccaaagggcaaacaagaccagggaggcattccttggaagggaaaaaaagctttggaccatggcgatgtactggcccactggtgccgctcttaaaaccccgtccattttgaaaataatctgcaggggcgggtcaatctggggctcgaacctggtgccaaggttacaggagtttttcaccgttcctcgtacaaaggggccacccgggctctcaaggtccaaaaaggccccccccgtctctgagaaatatgtaaaaa

SEQ ID NO: 55503 - DNA, 607 bp, Triticum aestivum
  Clone ID: PAT_TA_55503
gacaaaggccgccacgtcgcccagctcgacgcggaggtacgcgaaggagccgccggccacggggatctcgacggcgaactcggcgtagatgagcacggagagcatcgcggagaggccggccacgacgtaggacagcacgacggcgggccccgcgtggtcgcgggcctcctggccggtgagcacgaagatgccggcgccgaggtggcagccgaagccaagccacgtgaggtcccaccaggtgaggcagcggcgcatctcgttctcgctccggcgccgcatcgcgccgagctccgcggcgtcggtggagcggccggcgaggaggcggtccctgaggcgcgcgggcgtcgcggccagcgcgccccggtacgcgccccagctcgcgaacgacggctccgggaagaagtcgtccttccgccaccgccagtagcccctcgccgcgggcgctggcttgtcttgcggcgctcccacgggctccatggcctggagctttgggtcagacacagcttcactctgcttgtccgcgcacgggtgcaggacaagttactccgagccgtcgtctcgagaggttaactgattgcagacagaacaaacagccccgttgtcttct

SEQ ID NO: 55504 - DNA, 549 bp, Triticum aestivum
  Clone ID: PAT_TA_55504
gtcgctaaactgcattaacacaccaagatacaacaaggctgtttctcaacaacaacaacaaaaagatacaaggctgtttctcaacgacgacgacgacgatgacgacgacgacgaccagagaaactttagtgacaaccggatcagcacagcacgcatgcattattattattattacaaacagagaaagggatcagagctccggttcatcatcaccagacggcgtccgggcggatgggtcatcagtcggaggtgctgctgctgggctccggtgcatccgcagcggagggctcggaggcaggggcgtcggccgcgggcgcgtcggcgggcgagctggcggacggcgccggcgcttcggccttcttctcggccttggccttcttgcccttggcgtcggcgaatggcgccacggcgacggcgaccaggaggagggcgacgatgaagacagcagcgcgggccattgttattgttggctttgttggatcggcgagggatggatgcttactggttggcttgagagatggagacggacgcgtgggcggacgcgtgggc

SEQ ID NO: 55505 - DNA, 602 bp, Triticum aestivum
  Clone ID: PAT_TA_55505
aaaatcttaaggacttcctgtggggctggttaagcgggggccaaactagggccacggggatttgggaaccaccccagaacttgcttattttaaggcttaacgaccgaccaattaaaatgggcaactttacaattggttaattaccaaaaccagtatttccctttaaaatttaaaaggtccatgattttcccaacccttgccagattgggccgttcctttcgggttttcttcttcttttggttccggttctttcgggttttggaacccttggccgtccgtcctaagttggggccggaaaatcggccttaattggttttaatccacccacggttggaaacaaggaggatggaaaaggggtttgaacggaagttcctgatttttgtattccacaaccaagttttcccggaaaaaagaaaattaattttcgttgccaagcctaccattgactttttaagtaccagttccaaccggaaaattaccaccaacctcttttgaagccgggggtcccttggcctgcccatggttcccttgaatggatgtttccaaggaattttaaagttccgggtcccccgaacccttggttcaacccggaatttccgaac

SEQ ID NO: 55506 - DNA, 304 bp, Triticum aestivum
  Clone ID: PAT_TA_55506
ggtaatatagtattagattaatatgtcgggtgcaacaaaacaagtctcttgacacacttttatggcaagcaatttctgtttgtctctactcttacaactgaatgcggcgtagggacatcatttgagacttacatgaagtgactcattctgtgaaaattcgattatccgaccttgcattttaaggaaaatctcagataaaattaacaaaatgcctgtgcagtttaccctgcacgagcagtgtgtgaacgtggagaccttgcgcagccaccggggttgcgagtgaagacctgtgtgaacgaggcta

SEQ ID NO: 55507 - DNA, 400 bp, Triticum aestivum
  Clone ID: PAT_TA_55507
gactaaaaacatcaatttcaaacaaatgtaagcttagtttacaagatggtaaatgagacataatacttcattcacaaaagtatctatctatttccagtgacaatccgtcatacatgaagtttaactcagaacaatttttgggttttttcaagcttcatggttgaagagcaagaactatgcagacatatataaatgtccgctaaaagaacgcatagcttcatgcaccaatttagaacaatccttctaatctccagtggcaaaatttcctggtctaggagaaagcaatagctcctttatagattctaaatccattgatacacagcgtcggccgaatgtcctggtctggagtagaggtctggaggtgaccgtcgagcgtcctcgtcgtcctggttggctgttc

SEQ ID NO: 55508 - DNA, 445 bp, Triticum aestivum
  unsure (1)..(445): unsure at all n locations
  Clone ID: PAT_TA_55508
gggcgccttagccggggcaattttgctccaaaatggtgacacggcacacacgacacactttttggacaggacaacccattcacgtacgggcatgctaaggacaccggacgccccgtttttgcatgccgtcgcgcgggcatgcccccccccaccaaaaatcgagaaaaaaaaaccgggactcgacttgattagttgacgcgaacgtccatccacgggttggtgattaattctcgggtgggacgtggggggggggttttttgacccccggcgggggggggggcagctggttgccgtcggagtccaaggcgatgtgcccggaaaactggagcgggcggcacttgtcccccatgatgacgggctttctccacacgggcttgttgtgatcctccagccccacagcgggcaccgcctccttgtngtcgtcgctgctgctgcccggtgccgg

SEQ ID NO: 55509 - DNA, 570 bp, Triticum aestivum
  unsure (1)..(570): unsure at all n locations
  Clone ID: PAT_TA_55509
gtaaccctctgaaatatgaatcaagcacgggtaatcaaccaaccatgagctcaaactaacaagaacaataaaactaattcatgcaggacctagtgccaagcacgaccgctacgctacaactacatatacctctttgactcctcacctcactctcatgatacaaattattactaacctctgttcagaattacctgtcgctgaaatgagtgtatctaagacgcgcttcagtgtgtagatttactgatttcagcgacagttaattccgaacagagggagtacaagccatgaacttaacctgcaatagaacagatataaaaggctcttcagggaaaacgcgctcagaatttacagcagagaagccccttcctccagcctcggcgccgcctggtgcatctccgctctcctttcgccatcctcaccgggctgctgatccagtccttctgcagtactggaaatgcaaaggaccgggtgctggtcgtgctactacctgaaccgatggagatattgccagaataagcaagatggccagagtttgacactggagcagacataatactangaccaaaaccc

SEQ ID NO: 55510 - DNA, 375 bp, Triticum aestivum
  Clone ID: PAT_TA_55510
ggggaacaaggacagaaaacttccattgaacaccttgaaaaggggtttttcaaaaaaaaatacattggggtttggtgggaacccgccctgactgaaacaggggggggaaagggaacacaatcccccatttaaatttaaaacaccccggacaaaatttatcccgggggattttattataaaacactggcggggtttttacatggggggcccaggaaaaagctaaattttaattacacaaaaccccatttttggtcgggggagctaaaacccatggacaggaacccatgttttgcaaagtttttggcaccgggtttaaaccgaataaaccttttaaacctggtgacgaacaaaaaaactctcttttgggtccttcca

SEQ ID NO: 55511 - DNA, 287 bp, Triticum aestivum
  Clone ID: PAT_TA_55511
gacagctctattatgatttacttattacaagacttcgcttttctacaatctgtacaagtgaatgcaccaacaaacagcctttactgtctattcacatctcaagcaacaacttaataccagcacacctgcaatattatctaagcaaggtgtgcaaaacactggctacgattgcaacacaaccttgcaatctcacttttacctaaacattggttgcttgtatcttggattaaatgtccctctcccctttcctcagcaacccaagcaatagtatatcaagtctgcgcaca

SEQ ID NO: 55512 - DNA, 566 bp, Triticum aestivum
  Clone ID: PAT_TA_55512
gatacccagcatcactagcaaaagcaagaacttaagataatttacattgaccacagaatgtaattgtcatcatggttattacaagacacccccaatgtacgggatgactcccaacctttcctcagcagggaaaggcaacaaaaggatgccatggagttaactatgcttaaggcatttcaaatgacaaggtttggcaagcaccgggccagtatctacacacagcatgacaggtttggcaaggcaaactatgctgaaggcatatttcaaatgcaatcttcaggctattgccatgtgccaggagccatagcaatggtagcttttgattaacaatccatgcattttaagacttacaagtgagcttctatgccggtgcttcgttgaacaccttgaatagcaacagcttcaggagccaacacggcaggctagctcgaaatcaactccttatgcccacttggggaagaacagatcataacctctaaaataggcattgttgcactacctgaacaaaagatcatgaaccttctgtatccctccgggacttagaattgcaaaacccaactaactga

SEQ ID NO: 55513 - DNA, 136 bp, Triticum aestivum
  Clone ID: PAT_TA_55513
ggatcgtgaatgtcaagatattcaccatatataaaactaaggtacagcagaccttgctcggaaggctgtctgagtttaaatacaacaaattgtttacattaacacaaagatgatgtggtgatctggcagtaaaacc

SEQ ID NO: 55514 - DNA, 111 bp, Triticum aestivum
  unsure (1)..(111): unsure at all n locations
  Clone ID: PAT_TA_55514
ggataaaataaatcttcttttgtgaaaatcggcggttacctacgccacattaggctntcacacctggcatcaaatgcngaatatgtnctagttacagcagtagtcagagac

SEQ ID NO: 55515 - DNA, 396 bp, Triticum aestivum
  Clone ID: PAT_TA_55515
aaaaaaaaaaacgcttttttttcagttggggacaccttctcccccaaagtcccctttttgggggggaccccccaaaccccctagagctaattgtttattcgggggaccaatagcctggccaggtgttttacagtacccaaaccacaaattttttgaaaacaaaggccccatacgggacagggaccgccaattactcgcacaggaccgggccctcctgcagggaattctcctccccccgccatgctaggaggttggcgagcttgccttccttgaccaaagggggggtctgcaccctttgggcctggaaccattggaagacggacctgggcgacccgggaaagacagcaccccgttggggcgcggggaacccctgggggatgaggaccccccccctgg

SEQ ID NO: 55516 - DNA, 602 bp, Triticum aestivum
  Clone ID: PAT_TA_55516
agtacatctgatactcaacatctctcgacaagtttcgtaccatgcttattccagctacatacagtagttctgtagcatgcacatgcatgtacctcgcactcccgatgcgtatatgaaggccatattataagtcttgacacgaaaaacattgagtactagtttagcgctcgctcgatgctccgctcgagttcgtcgtccttgaggccgacgaccttgcccacctgcttgcacttcttgaatagcacgaacgtcggatacgctccctccactccgcaaagccccgccaaaaactcgaagttgtcgacgtccaacttgcagaagtctgccttgcctttatactgcttggcgagtttctccaacagcttgtccatggccttggacagtgtggaattcttgtcgtagaacgcatacaccaactagatcatttcaaacattagagttgtgctagctaaaggtcgagtccccagaaaagaaaagaaaaaaagaaggaatttgaaaagctagcgctgcaaggttaggtacgtacgtaccagcttgttgtatcgagcagaattgtcccaacgcgattgccattcctccatatctttgatcgagatcacagt

SEQ ID NO: 55517 - DNA, 627 bp, Triticum aestivum
  unsure (1)..(627): unsure at all n locations
  Clone ID: PAT_TA_55517
ctacagaaggcatactgatctgttttattatcacagccatccatccacccacctggacttgcgttcatagatgctttacacaggcagagcactacacagaactggtgggtggagaattgatagatgctacaggtagtacgtactactagttgattcagattgctgcagcagattcaggtgtcggtggcggtgtggggacttccactgtaaccgggagtccgttgtgcagccacgcagcgtagcctcctcccacgttcttcacattcatgaaccctgctgctaggagatcgacgcaggccagctcggacctcttgccgctctggcacccgacaagtatgtattggtctgtggtgaagagtgagccgacctgctccacgaaccgggggttcttctcccggaccccttgtggtgtgacgaagaagtaggggacgttgagggagccgcggatgtggcccttgcccatctcctcctctgtcctcacgtccaggtacatcatgccgtcctgctgctcctgaagctccctcgccgccgtctgcacgtcgactgtcgtcaccgncacggccggtgtcaccgccgtctgcacgtccaccgtcgtcacccccacggccggtgtcgccgccgtctgca

SEQ ID NO: 55518 - DNA, 536 bp, Triticum aestivum
  Clone ID: PAT_TA_55518
accatagtgacatacgacctgcggcttagtatataccatcaccgcatgccacatgtacacagacagcacagacaccgggaggaagacagctgaacattgcacagagctcgccaaaatgcgtaagctacaattcgcggcccctctccgtcgcacctacaaactaccatcactaaagctagacacagcctagccaccaaggctacagcccgaccctggggttgtcgcctaggcacgtgtgccatgcatcacgataggccatcaactaagattgcacgaaccacaccatcttgctaggttaacgcactaagacgcacgatgaccatgttgcgcatataccatttgggaccctatgttctgccgaccgtaatgaggacccttacctagatcttgcaaagcttctccagctataccaatgcgttggccttggcgatggacttcattgacgcggagctggactcaaactttgactcctgcttgtaccactaacagtaccttgcgcactacacgttaccacaccggcaattgaatccagtcag

SEQ ID NO: 55519 - DNA, 694 bp, Triticum aestivum
  unsure (1)..(694): unsure at all n locations
  Clone ID: PAT_TA_55519
gcgcgcacgctgacgacggcgacgtcgtcgatcaccggcccgcagagcgagctcatgtcgtcggtcctggtgttgtagaatgagctgaagaagacgacgcgcgtgcgagacgacgtggcgcgaaacgggagcacggcgcgcttggcggcgccgccctgccccgccgactcgtacggcaccttggtcgactccctgccggcgtaggcctccaccatgagcgaccctcggcatgtgttgctggcgtcgcccacgctgaaggacagcgcgtactgcttccccggcacggtgcggatcacctgcgcgatcgcgctctccctccccgccagcagctccacggtccggcgcccccgaggcaccgcgaagtggtcgctgtcgatgtacttgacggccttgagtgactccaccatccagcccggcaacggcgagtgctcgtccaccatgcgcgacgggatcagcaccccccacttggtcccggagatgatgtatggcccctcctcgaaatcaccattcttcaccaggttcttgttggtgcggcgaggcggngtgagggtcttgatggcgacggagtcgatgaggggtccgcaggcggggtcctcggtgacgccggggttgtggacgacgacctcgacctcgtcggcgttggcgtcccaggcccaggattaggagttccagccgttgctgctgtacatggtct

SEQ ID NO: 55520 - DNA, 478 bp, Triticum aestivum
  Clone ID: PAT_TA_55520
ggaaccaacaatcccatgggtttaatatccatcgccttccaaagggggacgggctccagagaccggtaaaaaaacacacgcccttggacaaaacttacgggattaaaatccatggccctccactaactacacaaaccgggggaacagaaacgcacgcccccccgcttttaaaaacaaaacgcatagccccaaaacagcagttagcaaagtcaaagtccacggaaactggaacagggggcccaggcctaacccccaaaaccgaaaagggttcccccctggggcttgagcccgtaaacaacgtccatggggggaacggttttggggggggcgtgctcggggtaggggacggggtcccggataaccttctccaaaaaaattttgaacactccgggggtctccttgaaaatgaaccccgaaatgcgcttaacgccgcccctccaagcaaaacaacggatggccggtttggggatcccctgga

SEQ ID NO: 55521 - DNA, 463 bp, Triticum aestivum
  Clone ID: PAT_TA_55521
ggagcaaactgtttaatttggatatatcatatacatacacttatacctattttttagttacatacatattgttgtttgaccgttgttgagcacctggccacgcaggcacccaacgcatatcgaagtggagtagcccagactaagctttcttctctcccgacccagtttcctggtaaagtgggaggccagaggcgaggccgccactaaccacggaatcaccagcagcgttggcagcatccttagcgggtttcccgatttctcggtagagcgggaggccggttgagaagctttcaccggttgtagtggtagttgccactccatcggtaagagcgacctctgagccagcgtaggacaatggtgctaccgccgcgatggcgacgagcaggagcatcgcaacggcgagacctcgagccattgttcccgtcgggttattgtttgcttgacgatgatcaggcatggtgtt

SEQ ID NO: 55522 - DNA, 412 bp, Triticum aestivum
  Clone ID: PAT_TA_55522
aaaatctatcggggccatgtttacattttttttttttcattcgacccgctcccctttgggggcaaggccccctaacaagaaggggatgccctggaacagcaggaagtaaaagggtttcccctgcttcgtcagcaggctgggagcgggggccgggagcaggagcagcgacagccccagctcctttttggatatccgggggggcttttttggggggtttttcccttcctttttggggctcgggtggtgctccttgagcaccattagggcctccaggctcggcgcccacccggtttttggggggggccccacctccctgggcggggggggcccccgccgccagggaaatgagggctcccttcgacgaccgccccgattttttggtccccccccactcgtaggcccttcccgggcc

SEQ ID NO: 55523 - DNA, 652 bp, Triticum aestivum
  unsure (1)..(652): unsure at all n locations
  Clone ID: PAT_TA_55523
ctgagtaattatcgaacacaacagcaaagtacagatacagattctcactatcatagtgcagagttgctagcagcctaacatccgacataagcacagttcaatgaactgctacacttcaaccataaaaacataacaacatcactagtagaaatccgccctagggcgtgttggtgcaagtgttcctcctgtgtcctgtcagactccacctgaagcagcgaggcgacttccttggcgccttcggaagatcactgcgctgcggacatgttgtgctcttgtgcccttgaccacggcggattgaacaaaaacggctccttttagccggttgttcatatagcgctttgtcgcggcttgttgtaggccgccccgctggtctcttcttggatggtgccccaaagctgtctgaacattgcgagactctctgcacctgattcgctggaccaaaatgttgtttgtgcgctatagacgagactgtagaatcacctgccatttctctgtcggataatcccatgccatcacgtacaacggctaccggttcaagcaatgcctttgcatttcttagctgctccatgacaagagtatatgcatcgacattgatgtcaccaagtctaacaatttcagggcanagtagatgcagattgttatgtcgccgcta

SEQ ID NO: 55524 - DNA, 302 bp, Triticum aestivum
  Clone ID: PAT_TA_55524
gggacaaaaaaagccgggcttttgcacaaaatttttttaatttacatcatggtgggccaactcaaaccacaagataatacgcctcatggggagcttagtcccaaaacaccttacttgccgggggcaaagttgggggcaaatgcccatgcattgttgttgacggggtcggcgatgtggcccccgaggttttaaagggggcctttgcccgggacgatagcttggacaaaaaagccaaacattgaaaacatgggaaggggaccgttcttgatctccttcaccttgagctcggcaaatgccttggg

SEQ ID NO: 55525 - DNA, 621 bp, Triticum aestivum
  unsure (1)..(621): unsure at all n locations
  Clone ID: PAT_TA_55525
ataggttaccccaacacaaaatatcatcacttgtttgaatgaaatgttgcctcttatataaattataattataatggagtatgtggttcctgtaacaagacacggtcatgggcaataacaggggattgaaaagtggcaggaaacgaaatgcaaggccgactctcacttcccacattttgcctgcaacctcttcacttcagacctccagcaaacaatgtctgacatgaatagcatgatgtgcacgttgccatggcgtcgcgtcgtgatggatgatgatgctcttccttctcagtttcatatcacaggtcaatacaccagtgtggttgtaaatgctgttggtcactaaccatgtggtgacgacgacaccgtctgcacaccgaaataggatttgcctcatgctctgatgcttgatggcttctcgcaacaagggtaagtaacaggaacaagccaaaggagatgacgagtgctgtggccatcaagataagcattgcttgtagtgtgatgcttgggctcaagaagaagatgactgcgatggcacctgattgccaaaccttcaactgtgcaaaagctgcttccttgacatnctcgaacagcaatccaagtaatgcgcttaactgtgtg

SEQ ID NO: 55526 - DNA, 526 bp, Triticum aestivum
  Clone ID: PAT_TA_55526
ttttttttttttttttttttttttttttttttttttttttttttttttttttttttttttttttttttttttttttttttttttttccccaaacaagaaaacgggaaaaaacccagggggtccccaagcccaaaactccagagtcccccatccaaaactaaggacccctagggcgggctgaagcaaaaaggcgaggaaagcgtcctgctgggggcctcgggccctgccggacggaggaatgaatccccccttcctaggggggtccggaacataatggggaaaacaaaacaagctattttggaaacagaaacttaaggccaccctttgaaagctttaacagggccttggggaagtcacccacggggccataaaacaaaagctgtttttttttttgcagggggaggaggccctcttaaacggggcccttgaaaaaaacctggggctttaaaaaggctggaattgcccgattcgggggattcaaccctgggctgggctccccacggggggattccaccaaggacccatc

SEQ ID NO: 55527 - DNA, 498 bp, Triticum aestivum
  Clone ID: PAT_TA_55527
caacccggccaagcccttgattaatggcttgggctaaaaacaaaaaactggggtccaagaaaccccgtttttttttattatcccccctactaggagaaattaacaagcaaagatctgatcgacacatacatatccatatcctaggaccggcccggcagggggggcatgctgaataaattcctgactttttgaaccccccctcctttcctggggagggatactgaaactgtttccccggccaatgctgaattccacgggaaaatcacccgcccggcaggctcgggtcggatcgggttgcccttggggggtaaaactgaaggggcaccgggagccaggggggtttacccggccaccgaggtctcaatcgccacccggtcggggaaaaggacgtcctccgccttttgggcctcctcccaaagttccggaagcgcctccgggatgttgtggatgctctccagcgcgtgatccgcgcccttcacccgttgggacgggccaacc

SEQ ID NO: 55528 - DNA, 373 bp, Triticum aestivum
  Clone ID: PAT_TA_55528
cgacacccgccgtccggcccaggcaaaggccgcgctggcgcagagtggcgcaaagccggagcgggaggcaagagatggccgacaccgtggacaccaggcagagggtgccgcgaactcggcctcgatgggggaggggtcgagggggaggaggcggagagcgccagggagacgccgtggcacaggaggagcaagaagagcgggcggctcgcgagcctggacggcgtcgacgacgcccctccccatcaagcgggggctgtagagctgcttctccggccagacgcgcccgaccgcaaacctgcaggacgcggccggggccgcgcaccaccagcagcagggacgcggtggccaggacggagaagccaaccaacaagcg

SEQ ID NO: 55529 - DNA, 101 bp, Triticum aestivum
  Clone ID: PAT_TA_55529
gagacctctcatctcaggatgcccgcgcccgcctaggctgagctctccgtctccaggaggacagaggctggactttcctgcctttctgcagcgcggacgcg

SEQ ID NO: 55530 - DNA, 418 bp, Triticum aestivum
  unsure (1)..(418): unsure at all n locations
  Clone ID: PAT_TA_55530
cccagcgtccggtcattgtgttcaccgtcggtcggaccgggccgggcgaactcattgccgggttgcttcacagggggcagtatgtcgggcccaatctaccggacgaggtttatctctccgtgtatgctcctaccggggcgacggacgggaacgtctccatctcctttaccgggcaagtgctggagtcaaaagagggcgccttgtcngttatcaaccagagctttccttagctgggtttgaccgagggagacctctcagaaatgagctgggtcgagtccacggcgcaanttctccgggctgaacacggggggggacctggggaaccgggggcgccagccaaagcagtactccaagagcaagtgcgactacctgcaggcgccgatctcgagggacgacatgggcnagatcttcccggacc

SEQ ID NO: 55531 - DNA, 529 bp, Triticum aestivum
  Clone ID: PAT_TA_55531
gggccggaattaacgcgtcgacccacgcgtccgcggacgcgtgggcggacgcgtgggtgcgtgtcgactagcgcccggtgtcttccactcactcccactcccgccgttcctgcgacgccgaccctcgccgtgcgggaacacagatgctgaggccctgagcgagcgagggccgatcgggacgatgggaggaggaggaggaggcggggccaaccccgccgagggcgtggccctcgcgctgctcgcggtggcggtggtcggtgccgcggagggggactcgctcgccggactcgctgcggtgatcgactagcgccgcgccagaggtgaacgaattggggccttgggcgaaggggctgctgaacgggatgcctgatggggcagcatggccgagggctatggagcccgtcttcaagtacccgctgtgactggccgaggacaggacgctgcggacggacggtttccgccatctcacgatgtgtggaggtggctggaacatcaccaagctgcactattgggcgtctgtatcattcac

SEQ ID NO: 55532 - DNA, 555 bp, Triticum aestivum
  Clone ID: PAT_TA_55532
ccacgcgtccgggccgcgtggatcaaggccggctagcagatatagagagagggaggactcgctacctcggaatcccaggcctggcgcctgcctacagcatccttcgcctgtgggcctcggcacttgttgctgatggcctgccgcggagggctaccgcgtggcacggcggactgctgatcgagatcgcggacccggtctaccccggaggcagcttcgaccccctgggcctcgacgaagacccggaagccttagtggagctcaaggcagaaggagatcaagagcggacgactcgcgcatgttctccatggtcggcttcttgggccaggccatcgtcaccggatagggaccgatcaagaaccttgcctaacaccttgccgaacctgtcaacgacacatcctgggcctttgccaccatactcattgcccgggacgagagcgcagtcagctcaacctatatgccgacaacatgctggctgatggatgctgctgcatgtgtgccgcacacgatctctgcttatgaccgtgctgagatcgagaacaacggactgatagatgc

SEQ ID NO: 55533 - DNA, 506 bp, Triticum aestivum
  Clone ID: PAT_TA_55533
ccacgcgtccgggagaggaacgggtcgagcaccgtcgccatcgccaagtacatcgaggacaagcacaaggcgcacctcccggccaacttccgcaagttcatgctgacgcagatcaagaagctcgtggccgccggcaagctgaccaaggtcaaggcctcctacaagctcaccaaggcccccgcagcgcccaagaagcccaagacgaaggcgcccgccaagaagaagccggcggcgaagaagaaggcgccggccaagaagcccgccgccaagtccccagccaagaagaagcccgccgccaagccgaaggccaaggccccagccaagaccaccaaggccgccgccaagcccaaggccgctgccaaggccaaggctccagccaagaccaccaaggccggcgcgaagcccaagccggccggcaagacgaaggcgcccgccaagcctggggggcggcccgccaaggccgggaagacctcgcgcaaggacgcggcaggcgagaaggcgcccgc

SEQ ID NO: 55534 - DNA, 529 bp, Triticum aestivum
  Clone ID: PAT_TA_55534
agggaaaattagctaatttaccggggcaaaaaccactaaaaaattgtctggaccccttgggggtttattttcgaaaggaataaaaggaagaggcccggccccaagggggggggagactatttgggagcttcccaccaagcccagttttgatcctttaataaaaaccccccaaaaagggaagggagaaaaaaaaagaaaaaaaaaggggtggcctaatatacactttctggaacgccaccgaaaccacccaaagggttcctataccaatttcggcggggcccactaccatttaataagtgggggtacctggcccccatatttgggcggattttttttccactttatacgttttttcactactaaaggatttgggccccattatttttggtggggttaccattactttcgctcaccaaggtgtgattaaacactaacgagaggggggaaaaaaggggggaaccccggaacaaaggggggggagacaggggggaactatttgggggccaccaagggtcggggaaagggggaa

SEQ ID NO: 55535 - DNA, 606 bp, Triticum aestivum
  Clone ID: PAT_TA_55535
ccacgcgtccgcggacgcgtgggaaaacaggaaaatttggagccctgttcgcgtccattccactgcctatatttgctggcatgtactgtgttttcttcgcatatgtcggtacgtccagatacccgcgaaaccgctcgtcgtcgttcgaaagtctaaatttgatcattttcagcgtgttacgttgccagttttgacaccagtatgaatgtatgagtctcattggttctctcttttgccgagcaggtgcctgtggtctgagcttcctccagttctgcaacttgaacagcttcaggaccaagttcatcctgggcttctccttcttcatcggcatatcagttcctcagtacttcaacgagtacgcctccgtctcgggccatggcccggtgcacacgggcgcaagatgggtacgatgagcacacgcctcggtctctcgccattcatcagctctctgaaaccactgaccctttgttgatttgggcagttgaacgacatgatcaacgtgcccttctcgaacaagccgttggtggcggcgctggtggcctacttgctgggcaacaccatgcacctgcaccacagcgcggtgaggaaggacaggggctaccactg

SEQ ID NO: 55536 - DNA, 279 bp, Triticum aestivum
  unsure (1)..(279): unsure at all n locations
  Clone ID: PAT_TA_55536
ctggtcgcctgaggtccggtccggattccggtcgaccacgcgtccggaataggtggacggatgatgtactcagtcaggtcccgccctcaagatgatgttggctccttgccgaagaagagaagagatggagactgggcgacgtagccgtcaggagggcgggacctgacttgatgacaaggacggggaagtttgatcttgcggagggcaaaaggtggacggatgaagtcaagaggatggtgcttncttgccggggaagagaagagatggagatggcgcgag

SEQ ID NO: 55537 - DNA, 601 bp, Triticum aestivum
  Clone ID: PAT_TA_55537
ccacgcgtccgccctccgccgccggcgcagcgtcctccccgcgactccgatggccatcggcatctgcgcctttagcctccttcgaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaatatctgcttcattgagattgtggatattccatgcttccgtgtagttgctgtgttgtggttgtggagacctcagtggtagctcagcgattactgcagacatttggatattgctactgctggtattttgaagtgtgttcctgtcttagcagtatctttcacac

SEQ ID NO: 55538 - DNA, 521 bp, Triticum aestivum
  Clone ID: PAT_TA_55538
cacgcgtccgcccacgcgtccggccggcgggtgccaacgggtgggtggcctgggcgctgaaccccaccggcgagggcatggccggcgcgcaggcgctcgtggcgctcaagggctccggctccgccgcccccaccgttaggacgtacaacatcaccggctacgtgccgctcggcaaggcctccacgcccatcgccttcccggccaccgacctcgccgccgactccggcagcggcggcaagatccggctctacggcaagctgcagctgcacagcgggatgaaggcggtgaaccacatatggcaggtcggcacctccgtcaccgccggggcccccgacaagcacgccttcgccgccggcaacctcgcctcgaagtccaagctcgtcctctcgggcaaagcggactccgcggcctcgccttcgccggcgcccgcccccatggccggtggcccgtccggatcggccggcagcgacggcggcgcttcggcgaccacggtgccttcagccggcaagtccccgtcgggc

SEQ ID NO: 55539 - DNA, 586 bp, Triticum aestivum
  Clone ID: PAT_TA_55539
ccacgcgtccgcgggcccgttcctgctcccgctggtgctgctggcgctggccaaggggcagcgcgtcaacgccgtgttcccgctcgcgcagctcggcccggcattgctgctgctgctgcaggcgtcggcgctggcgttccggaacgaggccgacggcgacatccggtacgcggtgctggaggcctccacggtctccggcgtgctgcacgccagcctctacctggacgccgtggtgctgccctactacacggggctggaggcgctccggtggtcccgcttctccggggagtgcgcgtcgtgcctctgccgcatggagccgctggtcgtcggcggcacggcgatgcggtaccggggcctgtccaagacggcgctggccatcatcttcgcgctctgctccaggatggtgtgccggatctacggcgaggagcggctgagcgcgtggacgcggtcggcgctggagggcgtcgggtgggtgttcgtggcggccgacgcggtgtacctcgtcggctgggtggcggccgagggcggcgccgtgggcgtggcggcctacagcctggtggccgggctcgtcttcctctgcgtgttg

SEQ ID NO: 55540 - DNA, 180 bp, Triticum aestivum
  Clone ID: PAT_TA_55540
gcgacccacgcgtccgcccacgcgttcgcggcttaagcaccaggctgcatgcggctggacaagtcattaccgacattcggcaacgtggcgtccgagggcaaaccccaatcttcctcagcagaagaggcttatggtccttgcccatacccttgaaatcaggtgggttgaatgacacctcac

SEQ ID NO: 55541 - DNA, 383 bp, Triticum aestivum
  unsure (1)..(383): unsure at all n locations
  Clone ID: PAT_TA_55541
ccacgcgtccgcccacgcgtccgccagttccccactcttccacacctacggccgcttagccaacgcgaggcgccgccggagacggcgatgcaggcggcggcctcttaccggggcgcggcaggccaccgccgcgccggccacccctcccggcgccctcccggtccctctcttcttctacccggcagcggcgctggcggggggcgtttctccgacgcggcgggtccnctgcgaggcggctccctgcggcggcgtngggcgcgcggcggcggcnatggggcgcggcggggtgccaggnacgggnaggcgtggcggctggcgcgcgcgctcgggctgatccttnctggcgaccacgaaatggtgcacgctcgcctgctcgaaactgc

SEQ ID NO: 55542 - DNA, 372 bp, Triticum aestivum
  Clone ID: PAT_TA_55542
ccacgcgtccgcgcgagcgcgggggattactatggggatgctgccgctctctaccccacaagacgccaccttcttgggatgcacgtgggctatgcaactgacgatggccatgcgaccctccgcatgttcactaagggcgcgaaggttgatcatgaccttcacctgtggctattaagcacaggccagtgcatacctgcgggacaacctgaagaacgcggaagcctacaaagtgcactggaacaaatgctcacgaagatgcaacatacgactctgaggagcgcctaccgacgatgctgattgagatactatcttgtggatgtcgagaaagattcttccggtgaacacggtcaagcctgataaagctcgaggaga

SEQ ID NO: 55543 - DNA, 707 bp, Triticum aestivum
  Clone ID: PAT_TA_55543
ccacgcgtccggcgagcgctacaaccagcactgtaacagcgagtcatcgggagtgataagcagacgcctgtcttggtcgtacggggtggaaccccgagtggtgtctgcccacggtaactccatccttctgcagctcaccccaaacgtgggcctgggcgcccgcactccagacttcttcgtttacactatccgcttccatgggaagccgttcctcttccgtcttcctgcttgcctgaaagaaatggcaagcgaccgcctctcgcatggtgggttacgacacatgctcacgattgctcacattggcctcctttcctttggtgaacagtatgtggttgcggacctccgggtgttaccagtcgaagaaggtcatgacgctgttaccccattggaggctcagttttgcatttttcgttctgacagcccaggtggctggccagtgatcaggcatgagaaggatcaagacagggacctgctgtggtggtcaacggacaccgtggtgccttgcgacaattttctatgttatgttgattaccttcgtggtatcttacttgggactgtcctcaacgaggaccctcatctgctttacatccatctacccgtgaaggttcccattggtgaccccacagaccctgaattgggcactagagggtgtcctcatcttttacgaagtgtgtgtgtcacccaaggaaacgtgttgatgtttgtcg

SEQ ID NO: 55544 - DNA, 615 bp, Triticum aestivum
  Clone ID: PAT_TA_55544
cccgcgtccgcccacgcgtccgggcaagagagcttagagctgcaaattcaaggctgcagcaggagaattcacaccttagtaggcgattggagctcacacgcctaccgcctgtacccaagtcccacaatagcatggaggtaaaaacatcagaacaagttgatgggttgaagcaagaaaacgagaagttgtcaaaagaggttgaacaactgcggactgacaggtttgcagatgttgaggagctggtatatcttaaatggatcaatgcttgcctgcggcatgagctgaagaacaaggggactcctggtcctggggcacaaactacagcacaggatctaagcaacaccctaagccccaaatctgaacagacagccaagcaattgataatggagtatgccaatgttggtgcggacgagaaaaatttaagctccatagaatttggctcagagtacgcttcttcaagggcatcatcaagtggcgaacccgatgacacatcgaccgacatgtcatcaatcacaacgcccagaaacccgaagaagaaaaaaagaaaaaagttttttctctaagctacggaaaatggtactgggaaaagataaggaaaagaacaatttccctact

SEQ ID NO: 55545 - DNA, 633 bp, Triticum aestivum
  Clone ID: PAT_TA_55545
acacgctccatcgtacctcgctgcgctgctcagcctcctagcttcttctgtagcgccgactaattctttcaagagaagcgccaatatagctgggaaagacctgggaaaaaagtgtgagtggcaaaatgactagaacatgggcggagaatggttccacacatttggaaaatggcacggagatgctgacgacaaaggcattcaaacctcagaggcactacaggttgtacaccgtctcgggggatgaccctgagctcaacaacaaggacaagacactggtgctgcacttcacggtgaatcatgagcacaagcttgactgcggtggtggttacgctaagttgcttggatgtgatgctgaccagaagaaattccccggtgacacactcctacagcattatgtctggaccagatatctgtagggacagcaccaagaaggatcacactatacttactaagggatgggagaaccatttgatcaaaaaggacgtgccttgggagactgatcctctgacacatgagtacactttgatcatacggcctgatgctatatacagtgttctcattgacaacgtatagaagcaaactgtaagcgtctacgaggactgggatattcttcctcccagggaatcaaggacc

SEQ ID NO: 55546 - DNA, 171 bp, Triticum aestivum
  Clone ID: PAT_TA_55546
ccacgcgtccgcttatcggtggcagtactacaagcgagtgactgatttttttttagaatttttggtaaagtgttgattcttcgagctgtgaggtgtgtgacgacggaacttgaggcacatgcgatgcactgatgatgaacatgtccggttcctagtgactgattgcgttgc

SEQ ID NO: 55547 - DNA, 724 bp, Triticum aestivum
  unsure (1)..(724): unsure at all n locations
  Clone ID: PAT_TA_55547
ccacgcgtccgcccacgcgtccgcaaactcacacaacccacaccaccgcagcccccaaccccacccgaagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggggctgaagcaggtgcaccccgacatcggcatctcctccaagggcatgtccatcatgaactccttcatcaacgacatcttcgagaagctcgccggcgagtcggccaagctcgcgagggacaacaagaagcccaccatcacctccagggagatccagacctccgtccgcctcgtcctccccggggagctcgccaagcacgccgtctccgagggcaccaaggccgtcaccaagttcacctcctcctanactgacggcgtgcagttggtttctgcatctgcatctgtactgttgactctgcttatctatctatccgcaagtagtggtagcagtagtagcacctgtgctgggtgattgccaacgctttgttggcccgttggttgtaagaactgaagttgctgctttggcatactgatgaaatctatctagaact

SEQ ID NO: 55548 - DNA, 737 bp, Triticum aestivum
  unsure (1)..(737): unsure at all n locations
  Clone ID: PAT_TA_55548
cccgcgtccgacatagcctacatttgttagctagttctgtgggctgattgctgtcaagtaatacaatatctgtactgccagatttattttctgcgtcctacttgcctgtcattctaaaattttgatcacactgttggtattccatgttcatgttcagacttggaggctcttgagaattatgcgggtacccctttcctgccctcagactcggatctcttacttgattccccagaccatgatgacataggtaaccatgatgacataggtaattttgcttgtgctgtaatttatctcggctatgaattgcgaattaatcatcatatatatacctgacttgatgatttagtttgagaccggcttactcatttgtggtatgtggtattatctccagttgagtactttgcggacgccatcaacgggtctcaatcggacgaagagaagccatagaagaacagactcagaatagtcccattgagatttagtcctggctagagtgtcatctcatgtagtgtaatctcgcagcccgtgcataccggcgcaatatcagactgggtgttcgcccagaggtgcggtaattgcgcgtcactaaggaattttgtagtggccaatgctagttcttcggaataatcagcctcaggcagccttcaccggataaagttgctgtctacaagtctgaaaagtttagaaaaaaaaattgtgtcgaacctcangaacaaatcaaaccctttgtaattgct

SEQ ID NO: 55549 - DNA, 438 bp, Triticum aestivum
  Clone ID: PAT_TA_55549
ccaagcgtccgcccacgcgtccgcccacgcgtccgtggaaggaaagtagacctcgcatcatgcgacaactatcataagctgtcaactgccgtcgaagagttgttccgaggctttcttgaagcccagaaggatttatcttgtgatgaaagcggagtgcgaggagcagaagagaaaatattttcagggttgctggatggaaccggtgaatacgctctagtgtacgaagatgacgaaggagacaggatgctggtcggggacataccatggagtgtgtttgtttcaactgcaaagagactaagggtcatgaggaggtcagagcttccccagcgtatgattggagctaactcaacgaaagtagcagattgctgaaaaatgagggtgcatgcatttccatggcacagaccgcagttcatcacatttttggaaatcgcttcatat

SEQ ID NO: 55550 - DNA, 683 bp, Triticum aestivum
  unsure (1)..(683): unsure at all n locations
  Clone ID: PAT_TA_55550
ccacgcgtccggcagacgcaaggcttcaatggagccgtgcaccaagcagttcctccccatgcctccgcaggaccccaactccccgtcgtcctccacctcctcttcctcctcctcctccacctcgccgtcccacccctaccaccgcgcgcagccgccgcacccacacaacctcccgccctcgcccaggcccgtcccccgcaccatcgagaccaccccgttccccaccaccttcgtccaggccgacaccacctccttcaagcagatcgtccagatgctcaccggctccgagcagtcctccaagagcgccgccgcggcgacgaccaacggcagcgccgggaaccaggcggcgagcgggagcgggccgtgccgcccgaagaagccgtccttcaagctgtacgagcggcggagcagcctcaagaacctcaagatgatcgcgccgctggccatgggcgcgccgccgtcgccgaggaacgcctccgccgcgccggagatcctgtcgccgagcgtgctggacttcccgtccctgaagctcagcagcccggtgacgccgctcaccggcgaccccttcttcccctcgccggcgtcgtcctcgggggacgccgcggagcgcgcgggcatcgccgacagggcttctttcttcacccttcgccgcggggcgccgagccgncgcgggttctcccgct

SEQ ID NO: 55551 - DNA, 656 bp, Triticum aestivum
  unsure (1)..(656): unsure at all n locations
  Clone ID: PAT_TA_55551
ccacgcgtccgcccacgcgtccgcggacgcgtgggtctgctcctaagtctgccaaaaaggacagcagcagtgatgatgacagttctgatgaaagctctgatgatgagcctaaaaaggaagttacaactgccacaaaatcacagaaggaagaagcctaatactcctgctagcaacaaaggtcaggcaacagggtcgaagaccctttggatggggaacctttccttcaatattgagtatgatcaagtgaagcaattttttgcacaaattggagaggtcgttgatgttcgcctggctacccatgaagatggccatcccaagggatttggtcatgttgagtttgctacggctgaagatgctcagaaggcgcttgattcgttgaatggtggagatctaatgggccgtcctgtgagacttgacatggctgctgaaagaggtgcgagcgctcctcgcaccagggatggtggatcttttggaaaaccaagtggaggtcccagcctctcagtatttgtcaagggttttgattcatctcaacaggaggatgctattcggagctctcttaagaacacttctctaaatgtggagaatcacacgtgtctcagttccgatggattatgagaatggtgcaagcaaagggatagcttacatggattntactg

SEQ ID NO: 55552 - DNA, 478 bp, Triticum aestivum
  Clone ID: PAT_TA_55552
cccgcgtccgagcagatggatgactctcttacataatcagaagctggtctttgtattgcatgaacggaacttccacatcaatctgatgataactgtggtgcccaatatccattagatgatagggctgctgctgctgcatgaaagctataacttgtacggtacccacccagacgatctagctgataacactgctagcctgaacactgatgcccagctcgagttgccaatatgggaaacaagtgataagatagtgagttaattgcggacttatggcacatgacgattctaaaatgatcactgttgatggacctggtggtagaccttcttgaatccatgaagtctttcccgtgcgtgtgagactgttaattctttcatttggtcatctaggaggtcttggcctctcttctgaaatactgcactatttataagcatctctgacaagatcaccaaggaaaggatgaaaaggaggtcgtattat

SEQ ID NO: 55553 - DNA, 417 bp, Triticum aestivum
  Clone ID: PAT_TA_55553
ccacgcgtccgcagaggtgaagaggctgtgggcgctccaaatgacaaactgcaagaggcatattaataaggactacactacaatgcttgcaatgcttgtgaggcttgatgatttcgaagaagctgaggtcttgttgaaagagtgggagtcgagcgaaaacgcgttcgacttccatgtcccaaacgtcttgctcactggttaccggcagaaggacatgctggacaaggccgaagcgctgctggatgacttcttgaagaaggggaagatgcctccttcgagcagttgggccatcgtggcaatcggctacgcggagaaaggtgatgctgtgaaagcctatgagttgacaaaaaatgccctttgtgtttacgcttcgaggagtggctcggtccccgggcctgcgatgattggtatgatact

SEQ ID NO: 55554 - DNA, 640 bp, Triticum aestivum
  Clone ID: PAT_TA_55554
cccgcgtccgaagatgttaatggaaattgaaataatatttttaagtgccaatcgaatgtttgataaatcagtctatgattctacagtatatatgtgtacataatgagtttctcgagcaaccatgtcccttctaacggagggagtaaaagttatgtttctgtaacaaatcttatagttaataatctcgggacttgtttttgtggttgccatgttcagctgcatcataaccttcatgcctggctagtggctactatggcttgacggactacctcagccactacctcagcttcccacacaacatgatgacagtggttttgctacaaccgtggcggtggtggcggcccctaacttggttctgggaggagggtctagagcctagagcctccgtgaagtttgatcttgcggaggagggcgagaaggtgaatggagcttgtagtgccgcttggtcgaaattgggttgctgctgatgcgattgatttctggtggtgtggacgggtgccttgtgccactttgtttgtttataccatctttgctttgcaggacaacacccacccatataacttgtgtggactttgacgatgatccggctgtggcagtaccagtttgtgctgtaggggcgttgccaatactttttgttgct

SEQ ID NO: 55555 - DNA, 443 bp, Triticum aestivum
  unsure (1)..(443): unsure at all n locations
  Clone ID: PAT_TA_55555
cccgcgtccgaaagaatcccatgcccagttccctgacaagaggaaggcaaacccggaatatatgttacatgtgtcttggcagcatctcggtttatcctagttgaaatgagattttatgaaggccttccatggcaggaaaaactcatcacggacggttctagaagcgtatttgatgagtcgtcagctgccgccgtgtgccttcagtacgatatatattgcatctgtccattcctcatgatgggaactgttggggtttgtaatgtaaataaattttggcccgctccgtccggcgcatgttagatgttgcacgggactagacacggttcaaagctggacacagttatcccttttttttcatacgattgtgtcctgagaaaagagggaacaaactctgaacaagagatatccttattcnnaaaaaaaaaaannaaaaaaannnnnaa

SEQ ID NO: 55556 - DNA, 608 bp, Triticum aestivum
  Clone ID: PAT_TA_55556
ccacgcgtccgatggacttcagcaaatacttgacagagatagagactgcagatgcagtgttatcccacaatggtggtgttctcattgttgttactggatcattaaccatggttgatgacttctgccaacgatttacacagtcgttcttcctggcgccacaagatggtggtggctattttgttctcaatgatatttttaggttgataacacaaaggaatctagaaaacggaagaactcagaaggatgggcctgttgctcaatcagtagcagatcctgctccagctgtggtggtggagcgttcaactactgaccttgttgccgatgtggatgttcagaatcccactgttaatggcacaactgttcaaagtaacccgactgctaatggagctgttgaaaataaggttgagccacctgtgaaggtgaccaaagaggttcccaaaaagacctctgttgctgttcccccatctcctcctgcccagaaggataaccctcctccagctcagaaggatattccaaaaaagacccctgttgctgcttctccccctcctccttcttcagctcagaaggatgtcactaagaagacttatgcatcaattgtgaaagtcatg

SEQ ID NO: 55557 - DNA, 198 bp, Triticum aestivum
  unsure (1)..(198): unsure at all n locations
  Clone ID: PAT_TA_55557
aattgaactaaaaagtcccaagnatctcagcacactaccctatgcatacaaatcaaagcagtccttacctatttcatgtaagcagaccacattcttgtagaactgagaacatgctgaataggaagccccggccgaaaggaatggctctgggagccgcgctggcagcactcagtcagcaacaaaggggttggtaatggt

SEQ ID NO: 55558 - DNA, 250 bp, Triticum aestivum
  Clone ID: PAT_TA_55558
cggcaccttcttcatgctctggctcctctcggcggcttttcattcgccgacttccgacctgtggccgctaccttaccatcgccgtcttctccgccgtccaagccaccggcgtgatgatactgacgatctcgacggtggcgcccgggcttcggccggcggcgtgcggggacgcgacggtgcaagaccccgactgcgtgccggcgaacgggacgcacttcggcgtgctgtaccttggggctgtacatgacgg

SEQ ID NO: 55559 - DNA, 572 bp, Triticum aestivum
  unsure (1)..(572): unsure at all n locations
  Clone ID: PAT_TA_55559
cgcggccccggaaattccccgggctcgacccaccgcgtcgcgatccaaaccaacgagacccttccttcttctgacgcacctgcgggatcaggacgagacactcatgcacctttcagcgttcgcatcgatcagtagtaccgctcgaggtagccatggttgccgtcgtcatgctggcccatttgacaagagcgacctactcaactgtgcctgaccctggttcccaccgccgaccctgcgggcaactgggattacaaagctcgccatgtgacttgccgctcttgccggaccaggctagggtgtaaaggcgaagcctggatgatgctgagcagcgcggagcatgagcccccctccggcgcaagagctgagcttaaggttaccgggaggcgggaaggtgatagacctgccccacgcgcaaggcgctcacactctaagaaagcgaaaggcggcaacaccggaaagcggagcacgcangaagtggcaggggagatcatgctctggctgaaaaacgagcgggcctgaagtctaggtcgaaaatactgaagaacccaaacacagtgccctgtgcctgcgga

SEQ ID NO: 55560 - DNA, 262 bp, Triticum aestivum
  unsure (1)..(262): unsure at all n locations
  Clone ID: PAT_TA_55560
ccacgcggccgcgcgggggagaacggaaaacccgcccgagggcgagacggcgcgacacagcacaaggggggccggcgcgggcccggccacgagcaccggcgggggcaccggcnacgaccaccacaacnagcccgaggcacgcggggacgaccaacggccggaggccgccaacgcacaggagccggaaaaacggagaagaggcgccaggccgaggggcgaacacgagccccgaggaagcggcggcagcggagcggggggaacg

SEQ ID NO: 55561 - DNA, 453 bp, Triticum aestivum
  unsure (1)..(453): unsure at all n locations
  Clone ID: PAT_TA_55561
gacccagcgnccgcaaacctttaccagcccnagggngcgggggcggccggaggaganacanagagcnncaccagaagcgccanggccggcgcanggaccacgaggagcgcaagcgcaagaaggaggcgcgcgcgggcaagaagaacnccaaggaggcccgcaaggggcgcggngccaagggcaagaggngcgccgggagggggnangccgagaaggcgcagangaagaagacccngaaaangcangacgagncnncnncccggcagaagggggangangangnngaggagggcgccannccnncggangggcgggaacgngaaccgacacagngcgccaaggnncncagcancacangnaagcagaagaggaaggaaaaggcngggaaaggggaaggggcnnngccaaaggncagaccgggggcngaagaagagaaggggaaagnncnacgca

SEQ ID NO: 55562 - DNA, 407 bp, Triticum aestivum
  Clone ID: PAT_TA_55562
cggtcccggaaactcccgggtccgacccaacgccgttccggtctattcctgcaaacctcgattagggattggcctcgcggtggccagcttcttccgcttcgtgctggtcgccacggtggcccactatgcttcttgtagccacccgacgcgggcattttctgcggtcaggtgacctccgcctttagccccttcattttcttttcccgcggcaatggcgccaacccgacttcttgccttctgcaacggtgtcaagagtcttgccggggcaaccccgagcaccgcttacaagcaagcggcgtgcaagtgcatcaagaacgctgccggtgggctcaacgcttgcaagggcgccggcattcccttcaagtgcggcggcagcggcccatattccatcaacgcttacggcgact

SEQ ID NO: 55563 - DNA, 336 bp, Triticum aestivum
  unsure (1)..(336): unsure at all n locations
  Clone ID: PAT_TA_55563
cccacgcggccgcccacgcgccggaaccagaancaggcgagggnggaggcagcggngggnagaagacgccagcccacagccancggaagaaagcaggcggcccngagagagaaaaggaagacccgaacaccgggaaggacggnacccgcaanaaagagaaggccaagaaggcagcgncaagncaaaacaacaggggcggggcggnngaagaacaacagaaagcggcgaaccncgagaaaaaaggaccggcggccaacggaaacaacacagcaaacaggcagacaaacaacggcggagaggcaggcccaaacagaggcgggaggcaccacaaccacg

SEQ ID NO: 55564 - DNA, 399 bp, Triticum aestivum
  Clone ID: PAT_TA_55564
tcgacccagcgtccgcggacgcgtggtgaaaaaaaaaaaaaaaaaaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggcccttttaaagaacccaagtttacttccccgtccttccaacctaatagtttttctatagggccacctaatttaaatccccggcccgccttttcacaacttcggaatgggaaaacccctggggtaccccaactaaatcccttggaaaaacatccccttttccccagttggctaaaaaaaaaaaaggccccccccaaccccccttccaaaaaattgcccaccccaaagggaaaaggaacccccc

SEQ ID NO: 55565 - DNA, 115 bp, Triticum aestivum
  Clone ID: PAT_TA_55565
cgggtcaccacgcgtccggttagggtgggccaggctagctttgacagcacgctagcttgaggtatcgatcatcctgcactggaatagaggtgctcactggcagactcatgactcg

SEQ ID NO: 55566 - DNA, 599 bp, Triticum aestivum
  Clone ID: PAT_TA_55566
cacctgacactgcgagagtgacgagtccacccggacgacaggacatggcaaagacgatggaggtcctcctggctgccatgatgctggcgctggaggtggcggcgcccgccgcggctcatgccgagcgcgaggcggcatacctgactgctcgcatgctggggatcacaagctgctccaagccacttgagtgccagatgccgcaccctccagtcggcaggcgagggcttgtgccattactgcatagacccctgcatcgcccctacattgggagcctgaagactcgcgagaccctattctactgcggcctcagcgtccccgactgcagatagacctcacttcgcctagcgcagaagtggttcagccatacgtatgcaacctgctgccatgagagattagagattatggctcagcctagctgagtgcctgatgaatacatacacgcatgctgtgctgtgatgcatggatgaaaatgcagggccgatcgatgtgcccgaggaaaagactttgatgaccctaaagcaagaaaaagcagggagtacgttctagaagacccaagctaactcacccgtgcttgcaaccacctagatcttctattgagc

SEQ ID NO: 55567 - DNA, 470 bp, Triticum aestivum
  Clone ID: PAT_TA_55567
tcgacccagcgtccgagagttttgcacagtggtctccttagcactgcataggtggcaatgaccaacgctcgtctgcggggctagctcctcgagggctgccatgggagtgctaggcggacgacacagcctaggccgaggcgggggatgacgacgtttgccacgacgcagtgagcgcgctgatcccatgccgatagcaactgaaaccagccgccaccggaaccccagagcgagagctgttgacagcgggcgcagagaatgctgaccatggtatatagatcgacggcgtcgactgactagatggtgactcggagatgcaaatcacgaacgccgtcgcgggtggagtaatggtaaggggatgcaacggcgacatggtcggcctggaggataccatcatagtgctaagcgcctctgacgtcttggactcgaggtacgtggcttcatcttcctctccatgggtgaagcgacgcttt

SEQ ID NO: 55568 - DNA, 294 bp, Triticum aestivum
  unsure (1)..(294): unsure at all n locations
  Clone ID: PAT_TA_55568
aaacccgggncgacccacgcgcccggctttttgcgccgcgacacgaccgggggggggagcgtgggtgcaagccacactagggggcgggggaccctgagtgcttgcagacaagccaggtcaccgagaaaagcgacgtgtacagctacgatggggcgctgatggagctactgacaagggagaaaccactatgtggcggacatactggcggggggagaagcctagtttttttttgacggcgatgctgcatcacaaccaggtgctgagaattgagtactgtaaagcggccgaggaaac

SEQ ID NO: 55569 - DNA, 409 bp, Triticum aestivum
  unsure (1)..(409): unsure at all n locations
  Clone ID: PAT_TA_55569
tcgacccagcgtccgtctgcagacgtggtgggggacacgggcggggggatgggcgagtgggtgcggcgcccgcgggagcacacggcgctggacgacatcctgccgtgcgtcgacacggccgccgcctcggaggcgctcggccggagcaaggaggtgaactaccgtcttgtggacgtgctcaacggcgtcatgtccgcntggccaacctttatttcccgccgcaggcgccgctctcgccgccgctctactacaaccagtcgggcccgcccgtgccgccgctctgcaacccctacacgccggacctccgcgaccgcgcctgcgcgcccggcgaggtcgccggcccggacgccgcgcggcagtcgtggggcggcctcgtgtgccggacggcggacgccggcgggtcgggggt

SEQ ID NO: 55570 - DNA, 261 bp, Triticum aestivum
  unsure (1)..(261): unsure at all n locations
  Clone ID: PAT_TA_55570
gtacgcctgcgtaccgtnccgatcccggtcgaccccgcgtccgcccacgcgtccgcccacgcgtccgcttaaatcaaacaccgttaagtttgagccgaggctcccggaatggaaggaggaagcgatgagagaactgtcagttggagtcgagaacaaaatagttctccacttcagtgaggttttctggtctagcgtggagtttctagtagtatgtccgtcctctacatatggctgcggctgtttaactccctgttgtcaccg

SEQ ID NO: 55571 - DNA, 305 bp, Triticum aestivum
  unsure (1)..(305): unsure at all n locations
  Clone ID: PAT_TA_55571
ccacgcgtccgagcacatttcagcttagacatggccgggtcgtcggccctgcaccgtctaaaaaactcgccggcgccgcgctcgcccgccggccagccttctctaccagtacgtgccatagtcgacctcttatttgacatttatgttgtgtgtgttgaaatgttggatctgtgtacgtacctgcntanncttcacggggtgcagggggntttcttttttttaacccnctnatnacaannaacctaaaaagaaacnncannatcacctncatnaccccccaanacnactctnttttacacatacat

SEQ ID NO: 55572 - DNA, 503 bp, Triticum aestivum
  unsure (1)..(503): unsure at all n locations
  Clone ID: PAT_TA_55572
gtggtctgagagtatttaaccaaaaactaccacatttgccggaaacgtgacggaaaactaccactctactttttgtgcgaaaaactatcaaatttttcctaaaccgtgacaaaaaactaccaactcgcgaaaacgctcgcttcgcccgcgctaaccccgtttctgaccggttgggcccgcgaacagttgccatgcgggctaacgggcggccggcgcacgttgacggctgttaacggcgtgtccgttgtcggaacggcgactgtcggtcggccaatgggtcaagatctgatcctctcccctctcgttgtactctctccgtcctctccctctctctgaactaggtggtggcggcggcgacaacgatggcggcggtggttccggaggggggcgtcngcgatatgggtggtggcggcggcgacaacaacgctggctgcggtggcataagtttggacgctgcgggctcagtcgacatttgggtggggagcaccagcttctcgacgcag

SEQ ID NO: 55573 - DNA, 152 bp, Triticum aestivum
  unsure (1)..(152): unsure at all n locations
  Clone ID: PAT_TA_55573
taagctagcaccgagtagatcgcggggtgccgtccaaatagcaagcaccagcatggcgtcggccacctccagattcatgctggcggcgggcatccccagcggcaccaacggcggggngagcagccgcgncagcttcnncccctccaacctac

SEQ ID NO: 55574 - DNA, 278 bp, Triticum aestivum
  Clone ID: PAT_TA_55574
cccacgccgtccgcggaatgcttccatgagcgaaggcggggggggcgagccgacatcttaaagtttctccgtggactcggatcgaggaaatccgagcggtggagagcggcggaagatctgtagtttcgtgctgtttctctgacaagtaaggctgtgtttgacaacaaggtattgcaaaaactgtagtattggaaaactacggtgttttaaactatatgtactagatactacagttttcacgtatcaaagaattttgaagtattgagaatactgtgacg

SEQ ID NO: 55575 - DNA, 436 bp, Triticum aestivum
  unsure (1)..(436): unsure at all n locations
  Clone ID: PAT_TA_55575
gtccgggcccttttccagccaacctcccacttgggggaggggggacancaaaaaaactccctcatcatgctcaacattaagatcctaatcaacaacttcacccgcatcaccacgctcctcaccagctcgccctccatacgactatgtcgacctcgacctcctcaccgacccccacatccccaccgaggacatgacctacatccctaactaccacaccccccacctccactacaaacacaaagacatcaatctaacgcacgccatcactctgctctttgccaacaagcccgttaccttctttctccccacgaaccctgacaagatcccgtcgtgtcaggctgtggcctattaccacttctaccccacctctctcacccctgacaacgacactgccattactcacttgcagggcgcccccaccaacgccgccatctct

SEQ ID NO: 55576 - DNA, 274 bp, Triticum aestivum
  unsure (1)..(274): unsure at all n locations
  Clone ID: PAT_TA_55576
ttcccgctcgacccagcgtccgggcaactctgcttcgagcactccgttgccggggggggctgccacggcgtcaccgagatcaagatcgtctactacaacccatagctaattataagctcgatcgtcagtgggtatctatcatgtgttccgaagaggttgcaccatcgtcaatcgtgtactaccggatttgcagtgtttaactatgaagatgggctggtactacattttattacntaattattaatcggaggaaaaacctctctttttatattat

SEQ ID NO: 55577 - DNA, 701 bp, Triticum aestivum
  unsure (1)..(701): unsure at all n locations
  Clone ID: PAT_TA_55577
ctacccagcgtccggaggttttncaggagctcnncgagggggtcacggggggggcagaaaaaacaagggcaagatcaacttcgccaccatcgatgctaaggctttcggtgcccacgctggtaacctgaacctcaagaccgacaagttcccctctttcgccatccaagaggttgtcaagaaccagaagttccccttggagaggagaaggatannnatcacgacaacatcgccaagttcgttgagcaattcgacgctggcaagattgagcccaccatcaagtctgagcccatccccgagacccaggagggtcccgtcacagttgttgttgccaagagctacaacgatatcgtccttgatgacaccaaggatgtccttgttgagttttacgctccctggtgtggtcactgcaaggctctcgctcccaagtacgatgaccttgcttctcagtacgctgcttctgagttcaaggacaaggttgtcatcgccaaggttgacgccaccctgaacgacgtccccgatgagatccagggtttccctaccatcaagctctaccccgctggtgccaaggacgctcccgttacttaccagggctctcgaaccgtcgaggacctcgccaacttcgtcaaggagaacggcaagtacaaggctgagatctccatcaaggatgagggtacagaggaggctgcccctgcccccagtga

SEQ ID NO: 55578 - DNA, 573 bp, Triticum aestivum
  unsure (1)..(573): unsure at all n locations
  Clone ID: PAT_TA_55578
ccgggtctactccacgcgtccgtttttttttatgtttattactgtatgagggagggaggggggctttgagaaagaatcgttctgtgttttgcaagcgaagtcccggtcctgttctggtgaatataatgggggttagtccctgaaacatcttttgtcctgtggctacatatgtgcaaatagttctactcctggtttgtnggtgaacctgtttctgaacttggttttattttatgtttattactgtataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaagggggggcccgttttaaaggatccaattttactaccccggccttgcaacttaaaattttttttttggggcccccaaaattaatttcctgggccgggttttaacaacggggggaggggaaaacccttggggttcccaaattaattccctttgaaaaaaatccccttttccccagtggcgtaaaaaccaaaaagcccccccccgatcccctttc

SEQ ID NO: 55579 - DNA, 318 bp, Triticum aestivum
  unsure (1)..(318): unsure at all n locations
  Clone ID: PAT_TA_55579
cacaacccacnccanttcaacnaccccaactgnttcctcaacacaaaaaatgactacaatgacggcaccttctcccatatcatatacaacgccgtcgacatgaacctcagagattaccttgagagactcaacaagatcaggaaccatcgcggactgcatcactactgcgacctccttgtccgttgtcatcacaccaagactcaccccatgagaccaaacactgttggtgtctccaaaaacaataactctcttcacaacgatcccccatatcttttctactactgatacaggccatctccagaatcttaaggaatgttc

SEQ ID NO: 55580 - DNA, 444 bp, Triticum aestivum
  unsure (1)..(444): unsure at all n locations
  Clone ID: PAT_TA_55580
ccccgtctaccccgcctccgcccacttgtccgcccacgcgntccgagtgggaaaaggggggggaaaaaaaaaaaaaaaaaaaaaaaaaaaaaaaaaaaaaaaaaaaaaaaaaaaaaaaaaaaaaaaaaaaaaaaaaaaaggcgcgcccccttttaaaaaatccaactttacttccccttccatccaacttcataccttttctatagtttcacggggggtaaattcactgcccttcttttaacaacttcttaactgaaaaaaccctgcctttccccaatttaatccccttccaacacatccccttttccccacctgccttaataccaaaaagccccccaccaatcccccttcccaacatttccccaccctaaatgccaaatgaaaccccccctttacccccccattaacccccccggttttggtgtttacccccaagttaacctt

SEQ ID NO: 55581 - DNA, 302 bp, Triticum aestivum
  unsure (1)..(302): unsure at all n locations
  Clone ID: PAT_TA_55581
ctcgacaaggagaaagagagattgatggcgcgtacgaagcagaccgcccggaagtccaccggcggcaaggcgccccgcaagcagctggccaccaattcttctaggaagtcggcccctaccagggagcggggtgaanaanccccacctctacanncccnncaccntnncnctacacaaaatccacaantaccaaaaaaacacnaaactactcatccacaaactaccataccaacacctnntacaaaaaatcacacanaacttcaaaacaaacctcannttccagagccacaccaaactaaccc

SEQ ID NO: 55582 - DNA, 596 bp, Triticum aestivum
  Clone ID: PAT_TA_55582
cccactcgtccgaaaaataaaaaaaaaaaaaaaaaaaaggggcgggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcccccctttttaaaaaaaccaaatttaacaaccccccccatccaaggggggggttttttaattttttttccaaaataaatttccttgccccctttttaaaaacggggaaattgaaaaacccttgctttacccaaattaaatccttttaaaaaaaacccctttttccccatttggaaaaaaaaaaaaaagcccccaccaaatcccttttccaaaaatttccccaccttaattggaaaaggaaccccccctttaaccccccattaaaccccgggggttttgggttttcccccaaattaaccctttaattttcccaccccctaaccccccttttttttctttttttccctttttttttcccacattttccccgttttcccccaaaaattttaaaaagggggcttcctttaaaggtcccaattaaatctttaacggcccctcccccc

SEQ ID NO: 55583 - DNA, 647 bp, Triticum aestivum
  unsure (1)..(647): unsure at all n locations
  Clone ID: PAT_TA_55583
tccgcttcatttcgccgcctccctcncccgggggtcgggaggggtctgcaaatctcactcancgggagcagcaaaaagagcggagagagcagcccgccatggccatggtcgcctccacctccatcgcctaccacaagccgcgtttgtcggtggtgtgcatgaagaaggaccgggacagggagctggggggggggaaggancacattttctccttcaaggtcgtcaagatcacgccgccgccgcgatgcctcggcgtccgctgcttccccacgaacatccactgcggagagagcgtgacgatcgaagggcangcgtacacggtgtcggcggtgacccaccggtaccagctgcgcaaggggcggtaccagcctagcgagaagcgcctcgacgttctctccaccggcagatacatcctcaacctctacctcgacagcctcctcgacaagtcctagactctatgttctactctatactaagtacaaatttatttattctactactccagcaaatttatttatgcatgtactgtaactgtacgtacgtacgctacttctgtgatgaggtccaaatgatttttatacagtancaagtacatgcgcgctgagcccttgtgtgaaggccgcgcatgcatacacgcatttggtccg

SEQ ID NO: 55584 - DNA, 624 bp, Triticum aestivum
  unsure (1)..(624): unsure at all n locations
  Clone ID: PAT_TA_55584
ctggacgagctcgtcgaagagatcctcctccgcctcccgcccgaagaccccgcgtgcctcctccgcgcctccgtcgtctgcaagggctggagcggcatcgtctcccaccccggatttcgacgccgcctccgggggaggggcggcgtaccccccgtgctcggcttcctccacaactggaaggacgatttcatcccccgattcatctccaccactgcatcgtccttctccctcgccgccccggaccgccgcgcctggggggccctcgactgccgccacggacgcgccctcttcttcccccagggatttggtgggctggagctgctcctgtgggagccaatgacgggtgcccagcagcgcataccggtgcccgcggggttcaagggtgactacccgaccgcggccgtgttgtgcgcagcggacgggtgcgaccaccgcgactgcctcgagggtcctttccgcgtcgtcttcctcttcgtcgtcgtggtagatgaggagaccagcatatactcntccgagactggcgcttggggggagctgacctcggttcagtgcaccctcgacttctccattgaattcacagaaagctacagcgtgctcgtcgacagatctgtgctctacttcacg

SEQ ID NO: 55585 - DNA, 624 bp, Triticum aestivum
  Clone ID: PAT_TA_55585
cgacccagcgtccgtgttttgttattgcgtctaaatctgggggggaggggggggggtcaagacctaccagcctcacttttaaaaaaaaaaaaaaaaaaaaaaaaaaaaaaaaaaaaaaaaaaaaaaaaaaaaaaaaaaaaaaaaaaaaaaaggggggaacgggaaaaagaaacaaaaaataaaaaaacacaaaaaaaagaaggggggggggggacaaaaggggtttgttaaattaaaaaaaatgaaacgtaatttaacaacgggggggaagggaaaaaccctgaaaaaacccaactaaatcaaattgaaggggatggccctttaaaacaggtggaatattaaaaaaaagggcgaaaccaattgaactgcccaacagtaacacaccctttttggggaaggggacaaacccaaaagggccccataaaacgccctttccaaaggggggtacacccaaaaaggacaaatgaaatcccacctgcctagggccacaaactgggggggttttgggtttttttctaagcaggaccgcaaattttcccaggcaaaaactaaaagggggtttccttttatgcctcctatttaaggcgattatgggaccttttccccaaaaaacttaaaaagggg

SEQ ID NO: 55586 - DNA, 305 bp, Triticum aestivum
  unsure (1)..(305): unsure at all n locations
  Clone ID: PAT_TA_55586
cgtggtggcaancaaggggggtgggggcggggganaataatgtgagggccaagctgaagcctctaacgagcgcgaattggagcagcaaagcttgcaaagtagagttgtgcaagagcacgcgcactgaacctggaagtcctatttacagcaacaagatagcttctgattttgggtggggggggccttttnaccttttctagtaccactanaangcanaaaggatctctgtaagttaattagtagcactatgcaagactacttgttactcagctagacttggtgtttgttggacttggcagcatttc

SEQ ID NO: 55587 - DNA, 247 bp, Triticum aestivum
  unsure (1)..(247): unsure at all n locations
  Clone ID: PAT_TA_55587
tagcgcctgagaagctctgcatataagaaagacccatgtctatagtgttcattggatcagaccgaagtttatgagctgctcatgtagattgtctagcagcccagtggatgagggtgggggactggatactaattgtagtaaggtatagacctacaagatctgtagttaagaaaagaggattgatgctagcatcaaaataataggagcaannccatcgggggatccagggggggggtgtttttcacaa

SEQ ID NO: 55588 - DNA, 672 bp, Triticum aestivum
  unsure (1)..(672): unsure at all n locations
  Clone ID: PAT_TA_55588
naaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttttaggggcccaatttttcccccccgggcctgccccgggatggttttttttttggggcccctaaattaaattcccgggcccgcgttttacaaccggggggtggggaaaacccggggggtcccccatttaatccccttggaaaaaatcccctttttcccccgtggggtaaaaaaaaaaaggccccccccggttcccttttcccaaagttggccccccttaatgggaaaggggcccccccctttacccgtttttttacccgggggggggggggggtttccccccggggtaccctttacttttccaaggcccttggcccccttttttttctttttttcccttttttttcgcccccgttccccggttttccccttaaggtttttaatggggggcttctttttggggcccgatttaaggtttttcggccccccccccccaaaaaattttttttggggggggggtcccgttgggggccctcccccttgtaaaccgtttttccccctt

SEQ ID NO: 55589 - DNA, 273 bp, Triticum aestivum
  unsure (1)..(273): unsure at all n locations
  Clone ID: PAT_TA_55589
ccgggnncgacccacgcgnnccgcccactcgggcgcangggacccgacggggggcgaggggagggaaaaaaccacggacaaggagggccgagccgaccgaccgggcaaggacgacggcaacgaggaagaaccgcacagcangggggcacagagccagagcgaaccaacggacggagacgagagacggagaaaaacaacaaaaacgagggggggggagcagagcaaacagagagcagaagccgaagggagaggggcgaaggggagaggaggggg

SEQ ID NO: 55590 - DNA, 311 bp, Triticum aestivum
  Clone ID: PAT_TA_55590
accaccgcatccgagctgccagagggcggggaaccatttcgctattacagaacccgggtctgggacttctgaaactataccaccctcacctaacgacacccccccagacgcacgcatgacttctatccctaacgccggccgacccttacgttcgagctaatctctatgggccagagtgggcaacttctctttgcttggtatgtgttgggtagatggatactgtttggcggctaatgactctgttggttaagagctgggataccaagatggggggaataaatagggaatgtaatattacaggaaaggggggg

SEQ ID NO: 55591 - DNA, 674 bp, Triticum aestivum
  unsure (1)..(674): unsure at all n locations
  Clone ID: PAT_TA_55591
acccagcgtccggatggttcaanagccctatgctcagcaagctgcggggggggacgcggaactccaaacccttcttctgaccttcgccgcactcttccgccatcaccacgtacactcaacataccgcgtaatccaactaaccagcttcacaaacaacaaactcgaatcacacctccgatacaactcccaaccatagaggacaatgatcccacaaattaataaacaaagactatcacaacctataggcaagatacaaaggaaggacaacacatatgacagatacgatatgtgctcttaaagaacacatactgacacagatacaacatatgaacatatacaatcagtcccccaccaacactacacacagagaatgctaatactaccaccatagttacccaccacaatctcaaggcaaaaagattgtggcatcttagactaccactcttaaatgatcaagtgaacataaataatctctaactccaaaagctaaatcattttcacaactctattatttttatagaacataattatctacactaccttcctttaatttaatcatatgactcgtccatacaaactactgaaaaactactcacacagggactaatcaagtaaaatgtttactctcctcttacttagtagaaataatatactacccttctcacttgagtcgc

SEQ ID NO: 55592 - DNA, 356 bp, Triticum aestivum
  unsure (1)..(356): unsure at all n locations
  Clone ID: PAT_TA_55592
tcgacccagcgtccgggaatttccttccctcttgtccggccatgggcggggggggcgccggccggacctctcgcaccctccttntagcagcgccataacaatttggtatcagctagcttcggtttgatcatgtgttcaccggcgncaagcccgtctcttccgctaccggtcacctcgtcgnctncggcgaccaccaggaggggggccacgctcttttttttgctgggatcctncgtnacgcccgnccccgncgacctcatctcggaggaggtgctcggggtgctgnaggacctaacccaggcggggcaggagatccacctgttattggacgagtactacggggcggaaaagggtgg

SEQ ID NO: 55593 - DNA, 379 bp, Triticum aestivum
  unsure (1)..(379): unsure at all n locations
  Clone ID: PAT_TA_55593
gcgtccgaggcgtgtcacgcccatggccccgggcgcctgcccgtcgacgtcctcagcgacgacctgctgcaggaggtcttcgtcctgctcccgggccccgccgacctcctccgcgccgcgctcgcctgccgccccttcctccgcgccgcccgcagcgccgtcttcctccgccgcttccgccgccggcaccccttcacctgcccgctcctcctcggctgccacctccacctccccggcgagcgccgcgggaacagcgcccctcacctgcttcccgctcccccctccgccgccacgcgccgggtcgccgagcgcggcgacttcgccctctccttcatcccccgccgcggccggccgggcgccgacggnaccggaaccccgt

SEQ ID NO: 55594 - DNA, 563 bp, Triticum aestivum
  Clone ID: PAT_TA_55594
ggaagcagggataccattgactcctcatgcatgagagtactcgtgctcggactgtccacgggagccggcatcttctatagcgttctgggggcagctatggtagggcagaggatctgacgcagacactaccacatgcttgcgaaccgaatgctagcagaggagtaccgttgcgctatatggtgacacctgaccgtgcagagtggtctacgacgccactccctgctgcgcacgtacagcagctcatatccctgatactcctatagtgcatgacatggagctgcatggctgttgatgaagagcgtaaggagaggaccagcaccacagcctgccccagctgtactggaagcacatactaagccgacggcaggcatctgattgaatccgccctgtggacagcccaacatgcgcgcgatatcatccggtcctttttgcatactgaaccaggggcactggctacacccttggatttcatacataccagaccgctcgtgcccgaactgtgcggagctactgcggccatggtcttgatgtacatgatccaaggacatatctgggttcaggtt

SEQ ID NO: 55595 - DNA, 518 bp, Triticum aestivum
  unsure (1)..(518): unsure at all n locations
  Clone ID: PAT_TA_55595
cacanattttgttctctttntttgccttatgtcgacggcccaaattgggttgtgggcatgtactcacaaagtacgagaagagaaccagtcgattctttcggcggcatttatcgaaaataagctgggctagctagcagtacagtcattgtgagagacagcgtcgtgggttacatatagtaagtacagtagttgtgtcctggttcatatgactgcaagactggctgctatccagcaggtggaagtaagagggttacatatagtaagtacagtagttgtgtcctggttcatatgactgcaagactggctgctatccagcaggtggaagtaagagggttacatatagtaagtacagtagttgtgtcctggttcatatgactgcaagactggctgctatccagcaggtggaagtaagagggcgtgcgtcaagttcgtttgttctttgtgtgatcagttgtgtacttttgtgtctaatgaaaaacctagtcttcatgaaatgtcatattccccaagtttgatct

SEQ ID NO: 55596 - DNA, 680 bp, Triticum aestivum
  unsure (1)..(680): unsure at all n locations
  Clone ID: PAT_TA_55596
gtgagatgttaaattctagagtgacataagtaaaattggcaaaagctagagtgacaaaaacaaagttttccttttgaaaaaactgtgctagtataacaatacctgctagtgctgcagggttggagctacgttggtgacaggctattgtcggcagtcgtgccgtatgaagaaaccgggtggtacgatggccaaatgtgggtcaagccagcagaggtgctggctcgcgacaggttattgggatcttacaaggtaaagccggtgatcaacctgctcaaacagacactggtgggcaccggtgcgctgctcgtcggggcggtggcactcttcgccttcgccgcccccgtcgaggaattcgtccactccttcaatggagcccccactgccgcctcctctaagccgatgatgaggagagaggatctgctgaagctgcctgccgaggtgaggcaagacgacgacctcgctgcggctgctgcggaggccgccaatggaacgcccggtttactgcagggaccgctactaccgggcgctcgnncggcggtcagtactgcacctcagacgacctgctcaactgatgataacaaatagtaatagtagatacgtattctggtatatgcagtttgccacattgatataataataagcacaagttaagcaaatgtatcttatcggaatgaaatttt

SEQ ID NO: 55597 - DNA, 699 bp, Triticum aestivum
  Clone ID: PAT_TA_55597
gaaacggaagcatgaacatgatgaggttcctcacacaagcccagcccttccatctgctcaagtccagcaaccacagctacaaccaactgtgtccaataaccgctgctttcttcattatctaccggatttgaggcaggccaaggaaatcgcatataattcttgtcaactgaaacccaaggttgaggtaagtgattacttcgattctccgtcagcaaaattaataggcaagttcttctctgaagctggacctgagcctggtgttctccattcatcatctttgagggagatggttgtgtttccccaagggcctggggctgtaatgcctacgtacgaagctgttctgcaggagcaactaagagaaactgagaaccgcgcaaaggaactcaagcaagagtggcaaacaagtggctgcactgtaattgtggatagttggaagagcaagtgtgacaaaagcttcgtaagtgtcctggtgcagtgcagcaaaggtacgcagttcctcagatccattgatgtctctgaaatcactgaggacttcgatgagctagaatcaatgctttcttgcgtggttgaagatgttggtgcccataacattgttcagattgtcatgaatgacgtgtcaccccatatgcagatggcacgggagtatgtgctaaataaatatgacagtttttttcttcgtgctatgtgctgaccattgca

SEQ ID NO: 55598 - DNA, 575 bp, Triticum aestivum
  Clone ID: PAT_TA_55598
cgggctacaaggtgagcgcactcacgggctgccgggcaatggtgaagctccagtgtgtgggcagtcaggtgcccgaggctgtcctaagagattgctgccagcagctggccgacatcaacaacgaatggtgcaggtgcggggacctcagcagcatgttgcgtagtgtttatcaggagctcggcgtgcgtgaggggaaggaggtgctcccaggttgccggaaggaggtgatgaagctcacggcggcgagcgtgcctgaggtctgcaaggtgcccattcccaacccgtcgggagacagagcaggtgtctgctactgggccgcgtatccggacgtctagtcaagcgaatctgcatcttaattggtgcggtgcgtgcgcacaagataaataaaattaagtaatggtgcggtgcgtgcgcacaagataaataaaattaagtaatggtgcggtgcgtgcgcacaagataaataaaattaagtaatggtgtatgtgcctctgcgagatgcatgggtcatgaataaatgtgaactttgtttcctgttgatggattacactagtatctcagatttgtaccttacc

SEQ ID NO: 55599 - DNA, 660 bp, Triticum aestivum
  unsure (1)..(660): unsure at all n locations
  Clone ID: PAT_TA_55599
caaccatcattttagaagtgacaactaccaccattttcacagcaacaaccaccgttgtcgcaacaacaacaaccagtactaccggaacaaccaccattttcgtatcaacaacaaccaattctaccgcaacaaccaccattttccgcaacaacaacaacaaccagttctaccgcaacaacaaataccatttgttcatcacatctatcttgcagcagctaaacccatgcaaggtattcctccagcagcaatgcagccctgtggcaatgccacaaagtcttgctaggtcgcaaatgttgcagcagcagcagttgccatgtgatgcaacaacaatgttgccagcagttgccgcaaatcccccagcaatcccgctatgaggcaatccgtgctatcatctactccatcatcctgcaagaacaacaacaggttncagggttccatccaatctcagcagcagcaaccccaacagttgggcccaatgtgtttcccaaccccaacagcagtcgcagcagcaactcgggcaacaacctcaacaacaacaattggcacaggngtacctttttgcagccacaccagatagctcagctttgagggtgatgaacttccattgcgctccgtaccctacaaacgatggtgccgtggtcatggtggcccgttgtatag

SEQ ID NO: 55600 - DNA, 722 bp, Triticum aestivum
  unsure (1)..(722): unsure at all n locations
  Clone ID: PAT_TA_55600
ccaaggacattctctgcagcatcctgtcacggttgcctataaaggaagccgtgcggacgagcatactgttggaacactggaaacatctttggcgctgccactcaaatctagaattcagtcttagatcaatgtttccaggtcctcgtaccaatggacccaacgatgttaggccatggaaagacgtgtttattgagagagttgatgcggtcctgcagcaacactctggtgcaggggttgacaacattcagttccaggctccatgtgacgatgagcatggggatcggatagagggatgggtcagatttgctactgcttccaagacgaagcaacttattctcgatttctcagctacacaccatatagagcaacatccatataaaatcgatttgcggcttctcgatgacagtaaaagctcacacctgcaatccataaaactctgttccgtttctctaaaggtgcctgcggatttcaagggttttcggaaccttaaatggattttcctagcggacacgaatattaccgacggcgaccttcaccattttggtgtccactgcagtggtatttttggaagttccttggaatcgctgggttgtngggatgctcangaaggttacatatatnctcatcttttcanacaagcttaagcatttgcaagtatatgactggccgcttgcttcaacgaatgggagttaaacctttggtctggtaaagctcgagtacag

SEQ ID NO: 55601 - DNA, 516 bp, Triticum aestivum
  unsure (1)..(516): unsure at all n locations
  Clone ID: PAT_TA_55601
gggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactacccaacttctctgcaacagccaggacaagggcaacaactgggacaagggcaaccagggtactacccaacttcgcagcagtcggaacaagggcagcagccaggacaaggaaaacaaccaggacaaggacaacaagggtactacccaacttctccgcaacagtcaggacaagggcaacaactgggacaagggcaaccagggtactacccaacttctccacagcagtcaggacanggacaacaatcaggacctggacaacaagggtactacccaacttctccgcacagtcaggacatggtcatcatccgtgacatgggcatttggggtgcttcccaccttctcggtcgcagtctggacatgggtcagctcctggac

SEQ ID NO: 55602 - DNA, 723 bp, Triticum aestivum
  Clone ID: PAT_TA_55602
ggtggggcttgaactccgcgggcccccttttgatggacggggccgcccacatcgccagcgactccccggaggacgacagggcctcctcctccgcgtcctctaccggctcggcctcctggcgctcccggccgcacaagtggattcacctgcggcagcgccggcgaccgttgtccgctcggagaggagagggcggcgaagccaacggcaagggcgacggtgacgacgtgcaggacctcgcgctgccgctggggagatgtccttcacggcggttctcgcccagtacatgcctttggaaaaccatggccagtgttgtttccaccggaccgggtcctctctccgctgttctgatctaatgtcgactgcgtgccgttggcttcccatgcacaaggtcctaccggcggcattgggcaccacgtgggaagcggaaggaggagccgcaactctccatgcaagctcgggtcaatgtcatcgcaagttccgtgctcggcattgctgttcaatcttgcctcagctgatttcgcccgccgtctgcccgatgctccacactttgccgtaactcaatctgccggttctccgcttgaggttatcatatgacagaacgtctggggtgaaagctaagctacttccaatggtcccaaatgagaaggcaagaaggtatcagctgtatgagaagacccccgcccatgcccattccattctctatgaagtcaaaagtttcccact

SEQ ID NO: 55603 - DNA, 190 bp, Triticum aestivum
  Clone ID: PAT_TA_55603
cgagcggacgccctcataccacagttactagttgaaaaaaaatgtgaattcaacatgaacaaaagggaaaaatgttgactttgttaggtgcgactagtacgagcacggtacaattacagccccaaaggccctgaaaagaatattgttctcaaagatccataggtagaacggcgccttctgggtggcggga

SEQ ID NO: 55604 - DNA, 525 bp, Triticum aestivum
  unsure (1)..(525): unsure at all n locations
  Clone ID: PAT_TA_55604
acatgatgggtctctttattccatgtacggtggcttatggttaccatggaacctagttacacacggttcataacattacatgatggtgcatgcatctgggctctgatcgccgaaagtctgtggcggatagtgctgcggatacggcccataatacgttgctggattaccagcatatgggtattggtggtattgctgataagcatagtgcgggtatgcgtaagcgtaggctgctgggtggtagttgtactggtagtggccgttcacggccatcttctcagcctccggcgccaccgcaacaagtgaagccggcgcaggcagtttgaantaggtggtccttcgtctggttttcctctacaaccgtctccttctcaaccccatctccatcccctttgcccggccgaccggcgagtcctgtagcagggagctaaggggcatggcggactgggcgccggtgttcatcggtctggtgctcttcatcctcctctcgccggggctgctcttccagatccccggcaagggcaggat

SEQ ID NO: 55605 - DNA, 784 bp, Triticum aestivum
  unsure (1)..(784): unsure at all n locations
  Clone ID: PAT_TA_55605
gccgggacaagggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccagaacagggggcacaaggatactacccaacttcntcgcagcagtcaggacaagggcaancaccaggacatgagcaacag

SEQ ID NO: 55606 - DNA, 575 bp, Triticum aestivum
  Clone ID: PAT_TA_55606
gatctcctcgcatggctcatcctaggaccctggctgcttgctcaggctccaagtctctcgtgtcatcatccagtatgcggtacgccaggagagcacgattagaagcgtgcaagatggtaaccttgcttccaatggatctgaatcgtaaatgccggtgtggttctggccttccggcggcgataggttgcaattggtgatttgtctaggcattgatttggacactgaaatggccagatacgagggccgctgaaaggaactggataggagtactgcaggatcaatgacaaattgggctgtcttccttttcgttgtgctgcaaaaactacatcgggttggagggacccctacatacttctcacaggaacgatgaacagtacgggacactgggcttccgagccacgacagctcgcgcaccaacggcgtctggcgactgccataacaacgacaattgtcacaagggacctttttgcaggcacaccaaatagctcaggttgaggtgatgacttacattgcgctacgtaccctggcaacgatgtgccgtgataatgtgcccgttgcatacaaccaccactagt

SEQ ID NO: 55607 - DNA, 635 bp, Triticum aestivum
  Clone ID: PAT_TA_55607
gcacagaggtgttggtagcgattatggatacattgtagaaaccgctggcatcagtgaatagagctgtggcagctgtatagtctgcaaagagataggttgggctgaccggccgattatttgtctcccacaggaagccattgtaatatatatcaaattcccgcctgctctgattctggaaatcagtataatacaaattgaggtagtacccaggcggtgccatggccggccaggcagaaggaactgcccacgacaagttgagagggatggaggtggtaagcgaggtgacggcagtttggagcactctaattggcacctcagctgtatcagttaaataacgtttaatttcacttgttgtcgatagattcagccaccgtgaggtaccgtttgatggccaccacaaacgatcgtaggtatcatccggacacctgcgaaagtaaaaactgagttaatatgcttgtgtatatctttatgtatttatgtaaattattatgttttcactggttatgaagtagcaactttgtacttgttttcttgttgtgcactatttctgcaattgatgtgaaccacacttcctaaaagtttgtatgtaaactgtgttagtgggttttgtatatgctaatgtttcatcattgagt

SEQ ID NO: 55608 - DNA, 771 bp, Triticum aestivum
  unsure (1)..(771): unsure at all n locations
  Clone ID: PAT_TA_55608
gcaacaactcatttccaccacaacagccatatccgcagctgcaaccatttccatcacaacaaccatatatgcagctgcaaccatttccgcagccgcaactaccatatccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaaccgttgagccaggtctgcttccaacagtctcaacaacaatatccatcaggccagggctccttccagccatctcagcaaaacccacaggcccaggngctctgtccagcctcaacaactgccccagtttgaggaaataaggaacctagcgctagagacgctacctgncatgtgncatgtctatatccctncatattgcaccattgctccagttggcatcctcggtactaactgagaatagaagaactctagtagtagatatatg

SEQ ID NO: 55609 - DNA, 758 bp, Triticum aestivum
  Clone ID: PAT_TA_55609
tgcaaatttgggatactgctggacaagagcgatttaggaccatcacaagcagctactaccgtggtgcccacggcatcattgttgtgtatgatgtgactgaccaggagagcttcaacaacgtcaaacagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgcaacgat

SEQ ID NO: 55610 - DNA, 504 bp, Triticum aestivum
  Clone ID: PAT_TA_55610
gtggaactttacctgtgcgctggtgggcatactggtattatcctctagccactgtgctcactgcgactccttcaactaatgcattgggtgctaaataaatactggctctcaccaagaggacacaggagcatgtaccagaaatcgataagacgaaggctggaaaggcatctgcttccttgcccatggtatatgctgtcgcatgctttgaatatacctgcttgaagctgctgacacggtgatcctgacattgtggagcgcttgtacggaccactaactgtgaccgagctgcctttctttgcttgcattgtgacgcttgttacagatggtactcttgaagtgctcctgttggatcagctgacagcagcacctgaaggctatgcatcggtaactctgatgatgtagctacactctactgtagacatagtggtgaagaacatgaatgccccataagtagacacttatgctgattatgcataccctattatagatgatgtgcctgacgaa

SEQ ID NO: 55611 - DNA, 456 bp, Triticum aestivum
  unsure (1)..(456): unsure at all n locations
  Clone ID: PAT_TA_55611
gatgattttacacacaaagaggtcaaaacttgcggtcttgattatcttgcgactgtcagtgctggggaagcttcaaacaaagaggaacatgtctgagaagatcttccgttcctgccatgccccatcatgcactgccttgttcggcatagcatgacatcatgggatgactagatggagagatgcttgatgcatacatctggatgacccggctcctaaccgatgggggatggctactgaaggaacagagctctgtagtgacatttggagttgcagcggcaaatganaatctgctgcacgcggcgtaactgcgtgagaagacacgtatgagcggtcgcaaccatgctctttactttgccatcactgtcagtatgctgcctgaaattataaattccatgcttcttacaacatggctgagattcaatgagataaacctatgatgggtctttagagttcaat

SEQ ID NO: 55612 - DNA, 663 bp, Triticum aestivum
  unsure (1)..(663): unsure at all n locations
  Clone ID: PAT_TA_55612
ccgggacaattgcaacaaccagcacaagggcaacaagggcagcaaccaggacaagggcaacaaggtcaacagccaggacaagggcaacaaccaggacaaggacaacaaggtcaacagccaggacaatggtgcaacaaccaggacaagggcaacaaggtcagctagctcggacaaggtacaacaagggtactacccaacttctctgcaacagtcgggacaagggcaaccagggtactacccaacttctctgcagcagctaggacaagggcaatcagggtactacccaacttctccgcagcaaccaggacaagggcagcagccaggacaattgcaacaaccagcacaagggcagcaaccagaacaagggcaacaaggtcagcagccaggacaagggcaacaaggccagcagccaggacaagggcagtaaccgggacaagggcaaccagggtactacccaacttctccgcagcagtcaggacaagggcaaccagggtactacccaacttcttcgcagtagccaacacaatcgcatcaaccaggacaagggcaacaaggtcagtatgtaggacaagggcaacatgggtactgttggaaatatgccctagaggcaataataaattgattattattatatttccttgntcatgatcatcgtttattatc

SEQ ID NO: 55613 - DNA, 703 bp, Triticum aestivum
  unsure (1)..(703): unsure at all n locations
  Clone ID: PAT_TA_55613
gtcgcgatgcatagctgcaggagtggacaacaaagacaaatactcccttggattcgtcgtgattctggaatgggaggcaggtcgctgctgctaccgcccatgaagctgacgatgatcagtggccgtcatgcagcggcgaggtggcggttgtggaggggaggggagacgcgcgggcgaaaaccaacacgacgaaggaaggggatgcctcaggtggcgatggtcatgacggtcactatattgtgatatgttatttgcatataaatgattcaggggaccctgattgttcgaagatggggcccatctctttctaaactgcaaagaagtgaaggagcaatggtatgccttgctgctggaggaaatccggatcagagtgtaattcagcacatgacgtcatgagaaaaattctgaggtcgcggagaaggataagttgctcactatttgagtgtgggccgagaaatttttgaaacagactcgatactcaagcaagctgtgagctttactgctgggtattttcttatgtgatatcaagtacccactactataagcgtactttattcattgattgaggctagagtgattcatgctccaaggngatgtaaccaaccatctaatgtgctggcagctttgggtgcaggattagacactggtgatcatgtttaatggttctcagactacattgaggttgtagcccatgttgtaatcg

SEQ ID NO: 55614 - DNA, 710 bp, Triticum aestivum
  Clone ID: PAT_TA_55614
ggtatctctcaaatgcagaggttcagataagctcatggcggattcccatatgggagaagtctaagatttgcttctacgtgatggatcatcctgctacagagtcaggggaagctgttggcattcatggtggggaaattgagatcgaaaagctggctcttcatgaggttgaactgaggagggaactgctccctgtgtttaagcagttccactatcctgagcaaaataggaatcatgcaagccgccaaattcagaatgcattatccggcatcgacagcacacagtatagctcggcaaaggatagtgatgcatatggtcccaaaccagtgcctcatatatctggattttacactgatatgagaaaaacagaaaacatgaatgttttagctgggcagttattttctggacctactcctgctgtggatttgctgccaaaggaaaaatgcaattctattggatctcctgaagctagaaatttgactgtcaatcacaaagtagataacgggagcattggctatttgtctacaccaatcggaacaaatgtatccaccatcatgcctcagtctagagagggtgtggattgtgtaccatcgcacatcagaccattgagcaactattccctcttggatggacctcttgataatggatcaccttccccctgccagtaacgggatcatgtgggccctgaaataaccaataattcgtcagtcagc

SEQ ID NO: 55615 - DNA, 503 bp, Triticum aestivum
  Clone ID: PAT_TA_55615
gatgggaagaaggggaggctgccccagcaaagcggtttaaggccgcagatcatgcaccggctcatgcaaacaagaaagtgtatgcgtcaattttcacttcttccaataagtctgatttcagggagacatactcatgccggtcactccccctgggaaggaattaaatcgatgttggggagattccaatggcatggaggtgaacctcgtgtactgattcagcgattagcttcataccatggctcgcccataagttctggtatttttgttttagctgttggtgttatctatgcttgattgctgtgtggagctttctagttttcactcgcagagaagcaatatgtttttataaatgatttgtgaaatatgtaatagctgtaacacatatcattgagtccagtcttctagcaatttgtctgagtaatgctctagttttcattcaaagagaagcaatatgttcttataaatgctttgtgaaatatgtaatggttgaaacagttggcgct

SEQ ID NO: 55616 - DNA, 702 bp, Triticum aestivum
  unsure (1)..(702): unsure at all n locations
  Clone ID: PAT_TA_55616
catatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaccgttttcttaatcngacagttnngatcgttgtagcggntgaaaaaataaaagtgtcatgcactatcatgtaagaacccgaactatact

SEQ ID NO: 55617 - DNA, 311 bp, Triticum aestivum
  unsure (1)..(311): unsure at all n locations
  Clone ID: PAT_TA_55617
gcaaccaggacaagccaaccacggcacgagccaacggggccgcacgagacaggacaagggcaacagccaggacaacggcaacaaccaccacaacggcaacaaccacaacaacggcaagcagcgccaacgaaaaggcccaaaccgaacggccgcaccaacaggggagcagccagagaggcgaacgggacgcggggggaagaggagcaggaagcgaggagggagaggggaggacgcgccgagagagcgcggcacccgagagcgcccaaccgacccagcaggggaggcacggacagagccnngcggccgcgcgg

SEQ ID NO: 55618 - DNA, 760 bp, Triticum aestivum
  Clone ID: PAT_TA_55618
cgctcctccccgaagacggccggaggccgtcccgcgtggtctgtgtgcgtgtagacggccaacgggcggagcgggccgccgtcttctcatcggacaccatggagtggcaaattttcccggagactacgctgcagctgactgtatctgacaggctcagggccagcggagtggtgcatgggctcgtttactggagaggctggatgtatgaccaaatcgtggtgctcgacaccgccacctttcagttctctctaatcgatctgcccacgcctttgaaaccggagttgggtgaatcaacatataagcttggtgagaccaaggatgggaagctctgcatcgtagatataaaggataacactattgtttcttggttcctggacaatggcagtgtcatagagagatggatttcctacaagaatttcccattgcgcccaattgttagggagctcactgggtgctcaatggaggaagaggattattgtaatgtcaacgtggacctagtggcagttatcgatggctttgtctacatctgtattttctacctcaaggacacagaatattggtgagtcgtacctgtcaatatgcctggaaacatcagatatgtgcgagctctataatggtgcatatcggcataatgaggcggcccatccctatgtcatggcatggcctccctctttggtgcaagcagggaggaatcagaactgaagatgatgatcccaagacacagaagaacttcctctgtcctcatcgctgcactggagtc

SEQ ID NO: 55619 - DNA, 788 bp, Triticum aestivum
  unsure (1)..(788): unsure at all n locations
  Clone ID: PAT_TA_55619
cgtnnacctccgccatgttcttttacaaggacgagcaagaggaacggggaagatgagcaggacgaaggcaaatagatcgtagaggagccgaacccatcgatcgctgtttgtcgccaacgcgattattaggtggtgttttgtttggcgccaatgtgagtcttcgtggttctgtttggcgccaatgtgagtcttcgtggttctgtttcgcaacaacaacaaccagtactaccgcaacaaccaccattttcgcaacaacaacaaccaattctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtaccctaccaacgatgtggccgtgtcaatgtgcccg

SEQ ID NO: 55620 - DNA, 770 bp, Triticum aestivum
  unsure (1)..(770): unsure at all n locations
  Clone ID: PAT_TA_55620
gggtactacccaacttttctgcctcattgaagacaaggccagcagccctgcactctggcagcaacgcgtaacacgggcaaccactatactacccaactgtcttctgctgcacccaggacaagggcaacgcagggactccactcacatacttcttcgtatcagtcaacaactgggacctgagccaggacaaatgcaacaaccagttcaaagacatcaggggcaggatctaacgcaagggcatgcaagggcagacagccagcgcaagatgcatcaggggcatctttcagcacaagggcaacaaggtcagaagctactacaagggcgacatgggcagctgtcagcacaagggcactgaccagcacaagggcaccgtggtcagcagccaggacaagggcaacaaggtcagcggccagcacaagggcagcaaccgggacaagggcagccatggtactacccaacttcttcgcatgagtcaggacaagggcaacagccaggacaatggcaacaaccaggacaatggcaacaaccagtacaagggcaaccagggtactacctaacttctccgttgcagctaggacaagggcaacaagggtactacccaacttctctgcaacaaccaggacaagggcagcaaccaggacaatggcaacaatcgggatcagggcaacatgggtactacccaacttncttcggcatctgtcaggacaaggggcacggccaggacaatggctgcaaccaggacaagggcaacaagggtactacctaacttc

SEQ ID NO: 55621 - DNA, 621 bp, Triticum aestivum
  Clone ID: PAT_TA_55621
ggaattttgagtcactggggagtccattctgtctggctgctgtatgcctgtatatatgtagagatgactggattttggtaggtgttttgtcgcctgcttggctgtttgttgctagtacaaaactgatctccacattgaagaagtggctactcatttaccaagttggatattgatgcctgcaccaaatgggagatgtgtggttgctgtagtaattatgttaccacaattgctcttgctggctttgtctcaaacacctggtgccacatgcacaactggaactaagtgtagtagttcctatgcctccgcttcacttccatagcattgacaacaatatgtttattgaaacaaactgcagactgaatttgctagaattgttttgttgtattaatgtggtttgatcacatctcatcttatttgcttgattttctgttgattactcttttgatgtgctgatttggcagttgggattttgaatctcagcttcttgacacgcatctgatctggtagctatttgtatgtgttcacaagacattcgacatgaagcttttagaatacaccccgttcgactggtatgccatcttttcttctttcttggcctcatagtgctcctggtaacatggg

SEQ ID NO: 55622 - DNA, 398 bp, Triticum aestivum
  Clone ID: PAT_TA_55622
cccacgcgtccggacgttttggaggcggccccgagggctttgcaacttcgacgacaaggacctcatgtcatgtgggttacaactattgcaggcatgtggaatgcttgtctcttcatcgccgcgggaaagtgcctcatgacttctttccggcagtgatggaagagccgcttgttcggcggagcgagtcccctggctagtgtgtgtgtttgtgtggtttgcgtgtatcgtggcattcggcacactttcaagagtgagcttggctctgtgtgtttacggtgttctgaagtgggcttggccattttgttttggttttcgcctgattttcgtcattaattggacaatcttctacttaatcaatgaaagggcaaagcttttgctttgtgtttgaatttatttgt

SEQ ID NO: 55623 - DNA, 714 bp, Triticum aestivum
  Clone ID: PAT_TA_55623
ggccgggcatcacttcaaaaaacctgcctgaaatagctcatcattctaattttagctcacatctacagtcatacaaactggatcatgccaaggccggctcagggttcctatccatttcttttttaccaactgtgcagccactaacttcatctgaagtgtcatcagtggtcaatggctctgctgttactttagcggcacaaggtctggaaagtgattctgttcgtgacaaggctttggaaattgtttctgttcatgaaaagggactcaaggttgattccacacttgataccctgagggaacctggtagcactcagctagaggctgtaccagctaaaggtgaagaatcatctttgaagaatgacgcacagtctagccttggtcctctttgttaccagattcctaacatgaatgatgtagcccctgccagttcctcactcttttctgaacatcaaaccgtgcatcaaacatctgagcattgcaggaatggagcactatcccccaatggttgcacgacgccaacgaagggaacaatgtcagtccagttaagtgttgattcaatattgaagattgctgctgacagcttcccagtcaccccttcaatattaagaagaagaaacgagaaagaccgacacctgctagtgatttgaagtttggtgaaccgaacactgatagcttttacacccctgctgggaagcgccctactacagacacccc

SEQ ID NO: 55624 - DNA, 724 bp, Triticum aestivum
  unsure (1)..(724): unsure at all n locations
  Clone ID: PAT_TA_55624
cacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgttacctggcatgtgncatgtctacatcccttcatattgcaccatcgcgccatttggcatcttcggtactaattgagaagaaaatanctctagtactagatatat

SEQ ID NO: 55625 - DNA, 573 bp, Triticum aestivum
  Clone ID: PAT_TA_55625
cgcaatggtagtgtgtttgttggaaccgctgaactgcacttttgagtccatcttcgctacgaattgcttcgggccttctagcttaaatcaatggagtgtgtagtttggggtgagctttgctgacccttttttttaaaaaaaaaaaaaaaaaaaaaaaaaaaaaaaaaaaaaaaaaaaaaaaaaaaaaaaaaaaaaaaaaaaaaaaaaaaaaaaggggggacagttataaaggatcaaaacttacaaaacccgggcatgcaaaaaaaaaaaatattaaatggggggcccttattaaaattccctggctatggttttacaccgtggggactggaaaatccttgaggggacccaatttatttgctttgggggggtgcttttttcgcggggggggaaaaacccaggggcccccaacgatagccctttggaaaagttgccccttttgaaggggggggggaacgcgcactgggccggcccattaaccccttcggatgggggggttacccgcatggggacgggaccctcccctagagccctacctccccgccttggggtgggggggttttctttggggga

SEQ ID NO: 55626 - DNA, 766 bp, Triticum aestivum
  Clone ID: PAT_TA_55626
gccggggcagcaacaacaatttccaccacaacaaccatatctgcagctgcaaccattttcgcagccgcaactaccatattcgcagccgcgaccatttcgaccacaacaaccatatccacaaccgcaaccacagtattcgcaaccacaacaaccaatttcgcatcagcagcagcagcaacaacaacaaaaacaacaacaacaacaacaacaacaacaacaacaacaacaacaacaacaccaccaacaacaacaacaacgacaacaacaacaaatccttcaacaaattttgcaacaacaactgattccatgcatggatgttgtattgcagcaacacaacatagcgcatggaagctcacaagttttgcaacaaagtacttaccagttgttgcaagaattgtgttgtcagcacctatggcagatccctgagcagtcgcagtgccaagccatccacaatgttgttcatgctattattctacatcagcaacaaaaacaacaacaacaaccatcgagccagatctccttccaacaacctcaacaacaatatccatcaggccagggctcctttcggccatctcagcaaaacccacaggcccagggctctgtccagcctcaacaactaccccagttcgaggaaataaggaacctagtgctacagacgctacctgcaaggtgcaatgtctacatccctccatattgcactatcgcgccatttggcatcttttggtactaattgagaaagagataactctagtactagatatattaa

SEQ ID NO: 55627 - DNA, 669 bp, Triticum aestivum
  Clone ID: PAT_TA_55627
tacaaatccaccatgaagacctttctcatccttgcactccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgcagcagctgggcagatcccgacagcgcggtgccagccatcacatgtgtatgcttatttgctcacacacacacacacacacacacacacgtgaccaggctctcacagctacacatatcatag

SEQ ID NO: 55628 - DNA, 789 bp, Triticum aestivum
  Clone ID: PAT_TA_55628
ccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagccctacagacgctacctgcaatgtgcaatgtctacatccctccatattgcaccatcgcgccatttggcatcttcggtactaactgagaagaaaataactctagtactagatatatgaaacaccgttttctcagtccatgggtttggtcgttggtagcgggtgaaaaaataatgtgacatgcacta

SEQ ID NO: 55629 - DNA, 433 bp, Triticum aestivum
  unsure (1)..(433): unsure at all n locations
  Clone ID: PAT_TA_55629
catggaataccttcctcgtctttgccctcattcgcgcgttgtgggcgacaagtgccattgcacagcatggagactagctgcatctctggcttggagagaccgagccatgagcacccattaccaccacaacagctcattttcacaacaatccaccagttttcacaacctctcctccacccattacctctgcaaccatcatttctcgcagcaacaaccaccattttctcagcagcaaccacctctatcgcagcacccacgattttcacagccccaacagccagctctaccgcacctgtcaccattttctcagcaccaccatctagtcttacctcctcttctgcgccccaacaacttgcgcanctggcggatgcgtattgttttgcccttcgttctgctgcagctatgcccatgcgacagtgttccctgcctgcat

SEQ ID NO: 55630 - DNA, 302 bp, Triticum aestivum
  Clone ID: PAT_TA_55630
cttccctctccgcctctagcgacgcaaagcccgccccgtcccgctttggccccgctgactccagcccctaccatgtcgcccccgccggcccccagtcccatccctctatgctgtagtgccgcaccacctcgcggatgagggtgacaagctccggcgcggcggcagacgcattgagccccatccctcttgtttttttgtgagatatccctcttgtattatatgtaattcatttgtgtctacactgtgtaatccgttcgtgggtaatctgtttgtcccatgaaatgaaacaattttgtattttg

SEQ ID NO: 55631 - DNA, 809 bp, Triticum aestivum
  Clone ID: PAT_TA_55631
ggcattacctagcttctcagcagcagccagcacaagggcaacaagggcactacccagcttctcagcagcagccaggacaagggcaacaagggcactacccagcttctcagcagcagccaggacaagggcaacaagggcactacccagcttctcagcaagagccaggacaagggcaacaagggcaaatcccagcttctcagcagcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaaggggactacccaacttctccgcagcagccaggacaggggcacaacccggaccaggggcaccaggggcactgcccaatgtcccccgcagcaacacaggacaagcgccaccaactagga

SEQ ID NO: 55632 - DNA, 535 bp, Triticum aestivum
  Clone ID: PAT_TA_55632
tgatttttatcttctgaacatattcttgtatgactaactgaattcattttctcaaaacgttggtacttttcctttttcatttatgttgctcgactgagtctctctcggatcatgtacactccacatgctagctgatctgtagcagtgcggaaggtgagcttggctgccggcagcagctcctttggctgatctgcggcgatgcagaagttgggttggaaaaaagcacgaccggctgctctgaagtgggtcgtagggagagcttcgtaagagatagggagggagctctattggcccgtgcatgacatccaacccaatggcatcatgccctggtaggcatggttgcatggccacggggagaatggagcaagtagcgtgtgaggagtttaagaaatggggacaagggacagtttagttaattaagtctatgttagttttaagttttatccttgttgcggtaaaaaattaaggttggattaaccaccatgtacatctttaattacttttaaataagaaatataatcaaaatattcttttg

SEQ ID NO: 55633 - DNA, 503 bp, Triticum aestivum
  Clone ID: PAT_TA_55633
gggctatactgcaaagggacaccctgccagacagaccaagacacttactgccatggcctggtagcagcaacccaggccgcctctccattcggatacggttcggaggatccattccctgcccatggaacggagggggcttcctccatcaacatcatgctgcgcggtggcaccagcaacagcctgaacatctacagaagacaattctagatcatagttactttctttttacaccaaaggtcgatcttttcatttgctgtgatacttagcttttcgtcgagaaaccgaaagtggatatagggaatataggagagccgtcttactgtcgagtcgaagaagcggtgtgtatttggcgtcagttacagacagtgggtttttgtgatgaattattaaatatatgtttttgcttttaaaaaaaaaaaaaaaaaaaaagggcggcgcggtgatgttttgtgtttctccgaatttgttttaagcaatcaagaattttctctcttgggatttgc

SEQ ID NO: 55634 - DNA, 721 bp, Triticum aestivum
  unsure (1)..(721): unsure at all n locations
  Clone ID: PAT_TA_55634
cacgcccgtccgggnacaaggtaaaacaaccaggcacaaggcacaacaaggggtactacaccaacttgctccgcaacagtgcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggtgtacttcccaacttctcggcagcagtcaggacaagggcagcagccaggacaaggacaacagtcgggacaagggcaacaaggtcagcaaccaggacaaggacaacaagcgtactacccaacttcttcgcaacagccaggacaattgcaacaaccagcacaagggcaacaagggtactacccaacttctccacaacagtcaggacaagggcaacaagggtactacccaacttctccgtaacagtcaggacaagggcaacaagggtactacccaacttctccgcaacagtcaggacaagggcagcagccaggacaaggacaacagtcaagacaagggcaacaagggtactacccaatttctccgcagcagtcaggacaagggcaacaaccaggactagggcaacaaggatactacccaacttctccgcagcagtcaggacatgggcaacaaccaggacatgagcagcagccaggacaatg

SEQ ID NO: 55635 - DNA, 452 bp, Triticum aestivum
  Clone ID: PAT_TA_55635
gttcatgctattattctgcatcaacaacaaaaacaacaacaacaactatcgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaattgagaagaaaataactctagtactagatatatgaaacaccgttttcttagtccatggtttggtcgttgtagcggtgaaaaaataatgtgacatgcactatcatgtaagaacccgaactatactagttcaaacttgggaataaaagacaaacacaggtcttgtctacatatttatattgc

SEQ ID NO: 55636 - DNA, 787 bp, Triticum aestivum
  unsure (1)..(787): unsure at all n locations
  Clone ID: PAT_TA_55636
tgatagtccaccgagatggctaagcggttagtcctctttgtggcggtagtcgtcgccctcgtggctctcaccgtcgctgaaggtgaggcctctgagcaactacagtgtgagcgcgagctcaaggcatgccagcaggtcatggaccagcagctccgagacattagccccgagtgccaccccgtcgtcgtcagcccggtcgcgggacaatacgagcagcaaatcgtggtgccgcccaagggcggatctttctaccccggcgagaccacgccaccgcagcaactccaacaacgtatattttgggggaatacctgcactactaaaaaggtattacccaagtgtaacttctccgcagcaggtttcatactatccaggccaagcttctccgcaacaaggtcaacagccaggacaagggcaaccagggtactacccaacttctctgcagcagctaggacaagggcaatcagggtactacccaacttctccgcagcaaccaggacaagggcagcagccaggacaattgcaacaaccagcacaagggcagcaaccagaacaagggcaacaaggtcagcagccaggacaagggcagcaatcaggacaagagcaacaaggctacgacaacccataccatgttaacacagagcagcaaacggccagcccaaaggtggcaaaggtgcagcaacccgcgacacagctgccgataatggngtcggatgggaaggggggcgaccgcattgtcggctagccagtgatagaactctctgcacttgcatggtgcttggtatgcatg

SEQ ID NO: 55637 - DNA, 209 bp, Triticum aestivum
  Clone ID: PAT_TA_55637
gtgatactgtctggggaccttggatttagaaattgtagcagagtctgcgtgtgtgtgttttgaggagcatggtggcatgtacatcggccaagtgcagccatggccaattagccaccatgtgtttgtgttcagtggtctactgagttttggttatcttagtaacctgatatgttgccgttacttttgaagtaaaattgtacattagtttt

SEQ ID NO: 55638 - DNA, 587 bp, Triticum aestivum
  Clone ID: PAT_TA_55638
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgggcctttttaggggaacccaattttcttcccccggtgtttgcaaagtttttaatttttttttttggggccccctaaatttaatttttttggcccggctttttaaaaacgtggtagccgggaaaaaccccgggcttcccccaattaaatcccttggcaaaaaatccctttttccccaggggggttattaaaaaaaagccccccccaattcccctttcaaaaaatttcccccccctaattggaaaagggacccccccttttagcggccctttaagcgcggggggtggggtgtttccccccagtgggccctttacttttgccagccccttaacccccgctcttttcgttttttcccttttttttttccccagtttcgcggtttttccccgaaaagttttaaatggggggctccttttggggtcccaattaagggtttaccgggcccttcccccaaaaa

SEQ ID NO: 55639 - DNA, 216 bp, Triticum aestivum
  Clone ID: PAT_TA_55639
tctagcgtaccaactttactctacgcctgcatccgacgttctagctgttccatgctgacacccacgtgcatgcgactggacggctcttttcaagggtcagactggtacaacccagtggccgcccatctacatcgtcttgactggcatacccctgtcgtcagctagcttaatagcctagaggcacataccgatcgcgcttgctaacagtttcgcaaa

SEQ ID NO: 55640 - DNA, 583 bp, Triticum aestivum
  Clone ID: PAT_TA_55640
tgataaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaagaaaaaaaaaataaaaaaacaaaagcatgaaaaagaaaaaaaaaaaaatttaaaaaaaacctggggggcggttttttggggggccctttttccccgcccgggcctgtggaaacccctgggttttccttttgggacccccaattttaattcattcgcctttcccctcctgccgtattggggggggggccccggccgttcccctttttttttggttgggcaacctttctgttttttggggcgggcctttttggggggggttccgccccggtggcccgtttgccgaaaacttgccgcttttttgttggatttggcccccccctttggcccggtcctttgggggggggggtggggtggtcccccgttgggcccctttccctgtgggcggtcatacgggggctcctttggggtttccgcttttgttttttgcggcgccgcggccttttcccccttaattttggagagggggctccttttgg

SEQ ID NO: 55641 - DNA, 114 bp, Triticum aestivum
  Clone ID: PAT_TA_55641
aaataacaacagttggacacccgggcctgcttccgggacccctcttgtctcggcgcatctgacgtttgtgaggaaggttttccctcccggggaatccgctcctgttttggacgc

SEQ ID NO: 55642 - DNA, 550 bp, Triticum aestivum
  Clone ID: PAT_TA_55642
tattgtcaaaaaaaaaaaaaaaaaaaaaaaaaaaaaaaaaaaaaaaaaaaaaaaaaaaaaaaaaaaaaaaaaaaaaataaaaaaataaaaaaattaataaaaacaaaaaaaatgaggtggtgaaaccttgaaagtggggcgcctggcgcttctattgcctccccgctggcttgcccggttgtttggcgccgggtcacggccttttctcggcctccttttttttgccttcccggggcctggggttttccccggggggcccttgggaactcccccccccttccccattttctttgcctcgccgcgtttccccttttgcccggttggggatttgcctttgcggcgcgcccggtcgccctttcccgctggtggttcgcccttttgggccgcttgtccccccccggttcggggcctttacccccctcgtgttttgctttttcccccggtcccccccctcctcttgcaagggccctgctctcctgtttttttgcttttttgcgctgggtttctggccccctcccccggttttccccttaatgttgggtcccggggg

SEQ ID NO: 55643 - DNA, 276 bp, Triticum aestivum
  unsure (1)..(276): unsure at all n locations
  Clone ID: PAT_TA_55643
ctcacgtacgcgggggggggacgtcttagctattctatggtgtaacatagggcgagtgctctggcggttccaagctaacgtccgcgtgtgtgcaacccctgtcctttccctatttagtcccttagtagcaatttgggtttgcacgggctctttnctcgntttttgggaacccctcgggtcgcccttcttaataggtgttgcagccccccccccccttgggaggtgccgtgttggggcgcatgcccccccgcggctgtgttgcttacacacaaagaa

SEQ ID NO: 55644 - DNA, 167 bp, Triticum aestivum
  Clone ID: PAT_TA_55644
ccatttagatgacacgtgttttaggacggagggcgtctgcttaataagctaaccgtgagcttatgaggattacgtctttgcttttgtgagatattttaaactttgactaaggtgttgttttatttctcaaaaaaaatggaggaagaagaggggcttttgtccttttt

SEQ ID NO: 55645 - DNA, 611 bp, Triticum aestivum
  unsure (1)..(611): unsure at all n locations
  Clone ID: PAT_TA_55645
cggtcgcgtggngaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaacaaaaaataaaaaaaaaaaaaaatataaaataaaaaaaaaaggggggggcgttttttaggggttcccatttttacttccccgtcttggcgaggttttactttttttttggtgccccttattttaatttatcggcccttcgttttccaccgtggtgccggggaaacccttgcctttccccattttattcgctttgccacccttccccttttcgccggttggctttttagcgaaggggcccgcccggttggcctttccaaaaatttgcccatcttgattggcatttggccccccccttttcccggccctttaaccgcgggggttttggtgtttcccccctgggtgccctttccttttgcagggccctttgggccgtttcttttgggttttttccttttttttttgcccacttttgccggttttccccttaattttttaaatgggggcctccttttggggttccgttttatggttttccggcccctctcccccaaaaacttgtttggg

SEQ ID NO: 55646 - DNA, 597 bp, Triticum aestivum
  unsure (1)..(597): unsure at all n locations
  Clone ID: PAT_TA_55646
ngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgggcccttttaggggaacccaattttccttccccggtccttccgaaggtattaactttttttttggggccccctaaattaaattccccgggccggggttttaaaaccgtggggccgggaaaaccccggggttccccaaattaaatccctttgaaaaaaatccccttttccccagtggggttaaaagaaaaagggccccccccgttcccctttccaaaaatttccccaccctaattggcaatgggacccccccttttaccgcccctttaaccccgggggttggggggtttccccccaggggaccctttacttttgccagccccttagcccccgttcttttggttttttccctttcttttctccccactttcccggtttttccccgtaaagttttaaatgggggccccctttaagggttccatttaagggtttacgggcccctcgcccccaaa

SEQ ID NO: 55647 - DNA, 161 bp, Triticum aestivum
  Clone ID: PAT_TA_55647
gtctaaatgcgctgttctcgcggtgttttgacgcgctttgtctcgcactcttggccgcttcactttatgtggctcttttcgggggcttgtgcgcgggtcccctattggtgtgtttccctccgtcccttcaaatgtgtgtccgctcgtgcgacactccccct

SEQ ID NO: 55648 - DNA, 381 bp, Triticum aestivum
  Clone ID: PAT_TA_55648
cgtggagtactaacacgtagcctgcacgcgtgccaggtccccctatattgagtccggttccagctggcggtccacatggtccatatatggagcctgtgtaaaactggtattcgttaacaatatcgcataacatctgagccaaaagcatataactgtaacaatctgcggagcctaacgagcgagctaactaacatgaatagcctggggctcactgtcagctatctaactcacatacctggcgtgccacttactttaatgtatccagcaacgaaacctgagaggccagctgcgtttatgaatccagcaaggctcttctataggccagtgacacattcaacagcctgagtggcctttaccgtcagcacctagaagagcagcagc

SEQ ID NO: 55649 - DNA, 424 bp, Triticum aestivum
  unsure (1)..(424): unsure at all n locations
  Clone ID: PAT_TA_55649
agaaaaattaacgatgggggtgtggtagtgataagtcaatatttgccggtcgcctgtaactttgtcttctggcaaggcggaaggtcgtacatacatatttgggagcctctatggtgtgggtccatgaattccttggggttaacgtaagggcgtactgnccctggcaaatttttttctcccatgcgaacattcaaatcgtcgtacatttttcatccatgcttgaccactgcacatcatattactgatcaggtactcatgtccgctgggcgtgaaagcccgattttagccgtttcctcttgagcgggaattggcggatgtccaatactctgtacctatttgatcaactactgccctccagatctgatacagcttcctcgcctcttggaggtccttttcttatccccctcttctggcttaagcggga

SEQ ID NO: 55650 - DNA, 422 bp, Triticum aestivum
  Clone ID: PAT_TA_55650
tttttgcgatcgcaaccgggggtggggttttatcattaacagtgcttgtttttggccaagctccaccacccggtcgagcgccgggacgtaagacgtttttttttttatctatctacacattgggtgcttgtgggggggggcgacgatcctatcttatctcgtgtgccttaagctcttagtactactcctacttctactgctgtgttatgggagagtctagacttcaccttgacgactgggactctctttttttcctgctagcccctggccactgacttctcaactagccggcggcacccgctctgcaggtcctcggtggaggcgggggacgcctctacgtcctcctggctgtccaccttgtcccacagcccgtcgtaggcgacgatgagcacgtggtagtcggtgcccacgtcgaccgtgct

SEQ ID NO: 55651 - DNA, 551 bp, Triticum aestivum
  unsure (1)..(551): unsure at all n locations
  Clone ID: PAT_TA_55651
tatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaagaaaagggaaaaaaaaagaaaaaaaggggggggggggcggattgttgcctaggtttcctgccgccggttgggggaatagcgaataggttggggggggcccgaactcccctgtgtggggggagggtagaaaggcgaggggggggggaactgcgggggaaaaaaaaaaaaaaagggtggggnggataccccctgtgggaccggggatttgccagaggggggagcgcccgggccccccttcccagcccttcctcctgggaggggggagggggccccccccgtgaggtctaaatggggggggggggggggggggcggcccaggggtgcccggctcctgggcgggagcaaacgggccgggggtgatggtttacgtcgggggcctgcgccc

SEQ ID NO: 55652 - DNA, 435 bp, Triticum aestivum
  Clone ID: PAT_TA_55652
ccgtccgatataaaaaaaaaaaaaaaaaaaaaaaaaaaaaaaaaaaaaaaaaaaaaaaaaaaaaaaaaaaaaaaggggcggtagaggataaaggatccaagcacgacgtgcacgcagaagtgcaacgttataggctctgtggtatacgtgaaacccaaaatcacaaggccagtgggccgtacaacgtacaacactgggaaaagcggagaacggggccctttttccctcgcttttgcaccacgaacccacatccccccttccggcagctgtgagtaaaaaccccccccgcccaccccctttcccaattgctaacagatgcggaatggtgaatggggacagggcactgaccctgtaccttaacctcaaccgcggcggtggtgacgctcacccccaccgtgaccttgccattgccatagccccagcgcccgttccttt

SEQ ID NO: 55653 - DNA, 488 bp, Triticum aestivum
  unsure (1)..(488): unsure at all n locations
  Clone ID: PAT_TA_55653
cggtcgcgtggngaaaaaaaaaaaaaaaaaaaaaaaaaagggcggacgataaaaaaagaacggaggcgtccgtccacaggatccaagatgacatacccgtgctttcgacggaactaatttcaatatactggccctaaattcacaacactggccctgggaaaacaacggcgtgaccggaataaaccgggtggcaccaaatttatttttcttcaggtagattcatatttaacaggctggcacaatacggaatagcccccccccgatcacccttaataacaaatgggacgcccccttgggcaatggaacaagccctgtagcggtgcattaaacgcgcagggtgaggggtatactcgcaaggggactagctcactttccattgccttactgccctttctttttggtcacttccctcggctttttcccgacaagctctaaatttcccgctcaatctataaatccgaggcaccgtttaagggtacctttaaccg

SEQ ID NO: 55654 - DNA, 585 bp, Triticum aestivum
  unsure (1)..(585): unsure at all n locations
  Clone ID: PAT_TA_55654
tataaaaaaaaaaaaaaaaaaaaaaaaaaaaaaaaaaaaaaaaaaaaaaaaaaaaaaaaaaaaaaaaaaaaaaaaaaaaagaacgcaaagcaaagaaaaaaaaaaaaaaaaaacgaaagaggcaacgaaaaagaaataaacaaggccgggggccccacgtcgaatgggccggggcgaacccctgccgggaaccgggggggggagggcccttctcgtcgcctttccccaagccgagcgggccgggcgagggggagaggcaccgggcgggaccgccccccccccgcgggcgggcccgaacggaatggcgcatcgggacccggccccctggnccgcccattggggcccggcccggggaggggcgcacccgctgcgggtcccctgcagtggccacccccctagggccagggccttccccccccttccctccccttcccgccgggggggggggggtccccccgcgggcggccccccgggggcgcccggccgggggccccattgagggctggcctgcccccccgccccgaagacctggcggggggtgaccccctacggagctggaccagggggcggctcgacggggccccg

SEQ ID NO: 55655 - DNA, 630 bp, Triticum aestivum
  unsure (1)..(630): unsure at all n locations
  Clone ID: PAT_TA_55655
tatttaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaggaaaaaaaaaaaaaaaaaaaaagggaaaaaaaaaagaaaaaacaaaagaaaagaaaaagggggggggggggggccttttggggtcgctttggggcccccccccaaggggggcaggggggaaaattttttttttgcgccaggcggccccttgtttgtggggggggaggtttaaacccctttgccgggggggggcccgggcaagaaagaaaaaatggaacaccgcggggaggtggcccttttagggcggggggggtggtggttagggggcagnaaaaccgctcccctcccaaaggggggtaccttctgttggttaggggnccccccctcggtttcctggccaagtcgggggggggggggggggggccctcaggggggggcgccttttggggggggccttagggccctcggggccggggtctccaaaaactttgtttggggtggtggggcttttcgcgggcaatttttagggggggggggctgggggtggggctttggggg

SEQ ID NO: 55656 - DNA, 382 bp, Triticum aestivum
  Clone ID: PAT_TA_55656
gggggggggggggggttgggggtgctcgactggggaagaacatctgtggctggccgggccgcttatcgccggcgcgctgctgcataacctcatgcgctgatctgcgtcatgtacgttggtcacctccgggagctcgccctcgccgggggcctgattgggcgctccttcgccaccgtcaccggctttagcctcctgattggaatggcgagtgctctgcacaccctgagctgtcttgcatactgagccaggctttaccatcttctcggtgtctacaagcagcgtccgatggtgatcctcaccctggtcagcattccggtgggggtcgggtggttctacaccgggtttatgctgcttctggtcgggctggatgcagactttggcg

SEQ ID NO: 55657 - DNA, 303 bp, Triticum aestivum
  Clone ID: PAT_TA_55657
ggggggggtgggggttttgcatcacacaataaatgaatccatgttccaaattgcggccgttgttactcacagcggttcttcattacaggttcttgatgcatgaacaccaacacttacggtaactcatctaatgcgacaactttcttcctgtcgggggggggggggtgggaaggcgaaaccgcgccacgaatcacgcattgtggcgttactttctcgtccttgcatgcagtgacactgatcgacgagggcggatggacacgctcgcttgtgtgggtggctagccgcggtgggtgactcgtggca

SEQ ID NO: 55658 - DNA, 99 bp, Triticum aestivum
  Clone ID: PAT_TA_55658
agggaaatcaactatatttattgattggctaatttattcaacattccaaatttcgaaatatttggatgttacagacggctcgccttaagatcttattgc

SEQ ID NO: 55659 - DNA, 172 bp, Triticum aestivum
  Clone ID: PAT_TA_55659
tttttgcacgacgcacggggagaggcgggtaggcccgccggccgcggctgcgcgtgccacttggcccccgggtgtggcccctgcgaccggggagccatggccgtagttgctctgtgccggcggttaccctcctggggtggggggggggggggaactcggctcggtgcaattg

SEQ ID NO: 55660 - DNA, 272 bp, Triticum aestivum
  Clone ID: PAT_TA_55660
gtctcggggggcgggccgggacccgggaaccggggcccggagccggccggggtccccctatagcgagtggggggacagctgggagcggggggggccaaaggtcataccgggggcaagggggaaaccggtaacagttcccaacaccacacaacccagaagccgaaagcgtaaagcctaaggcccggggggcctaaggaaacacccaacaaacgggaagggcggagggcccactgcccagttggaaaaccggaaacccggggggccaaaaggaa

SEQ ID NO: 55661 - DNA, 373 bp, Triticum aestivum
  Clone ID: PAT_TA_55661
ttttgaaacaagatacagcggttcatgacattttctgaaacaagcagagctaaatagacgaaacattcagctgacacttccatgttacagtacaaatttacaccctgaaaagttgatacccatttgcgatcaacaaaagagatgggcattctgattctctctcttgtcacagaacaatacatgcgtttaagctgtttctctaccaggtgaccaggtgtccaccagcacatgccatcacgttgcataacgcacattccacaatggccgttgtcaacggaacagccaggtgtgggtcaggtaagcatagtggctactggaacctctagctgacatctcatggagccacagcttctgccttcctacatctgtatct

SEQ ID NO: 55662 - DNA, 101 bp, Triticum aestivum
  unsure (1)..(101): unsure at all n locations
  Clone ID: PAT_TA_55662
agggctcagnattggntgaagcccgacaggtaccttctgccataactacattcccatccactgctcaaatcgtgcccggagcccctgggtgtcgttctcgt

SEQ ID NO: 55663 - DNA, 662 bp, Triticum aestivum
  unsure (1)..(662): unsure at all n locations
  Clone ID: PAT_TA_55663
ctcgggctctgctctccagtctctccgcccaaccctgttccgctcacttgttttgtttgactcgtcgcggccttctcggagcggcaaaagaaaagcacccgccgccgctgccgcttccgtcttcccccgtctccttggctcggaggaggagcaaagctggttggagacggcgagtgcgcgtcggaggaggaggaggattctcccgcaagcgtccaaggcgataaatcctgccgtgtgccccgcggtgctgtttgccgggcgggaatcgtccgtccgtcttcctccggtgacttggagtgcgggtgctcccatgggcgccgcggcgcattgaggcgcgggtggtttttgtggaggcgagcgaggcatggatctggagctcgcgcacggcgcgggggcgccgcggaagcggggggagtcgtgggccgcggtgctgctgctggcgtaccagagcctcggggtggcgtacggcgacgtggccacgtcgccgctctacgtcttcaagagcgccttcgccggcgacgacatcacgcacacggcgggcaacgaggagatctacggcgtcctctccttcgtcttctggacgctcaccctcatctccctnctcaagtacgtctgcatcgtgctccgcgccaacgacggcggcgagggcggnaccttcgcgc

SEQ ID NO: 55664 - DNA, 606 bp, Triticum aestivum
  unsure (1)..(606): unsure at all n locations
  Clone ID: PAT_TA_55664
aacgcaagccgagccgaccaacggcgaccacctcacccacgcctgccgcctcgccgcccccccctgaaatcccgcccctgcccctgccgccgggcgcccggcccgagggcacccctgtaatttcgcgccgccaccgcaccccgtccggtctccggaccgaccccggctggctggctgtcggtcgccgcgtcattgtccactcaacctctccccgtccgtccggaacacggaagtaatcgccggttacccggtcaaacccaccacacggcacggcggcacgcgcgactccgatccggcccggccatgccctgcctatcccacctcgccgcctgtcacgtgccgcgcgcgtggccccctcggccggcgccccacccccgcccccggcgtgcccttttattccaacgcccaccgcccgttcccaattcaccccaccgtccgtccgtccgcccgtccgtcacgcgcaacccgcgactttcttgttcccctagggttagggttcgtcgccagatctgagcgatggagctgagggagatggccgcggcggcggcggcngcngctgcntcngcnggaggaggaggagggggaggcnngagcngagtgggggag

SEQ ID NO: 55665 - DNA, 494 bp, Triticum aestivum
  unsure (1)..(494): unsure at all n locations
  Clone ID: PAT_TA_55665
cgctggcggaggtggtcggcgcggtacgggaggcgaaggaggcggttcccgctcggttcgcgggctggatgcgcggcgtcgagcagtacgacgtgccgccgctggactacagcacagtgacgttgtcggactggagtcgtctcggcttcgacgaggtggactacggcttcggtgcgcccgggtacgtgttcccgctcaacgaccacgtcaatttcgtcgcggcgctcaactacgtcaggccgccggcgcccaggcgtgggggcatccgggtggtgctccactgcgtcgaggagcctcatgccgccgcgttcgccgtcgagctcgccaagttcgcctagatgcaacgcattgatggttcccatttcctggacatgtccgtccactaatgtgagactacgcagtttagggaacacattttcacattttttctctcgggagccaacacgttgtatctccactgtatggtcgtataataagagtaatacttantcttt

SEQ ID NO: 55666 - DNA, 174 bp, Triticum aestivum
  Clone ID: PAT_TA_55666
tttttgctccgcccggggcgcgggggggggggggggcttatatctaggggtcgcctctgccttcgcgtttgcggcctggtgctgtgctcggctggccctgctgcttggggcgttcctgggtgggtcggcctggctgtgttggtcttctccctcacttcaaaagggggggggggg

SEQ ID NO: 55667 - DNA, 647 bp, Triticum aestivum
  Clone ID: PAT_TA_55667
ctcaaactgcctcatccatccccaccgaagcgatcgccgagtgtttgatgagtgcctgagagagcggcgtcaatgggttcatcgccgcaagcataaagctacccgcctcgcggtgttcgttccccggcgcttcgacgctgaaagaatgcctgtccgggagcttcatcttgtttggacttttgaacggctagtttgaagaattcatcgcactgagatggaaagaatcaggaccgggatgatatttttgcgtcactgaagattgatccatcgactcatcttgacactaatggacggggaacactcggctttgaagaaaatgagattggaggacgcagaggattctgcgatcagtcaagtgcctgccacggcgtcgagcatgcatcagcaattgttctggagccagtggcagctactggactccattctccccacgggtggtttcgcacactcctacggcctggaagctgctatgcaatcgcgcatagtgaacaaccaggaagacctgaggctgttcctcatccaggtggtggacaacattggaagcctgctgcttccattcgtgttctgcgccagtaggtctcctgacgctgcggcatgggtcaagctagatcagctgctggacgctacgttgacgaatgaggtcggca

SEQ ID NO: 55668 - DNA, 656 bp, Triticum aestivum
  unsure (1)..(656): unsure at all n locations
  Clone ID: PAT_TA_55668
gtctgatctgcatttgtagttgtactcgatctcctcccccacgccggccgtagtactctactctccgtcggtcggtcacgggacgcggctaggcggctagctcgccagccatggctgtccaggaggaggcgctgcacatcctcttctttccgttcctggcgtccggccacctcatcccgaccgccgacatggcctttctcttcgccggccgcggcgtcaggtgcaccatcctcaccacgcccgtcaacgccgccatcatccgctccgccgtcgaccgcgccaacgacgccttcaccggcaccggctgtccggccatcgacatcgccgtcgtccccttccccgacgtcgggctcccgccgggcgtggagaacggcacggcgctcacgtcccaggacgaccgcgacaagttgttccacgccgcgcagctgctccgggagcccttcgaccggttcctggccgaccaccgcaccgacgcggtcgtgtccgacagcttcttccactggtccgtggacgccgccgcggagcgcggcgtcccgcgcatcgcgttcctcggcagcagcatgttcgcgcgcgcctgcagcgacagcatgctgcggcacaacccgctggagaacgcccccgacgaccccgacgccctcgttntgctgccggggctg

SEQ ID NO: 55669 - DNA, 594 bp, Triticum aestivum
  unsure (1)..(594): unsure at all n locations
  Clone ID: PAT_TA_55669
actggggtagcagtctcatttccagactaattcagcagagactagtagtaccataacagtcttacatagctactagggtggttgccttggatgaaagagctcgagttacatcacaacacagctcgccaaaggatcgatcagctcctaatctagggggtgcaacgcccggtcgtccataattacttaggggggatacatcatgttcacaaaaacatcggccttaacacaggcgacgaacaaagccggagcaccagtacaccgagggcgtcggtcgtcgttgccaggccggtgactggggcgggcgcggggctcagctggtgagcgctgagagcatgccgccgccggcagccaccacgacctcccagccaggccctttgagggggaagtgcggggcggcatcagcggctgcacgcgcgccggtgaggtcgctccggtccatcaccttcaggaggtcctcgtcgctgatgtccgtctggatcatcctgtcttcctcggcctgctcgtccctcagaagcgccagcagctccccctcatctaaggcgttaggcttcgcggcatcttgctggaactgtnccttnccgatcactacgtgct

SEQ ID NO: 55670 - DNA, 620 bp, Triticum aestivum
  unsure (1)..(620): unsure at all n locations
  Clone ID: PAT_TA_55670
ttttgatttgntgaaacgggaaaaccatcactatanaaaaaagaatttgcaacaaacagtactgtagctaatttattgcgacatacacaagtatagtaacaaacaaacatacatcactctgctactactgatctctacgaggagtgtaacatcttcagttcaggatggtttgcatgcttgtcaagttgcctgcgcaagtcttgcgcgaagctgctgctgtactctcccgttacacagacttccttgagtccatgtaggtaccttagcccgtcaatccacaagcacgacgatccaccacaagatctgcagcagttaatgttgagcgtctcaaccgagaaaaaagttgcccgtccaaaagttacccttgagcggatgccgtggcagtcaaacctgaggtgctcgacaggtctccactcagaaccatcaggtgtaggcacatgaccaaatgtgagaagctcctctaccggctggacatgagggcggtcagagcttcgtaacatatcccggctaaataacatgcctatgtcctctccagttgataccctccactcatgttggaaacatacgggatcgggaagcctggtccatgtttgccttatgcatgcaacactgttacgact

SEQ ID NO: 55671 - DNA, 603 bp, Triticum aestivum
  unsure (1)..(603): unsure at all n locations
  Clone ID: PAT_TA_55671
ttttaggtgaaacacttngaatataatgtagaaaaaaggttcccatcatatattattcaagccgcattgttcggtgtacacataaattaaaggttcgtcatacagacttcgacacagaaatatatagaatacccaaaagatgagtattatagacgcagctctgcttgtcattagttgctgtggttggtgcctagccaagcttcttcaagataaccaggacatggacatcatccctctcgctgctcttgaagccaataagaacagctgtgttgactttgagtcctctgctagctgcgaagtcttcccacttcttcctgccaaacacaatgcggccatcatcagcagttttgtatgagatttttttgaatctccgaccatccacagaaataccaacaaccccttgttcttcaaacggcgtggcagcagcaactttcttgggtattttcatcatgcccaagcgaatgtcagtccttgtgaggcggtgaacaaaagcaaacccgatgaaaccatcactgagaggcagcagcccctgtagctgagcatcctctgtctcattaagcaaaagccccctagtgcaaacaatgccttcactatcatcgcttg

SEQ ID NO: 55672 - DNA, 197 bp, Triticum aestivum
  Clone ID: PAT_TA_55672
ttttgatgtgttgtagaaactccttcgaacctgaggggttcaaaccacaaaatttggtctccataaacatgacatgtgaatttaggaaaagtgtactggcagaaagatcaacagattatccgcttgcacgcatcatgcaaaacaacagcgatttaggcagaaaatgaacactcgtgcagcagactacttctggtcca

SEQ ID NO: 55673 - DNA, 581 bp, Triticum aestivum
  Clone ID: PAT_TA_55673
gggtgtgggttttatactggttcggccccttgcggtgaaggtaaaggcctaatccaatttgaggtggtattgcttatgtctcgattaccagggagcgaatacgcttgacctagctttcgatctcttctttcttctccctaaaccgccggggggggggcctttatatacacagattgacgcccagcggcccacagagtcccggccggctcatacacaacgtgtccggctcggtgactaattacacatgccttacaatacaggttacacatatatgacggtttacacttgtgggccttaagtcgcctttgggcttccggacctccagtaagcctgcttcgtgaaccgccatcttcaacatcttcatgggctttgttaatgatgaaccgccataggtataacccgacccttcctgggcgggtcataccaaatagttatatacccaacaaccttcgtccagaagggtggctgcggcgggttcggcaaaggcaacttctccgagctgttcaagtccattgaagattacgagaagtcccttgaagccaagcaatctgctgcagttcaaggatcataggatagaagct

SEQ ID NO: 55674 - DNA, 588 bp, Triticum aestivum
  Clone ID: PAT_TA_55674
cacactggaggaatgtttaaccatcagtcttgaaacaaaggattatatccttcaaactgtagctaatatggtacacatcttgctagcaggagcaagatcaaattttgagctaacatagaactatgctgtaaaattaatgatgcaatacaaaaaacaagtgtcagcttggtatctttatgcatcttgctagcaagttcaggatcaaactataactcttgacagagattttggaggaatgatgctttgttaggagcaacaaccaaatcagtactaaaggattttataagcttatttctgtatgctcgagattcgatatctgaggtgattgcttgtgcttcacgcttccctaatccaaatatatttcttagatcattcaaaggaataacctgcaacaggtgtactaattttccttagaatacagatatgccctgcagtaatgaagaacaaagctgaaattagcaatcagttagtgcatctataaaaaaaattagctgactaccttaatggtatgaggttcagaatactggtcctggtctgtttatacaagaagtggaaagaatagaataattagtaaaaatattagctctg

SEQ ID NO: 55675 - DNA, 566 bp, Triticum aestivum
  Clone ID: PAT_TA_55675
gcgaaaagaagttttcttactcattttacacttttcttataaaatagcgacgcacaattaaattccatgccgtcatggctgtcgtaatagcaaagatcgccagcggatctagcggccattaatcagcaaaaggaaagttcgaagctgcccaaattaacacaccgtcgtaccagcccatcagctggcctggttgtcttctccaaccttgacggagctccggcgggccgtcagcacgtccatcagccggccaacatcgtcgtacgaagacccgcccttctccaccgcgcgccttgccttctcaccgaggtccttggccttcttctggatggcgtcgctctccatcaatctctggatggactcggcgatcacctcgccagcgatcacctcgtgggcctccatgcctgacgcgtagtccttggcgccgatgctgacgcccaccttgagcagctccaccacgagcttctcgttgtggaactggtccgcgtaccgcggccacgtcaccatcggcaccccggcgctcacggcctccagcaccgagttccagccgcagtgcgtcacgaacccgc

SEQ ID NO: 55676 - DNA, 619 bp, Triticum aestivum
  Clone ID: PAT_TA_55676
ttttagggctagaattgtttaaattggctaacttttttttcggatacggatatatccaattccatatccaaatttttcaaaatcccatacaacatttgtatttgtaaaaagaatccagatatttccaatacccattttcattttagttcggatgccaatgtcgacttgcaatatatggttttcttgaatatgactatcggatatttcaaattttccaccgccactttccacccttctatgccggtaaacctttctcacaccgatgcgccactcctgcatagtttaagggttctttttcctccagcgatagtgtacacgtccataccgtattcgctccatacctccttcgggtatctgtatttgtttctgctcccactgctggtcatcatcattttcggcatgtgttactccaagcaacctcgaaccttcagcattatcagggttctttaaaacttcagcctccagaggaagagcagcttcacttaagaggcccttccgaaagagttcctgctcttcctgcattggattagggtgaccaacatatgggttcatctcagaagaacataaaccccttgagaagagccagaacttttggaagctgacagttggttctgaaact

SEQ ID NO: 55677 - DNA, 641 bp, Triticum aestivum
  Clone ID: PAT_TA_55677
gaaactttaaaaacaatcagctctttatgaattaactaaagacttgatggttgcgttattattatagtatatacatttttgggcctgaattacaaatctgattcaaatatccttgttttgtgttattattatggtatatgttatcgagctttgttaatgttttcttcctttccttcctgaacttctgatactctctgcagtgatgaaatgtttttgcatgtcagttaagtactagggcaaccacagatgatgttccttcctttcattgagttgccctactgttatgtcgtccaactttttgttaatatacacactcgacaacttactgttataacgtccaactttttgttaatatacacacttgattctggaacccatgaactctatctctccgaggacatgtttcacatctactcctgtttgtagaaaaacattagagtctattatgtgctatataggcaaaaagtacataattggttctcttctatgtgctttccttaatgaatacacttggttcacaaaagccttagcataatttgttgaacaagttttgcctaattttatttcttgcatctcgtctggtaagttttatttcttggtacttgtaaattgttcagattacttagcttcgttcaactgct

SEQ ID NO: 55678 - DNA, 439 bp, Triticum aestivum
  unsure (1)..(439): unsure at all n locations
  Clone ID: PAT_TA_55678
ggtgttcgtgtttgggctgccgcgggaagccatggaggatgacgtcgcggcggcgctcaccgaggccggcgaggtcgaggaggtgcggctcgtccgggatccggtggagctgcagcttaacaagggctttgcctttgtacgcttcgccgaggtttggcaggcgcggtgggctgccaacgacctccgcacggccatgatcaagggaaaagcttgtggaatatgcaagaacaatgataatgagacccttcatcttcggaacatttgcttcgattggtcaaaagatgatttagcagagaagctgaaaacctttgagttggaaaaccttgaagatatcaatttaattgagcacccggatagaaagggaagaaatagaggctatgcgtttcttgacttcagctcacatgtggatgctgnntgctggattcttaaactacagaaa

SEQ ID NO: 55679 - DNA, 615 bp, Triticum aestivum
  unsure (1)..(615): unsure at all n locations
  Clone ID: PAT_TA_55679
aagcaccgtgctccagccagtgtcagtgtgtcactcgccaccccttcgcggtcacttggagctctgtacagtcgctccatcgttttcgatcgacgttgggttcatcgtcgaccctcatggcgccgggcggtctcttgggcacggcggcggtggccgtgatggtgtcgctggcggtccacgtcgcgctccactgccccatccagccgctcccgtcgccgccgtcgcccgcgcggcaccctcccaataacctcctccaggggctggagaagctcggggaagggcggctgagcgggccggaggacgtgtacatcgacgcggcggcgggcgggacgctgtacacggcgacgagggacgggtggctggagaggatgcagcccaacgggtcgtgggagcactggcggttcgtcggcggcactgacctgctcgggatcgcgccctccgccgacggcagcttgctcgtctgcgacgctcacaagggattactgaaagtcgaggagggtcgcgtgacaattcttgcatctacggtcgaaggctccacgatcaggtttgccgacgcggtgatcggagcgtncgacggcacggtctacttcagcgacgggagcaccaggttcggct

SEQ ID NO: 55680 - DNA, 549 bp, Triticum aestivum
  Clone ID: PAT_TA_55680
agcttagtgcatacctttcatgttatgttcttcaccgaaagcacagtaatttcattttaacacgcgatatatatatacatccaattacagttgctagcaatcaaacggaacttccattgagggtttccaaactactgatctcctccttcatgatgcctgggcatgatatcaaccttaatctcaagaaggctctcaacaggctgcctgcacatggggcatttgttggtctggaaccttaatgtctgagcacactccctgcataggcacatatgcctgcatggaaggacagttgtatctcttggttctgtaagacaaaccacacattctttcccagaatcatcctcatttacattcctgtcagctgtgttcctgtccccaataccgtatatctcctgcaagacatatctagttccatttacccacagtatctgctgcacaatgttgatcccatattcagcactgtctttcttaacaaacacagcaaatttaaccaaagacttcgagtcttcggcatcatgtttcttttctaactcttgcttgcttggcaca

SEQ ID NO: 55681 - DNA, 379 bp, Triticum aestivum
  Clone ID: PAT_TA_55681
gccgatcgcgtggcgatcgagacctcggtgaccgcgtaagacgccgctggctcccggtgcaccttcagtctgataccccaagcgcaacccgattcgacccgagcctgccggacaggtgatcttcacgtggaatgctcttcagcatttgccgggcaaacagtatccatcacgaggagaggagggggagttcatttagtcattaattaatgcagcatgcacaccatgccgggccggtcctaatatatgcacacccctcgatcagatctttgcttgtaaattactactgctaggtggaatgaataataaaaaagaacggggttacttgtaagcgagttattcgtatttagccgaagcaataaatcaaggacttggccagatg

SEQ ID NO: 55682 - DNA, 617 bp, Triticum aestivum
  Clone ID: PAT_TA_55682
gcgcccctcgcccctccctccctcttcggccgccacctcctcctccacctcctcctcctgcgccctaggagccccgccgccgactgctactcctccaccgcgtcttctcttcctcctcctcgctttcccatcgctcgggcgcaggctgccgtgaccaagcgcttcgcgggcgaacccgtctccaccgccagctctggtttcacgcgggacgggctcccctgcctggccggcctcgacgagcatggcctcgatccggcctcagcctgaggacctcgagccgaggagtgcggcctcgatcgggactcggcatctggggcgacggcaaaggaggaggggaaaggaggggagcagcaacaaacatctggtgcggcggtggctggactccatgagctggctgccgacggcggcggtgctggattcgatctgcaggagagagagggaggcgtggcttcgaattggagagggactccaccggcatcggcctgcgcgaggattggtgaagaactccgttgccgctgcgtgccgtgcttctggatcgagcgctgcctgaccaagggataagagtataagctgctgaagcaggcgcggcgttggtgcactgctggcgaaacggtcgt

SEQ ID NO: 55683 - DNA, 466 bp, Triticum aestivum
  Clone ID: PAT_TA_55683
ataccacttgttttttttttatcaggcactgttgggtcattttactgatagttttcacctttgtttattcttttttacacggggtccctaattgcactgctcgagttaaaccaccctcaccacggggggggggggggaacccatgaaccgcggccaacccattctacatctctgcccacgcgcaaccacgagtgcaaattcatcagctcctccggcagggaccacctcctggcgccccttgcacctgctcagccgtgcaaccgaagcaacagatatcgcagaggcagcgaaagacgtgcccgaacaaaccatagctaggtaaccggaccgcacagagggttccttgaacagggctcactcaggaagcctgaccggacaaccgccttgttggggctgaatatatccaaggagtacttgccgaggtactggccgaacacatactggactaccccgacgaaccgggggc

SEQ ID NO: 55684 - DNA, 525 bp, Triticum aestivum
  Clone ID: PAT_TA_55684
cgcaaaaaccatcaaactgctttatgatgccatcagtcacagccagattttattcgccttctccatgggtggcctcttcacccaacaatcttaaccacctccgactaataacgaccaaagcacgcacacaggcaggcacgggataaacaaccaccaaggtttgttctactcaacacacaaccaactgggggcaccagagatgagagccctcctaatacaggtcgccctccttgtgggtgtggatgacgcagtccgacttggggtaggccacgcatgtcagcacgtagccctcctcctgctgcgcgtcgtccaggaacgacccgtccgactggtccaccgcgccagcctcgatcttgcccgcgcaggtcgagcacgcccccgcccggcacgagtagggcagctccacccccgccgtctccgccgagtccaggatgtaggcgtcgtccggcgcctcaaactcgtgctcgtccccttccggggtcaccagcttcaccttgtacgtggccgccgcggagacgtccagct

SEQ ID NO: 55685 - DNA, 520 bp, Triticum aestivum
  Clone ID: PAT_TA_55685
catcaacaggaaggaatcttatattatctgagatacgtgacaccacaatctcatgtaattacagtaccatagcaggtctaaaattaaacaaaaggtgcaggataacatttaaacactacagatagccccaggccaaaagctaccaacaccacctatacgtactactaccgaaattcaggggcacaccaaaattctacctcgcgactagagagtagaaacagatcccatgatcatcagctgcatttacagcaacgccacccctcctttgctccccggctctgtctcagcatctacatcagctttgttagcactgtcaaccacattttcttcatcctcctcctcaatctcatcatcatcgtcgtcatcaccgcctcccatgtccagcttcgagaagtccatatcaccaaagtcaccaaatccggcgtcttcatcatcctcgtcttgccatttatcccagtcaaccttcaggaacacaggtggcctgcctttcttcttgagcagcctaggccaccacttgccc

SEQ ID NO: 55686 - DNA, 587 bp, Triticum aestivum
  Clone ID: PAT_TA_55686
ttttaagagtttaacgatgaaagtgaggagtgataagttaatatttgccgcaagctggaactttgtttctggtaagttggaaatacatacatacatatttggagcatcgaaggagtgggtccaagaataagatggaacgaacagaacgcgcgaactggcccttggaaattattcgtaaccaatgcgaacattcaaattggagtacaatattaaaccattcttcaccagagaacatcaaatcacgattcaggtaatcatgtgagcgttgtggtagagcccgattttagtgtttcctcttgttgggaataggctgatgtccaatagtctgaccaagttgatcaactactgatctccagatggaagagagctacaacgcatcatagaggcccttcttttatcacgccattcttgcagaagcaggaagaaaagccatgcaaatccaattgcttgaaatacgagtcccgcacccaagaggtcaagccaactgatggtgcggaagccgagagctctgggaaaatcggcgaggctgagagtgcagttgcgggcgaagacgaccgccttcttgccatacgggcactccctctgcg

SEQ ID NO: 55687 - DNA, 542 bp, Triticum aestivum
  Clone ID: PAT_TA_55687
agcatctgcagtggacagcagaatccattttattcagaatcaacaaacttcatggagcaaaagctaggctgaagataagcacacaaatttacaggacacatgcacggattacacaacctgggaatcatccacaggctaattgtcaattattattacaaacaacactgcatggttcaataagttgcgaccaactggatatataggactcgacaaactaaaaccagatgcggatattttcgacgatgagatcaggcatgggtactcgctggcttgacaacggtgacagggcaggcggcgttgttcacgacgtaatcgctgacgctgcccaagagcaccctcttgagcttgccaaggcccctgctcccaatgaccagggagctgatgggcatgtcatggatggcttggcatagcttctcacggggatctccgaacaggactttggaaaccacggcaacctccttctgcttaagctatggtgttgagcatgtccagtgtttcagcatcaggcttcaccccatatttctttgcgattgaagggtgag

SEQ ID NO: 55688 - DNA, 571 bp, Triticum aestivum
  Clone ID: PAT_TA_55688
agtgccgcttatctttattattccactggaaatggatgattacaccataacagacaacactaacagtacgagtacatgtctaggatgaaactgccgcctgcacccgtggcaccttcgccagagacagcttgcccaggaagttggtggaaaggcttcccaaaaagaggtgcccatcgaactccgtcacggaagtgatgaagtggatcaccttcccttgggagtcgtcgagcacacggatgatctcaccgtcctccgacacctgagccaccatcgctcccttcgctgtcgccttgatgggttcgtgaagcgccgggatcgacgcgacgactctcttggccaaggtccagcgggtgatcaggtccatccatggtgacctcagctggagaagggcgatccaaaaggagccgtccggtgctagatggatgttgtccggagaccccggaaggttgtcgacgaaggtctccttctggccggccttgtcgcctttcagccacagcctcgtgcatctgaaccccgctgtctcgcagacgacgaggaaggactcgtcccgcgacagggcgacgccgttggc

SEQ ID NO: 55689 - DNA, 562 bp, Triticum aestivum
  Clone ID: PAT_TA_55689
ttttacaaaggcacagcactgatcttttacaagcatgatttacaaacagttacaaacaagtgatgactccttgcttggttttgctgaagccagcacatgtgtaagatgtgacagatgatgccacaaatgaataaacaaaatgagctagcatctagcatctacaacttcctgggccttgctttgccaggaattggaaggtaatggaatgcttggtcttcgaaaaactttacaaagcccaaattgttcttgatggcatcttcagcgagcctgtattcaactattgatgtaggaggcagttgtccgatacagatctcatgtacagttgataaaagcggaaacagttcctgccacccatgataagtcaatacttcatagacttctcttgcagtggataccccctgcagtttttgcccatgcaacatttctgcctctagctcatcaaaagaccttttgccgccatttcttgcaaaggcttctgccactctcctgtttctcccaccaagcatgtagttataaggtcagccacaccacagctctcaaaaaaagtgttgtctctgactga

SEQ ID NO: 55690 - DNA, 502 bp, Triticum aestivum
  Clone ID: PAT_TA_55690
gtggggggggggttttttttttagatttttttttttttttttttttttttttttttttttttttttttttttttttttttttttttaaaccggattgctcgggacaaccggggcacctacaacgctaggaaaactttcacatcccttgaagggggggggggcaacaccgggaaaaccaaaactaaattttggggcttctgggtacattttcttcaaacacaacattccacacgacgagacactcgtcgctcccaccaacaatgggaaaaaggcaccatgccacaactgtatgaaaacctcaaaccataaaaatcgtcccaaaacccgccttgctgaattgaccactgggaattaaacccactggatcctttggctgaaattctatcagtatatgaacgaaagccattcatacttcctgattagcagtatctaaaaagctctgtaaaaaggatgccctggcaaaaaaatcggtcgaaaactgacccaaaactgcaatcgtcgc

SEQ ID NO: 55691 - DNA, 556 bp, Triticum aestivum
  Clone ID: PAT_TA_55691
ttttgatatacaaaatgatatatattgcttaaattattatccagatacaagagcagcaggagagcccagttaactaataactgtaaaacaaaagaattcccatatcataacacttcttcaggcaaacaagtgggtacacaacagcaatcaagagtagaagaaactcaaaacaaactgcaatcacaatcatctcatcttcctcccttccttccttcctactctaccagcaacaccttttctttctttccttacacatgcttctctctcctctcctctctttctctctcctcttatgttacaaaggcccacggcactgttttcttctcatcagctcagctcctgaacccgaagttggtccaccgcctgcccccggcgccgtccttcttggcgccccgcgcagcaccgccggacccgaacaggttctccagcgacttctgcttccggttccgggaccgccccgcctccttcagcagctccgccagccgcttcttctcgtcctccacgtccgggttcgccgtgcccagcttctccttccgcaccttcagcacgtgctcca

SEQ ID NO: 55692 - DNA, 558 bp, Triticum aestivum
  Clone ID: PAT_TA_55692
cacttccccattccctcgccgccgccgccggcggcccgtcgagatcctcctccgcggcggcgccgccatgctccggctccgttgcagcctcctctcccagctcctctcgtcttcccccgcctctcccatctcccacctcagccgcctctcctccgccgccgcgcccgccgactccccgaaccctagcttcgcggtggcggactacctcgtcgccacctgcggcctcacccgaccccaggccctcaaggcctccgccaagctctcccacctcaaatccccttccaagcccgacgctgtcctcgccttcctcgccggcctcggcctctccggcgccgacgtcgccgccctcgtcgccaaggaccccaagttcctctgtgccagcgtggagaaaaccctgagccccatcgtcgtcgggctcaccggccttggcctgtcgcgttctgagatcgcacgcctggtctcgctcagccgcgcacagttccgctgcagatccatcgtctcaaatctgcaatactgcctgcacctctttggctcctttgagaagatctcgctgctctc

SEQ ID NO: 55693 - DNA, 451 bp, Triticum aestivum
  Clone ID: PAT_TA_55693
acatactaaaaagaaaaggtaagatctaacaaaactgggcgctgatatcgatcacgggggcgatctgaaccatgagaccacgccacaaggctggcacaccgtgtacctatactaggcggacaggtaaagtcccatgactacctgtgccgccaaggccatgggctgcagcggcacgacactggacacatggccagtgacaactaactaacggcccatgaaagaaagcgccaccaaaaccaaaacacgcgcgtatcatcacgtatccaggtatcaagacggtgtgcactaggagcaataagcctcatttgaagagccgcaaacagagggtggactgtcgtcatacaggccatccagtatatggcgagggacatgatggagcacatgatacgggctcaaaagcttcggttgcctatgagaaagtggacctaaccagtgaattggcaacaacacg

SEQ ID NO: 55694 - DNA, 600 bp, Triticum aestivum
  Clone ID: PAT_TA_55694
gcggtcattcatcgctagacaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgacaagagggcatcaacc

SEQ ID NO: 55695 - DNA, 495 bp, Triticum aestivum
  Clone ID: PAT_TA_55695
gactagacctagtaccctcgcgccccagcagccccgtcgctcaagcccccagacgccgcagagccgccactccacccgcagcggcaaccatggcgggcggcaggaacaagcgcatctccaaggggaggaagggtagcaggcagaaggccggagctccggtcaccaagaaccagtggtatgacagcaacgcgccgatgctgaccaccaggcgacacgccggcaagaccgtcgggtccaggcacacagggcgccaggaccgcctcatggggcgtgaagcacagggggcaggtaatatctctagctggccttgagaacgaccaggaccaggcctacaggaagatcagactgcgcgctgaggatgtgcaagggatgaatgggctcaccaacttctggggcatggacttcaccactgacaagctgaggtcccttgtgaggaagtggcagacactcatagaggctcatgtggatgtgaagacaactgacaagtacatgctt

SEQ ID NO: 55696 - DNA, 528 bp, Triticum aestivum
  Clone ID: PAT_TA_55696
gtagcaacttgtaactatagtaattatctgtattatcgatcggatcgaggtcaggtaggcttgcgcgctgttgcgggaggcccgattcggggccgtgggcgcctgcgcgccctgcaactgcagcctcgagccaccctgcgccgctggtgtggcctaccacgctcgacgattcctgtgtgcaccaaggcatataccggtaacttatgataaaacatgtgatcgcgtttaaattctgagctttcaattgctatgccaggcccaggcttctggttcggaagctcggtagcatgacgtgcacaaggcggccgggcactgttctgataaggcgctcaaagtcatcttgtgcctgcagttcctggaggtcaccagctttctacggggtctacctgaacttgatagtctatcttcaggatgttctccatggagacagcgcatccaatgtgacggacgtcaattcttgagctggggtcagctacctcatgcccctgctcttggtcgccgtagccgactcctactggctgaaaacac

SEQ ID NO: 55697 - DNA, 634 bp, Triticum aestivum
  unsure (1)..(634): unsure at all n locations
  Clone ID: PAT_TA_55697
cgccgctgcggctgcnggggcgggggggggggggtcgtcgtctgcggcggcgtggatcatgctgcggcggatcgacgactcgcgcctcctctctggcgtcttcttcacctatcacgacggcaagctagccgccagcaggatcacctactgatccatccacacagccgcagcgagccgggggctaagctagtagagcagcagtagtcaagccatgtcgagcccgcggcggccggagatgccaccggcggcgaggaacaacgacaatggatacgtcgagaccgaccccactggtcgctacggccggttcgacgagctcctgggcaagggggcgatgaagtcggtgtacagggggttcgacgaggtgcgcggcgtggaggtggcgtggaaccaggccaacctcgccgacgtcctccgcacccccgacgcgctgcagcgcatgtactccgaggtccacctcctcagcacgctccgccacgacgccatcatcgccttccacgcctcgtgggtctccgtctcctccccgtccccgcgcggcggctgcgccggtggcgccccacgccgcactttcaacttcatcaccgagctcttctcctccggcaccctccgcgcgtaccgnctncggtacccgcgcgtc

SEQ ID NO: 55698 - DNA, 510 bp, Triticum aestivum
  Clone ID: PAT_TA_55698
caacatgtgtgtacccgtagcaaaggccactaaggcaagcggcaggtggaggactcaaaggctgtaagattttgcctgtcgtccatggccatgccagccaccggagctctgctgctcacctcctacttctggcttgtgcggtccagcctccgcctcctcctgacccacaccaccatgacctaggagccccgcgcgcatccggctcgtgtcccggaaccccctccggcgctccttctcgtcctccgagccggcgcccggtgtcgccggcgacgaggggggatatgtggacagggaggtagaggaggaccgcgacgagcggtacgggttcgagatggaggtgctgaagctgccggggaagaacaaccgcctgctgttgcgcgcgcgtgtgcgggtcggcatcgccgctccaagccgtctggtccacgctcaccgactacgagggcctcgccggattcatcccccgcctctacgagtgccgcctgctccaccaggacaaagtcttcgcccgcc

SEQ ID NO: 55699 - DNA, 644 bp, Triticum aestivum
  Clone ID: PAT_TA_55699
ccccttgttgactttgatgggaactttgttgggatgaactcctcccgtaccaaaatggagaagactgcctacgtgcgaaggaagcaaattcttcgattcttggtgtttcacgggatggtcagtgttaaggaaggggttgatgatgctacacaagcaagaatcaacagtgagatgaaagcaattaggccaagtttggacgctacctccatagcgagattgagtgaatccagaaaaggtgccttgagtgagcaggtgataccaagttacgcgaatgcactggcatatgcattgaaagctcatgtcctggtgttacaagtttcctcacatcaataaatttgattccacttacttggcgtgcaagcaagatcactaaaaatttgaagattaaagtacgccttctgaatgatgagactgtcactgggtggatagcggatcctgagatatatgttgattttttcattgtcaacgtcgctggtgttaatgccacacatgtcagtcttgaccgggacatgcagtttgagccttataggaaggtagcagctgtatgtcgcaatttcaattcaggactattaatggacaccaagcggagtagatcttgcctctccaagtgctctacctgatcagacaatgttcagcacatgcca

SEQ ID NO: 55700 - DNA, 509 bp, Triticum aestivum
  unsure (1)..(509): unsure at all n locations
  Clone ID: PAT_TA_55700
gacgcaagataacaatctgaggggcgttcaaagacaaatagaagaaatcgagaagatgatccatgtaggatacggactgccacttgaacccaagctccaacaacaccgagaaccatttcgtgcctgacagtatgacattatgaataggctaggagctgctgcaggaagaggtaatgaacctacaacatgaaaagctgacgaagggtggagacccagatgctaagaaggctcccagcatagaggatcactgctacgaaaacaaatgacgccgctgactgaggcagatacaaaagcaggataagccagtgacgaaatatgtaaagaatatgaagaggtctacaatcgataacanctaaggtaccaagcttgagctgtctctatgatacaaacaatctcttgaagaactatggcctaacaaaatgctagtctatggttgatgaggatgacccaacattgtagaaagcaaatgggactgaaattgagtggtatcctgtgaaaaagtgacacag

SEQ ID NO: 55701 - DNA, 600 bp, Triticum aestivum
  Clone ID: PAT_TA_55701
aaaatccccaatccctccgcccacccacccaccactgctcccccggattaccccgtcctcccatcccagatctgccgggcacggccctcgccggcggcgttgggtccgcgatgcctcggacggcgcgggggacctcgcccctgctccgcgacgactgcgaccacggcttcccctccgccatctgctgctcccaccgcctcaagccctggtcttggcaccccaatatccactcctcctagcgcgccctcgtcctgcaaacccccttcttcctcccctctctccccttccccttccttgcccctctcgtggctgtacttttctttgttcttgtcactgccctgcctctgcctgtgggattggatcgccgccgctcgggccggggtgtttagcttgttgttactgctctagaaaccgagctgcttgatggatggtcaatcctgtgatcttgggagtgtgccagcagcggcatctgatggtactggctcctcttccgttgtcgctggcggcggcacggacatttctccagggaaacagtctgccctggatggagcttcgctgcaggggcagaatgcagatggttcgttggaggctggaatgtgt

SEQ ID NO: 55702 - DNA, 553 bp, Triticum aestivum
  Clone ID: PAT_TA_55702
cttactctttagtcagttctatgtaccagttttgtagctttattcactgaactgagagatgatgtttgcgctcagttagatgatgcttgctcgattttgagcatgctggttgcagtaatcaatctatttgatatggggcctataagctatccttggttgatgtttggttacaaatcctggagctatttttgatgtattgagagacatttgttagaaaaaatattccccattatcaccttatttggctataattcatctttgccattagttctgttagtaaaatggactgagaatgtttgtgtattttttatgccttggcatcttgcagctacagccgcgcgctgtgtgtggcgagggattacttctcctgtgcagtaataccctttttggagtgtcccatgtttgcaactatccttatctgcagagaaaaacaaagggacaaacaaagcaagctgaaatgtcttatccacttggctatggttttttgtactgatgtgatttggcttgactgaattaactattttctgtatgcccacttttgtgtctcatgtgt

SEQ ID NO: 55703 - DNA, 625 bp, Triticum aestivum
  unsure (1)..(625): unsure at all n locations
  Clone ID: PAT_TA_55703
ccctgcaatccctccctgccggtagagggtggggtctgttgaggacaggcagcagcngaaagaagaggatggggcacctcacaccacccccgccggtaaagatcagatccgttgagccaaagggcggcgccaccttccacggttcccgatccttattggaacaccgaccatgttatgggctggaggcatttccgtttgcctacaccaatctacgtcagagtggatcgttcaggagtctatcactcatatccagagctgccaggtcggccgttccagagctttgatgcaattgcaagtgctctccatacctatgctcgtggcagtagcactgacacgtaatgtgctgagctctctctttctttttctctctcaaaagaataataatctcttgccttctctgaagaacgtaacatctactaatcgtatgctctgtctgatctaaaattaggtccaaggaaacaaataaggagcgtcttatacgtgaatctcttgagtggtcagatggtacgaggaaggtcgccacaagttcgaaaatagctgagagggaaattaagaatgtgcacagactggttaaagctttactggacaagaagcacgacgatgaggatttcgagtatgaactcaa

SEQ ID NO: 55704 - DNA, 414 bp, Triticum aestivum
  Clone ID: PAT_TA_55704
cgccgattacaccacaccctctcattcgcggcagctagcaattgcaattaagcactcctgaggatagccgcttgcttcttccatggcgttgttccggggccttatacgcacactagaggctgtgatacagaagtgggaacaagatgccaacacgcttggtgaactgagatggcaggagatgcaaagcgcttatgatctcagtcttaggagccaggtgcctgaactgattcaggatcaccggcacgcgcttgagagaaactaatgccatagcttggaaaggcacaacgagataacatgactgaagaccagttcctgctcgctattagaggcatgactggactgctgctgcaaacatgtctacttgagctagtagaaggtcgttcggctagaggtctgtatattcgagtgtgacac

SEQ ID NO: 55705 - DNA, 594 bp, Triticum aestivum
  Clone ID: PAT_TA_55705
ttttaacgaacatactatagattatcaatagcagacagctacaattcagttaggccaagaacaccaaatcaggaatgaatagcataacacgggaatgtaaaaaatatcgttgtgccgtactgttaccaattttcatgtaaatttgaatctagtcggcacttcccctctgcaagcggcatcatagtcttcagcaagggatggtgcaacttccttgtgaggggatatgtacttgtccacgaatactttctccatcacaatgactgcagaatagtagctccggttgtgatccagcagtccattttccttgagaaactttacaacatagtagcggggtatgatccggccctccaggctgtatgtgagcaatgccggatgatgagcaatgtatgctggttcaaaccccaccttggagattaggaactctgacttgctctccagcatatggttagacctcatcagcacagatggaagcgtggacaaagcaatgcgcacctcggcatctgaccacctgaacatcttcttcaactgctccactttggcggcgatcttctcattgctgaggaatgcaacagccttcagcgcgtgcctgaacat

SEQ ID NO: 55706 - DNA, 475 bp, Triticum aestivum
  Clone ID: PAT_TA_55706
tttttgtttgaacgcatccccgatgcactgatcacttccgaatggtgacaaatagtgttcactgcactggtacgaactagctgacaagacagtggctggggccaattgacaagctcggaaagcgacgctcttacagcgcgaaccaacgtgcacatattgtttttcaagggttctggggttaaatgacgcctccacaccacgccttgttcaaagcgccgcaactgaagccttttggaccaagtctactcctgcacgggtgcgggtacatgctcaaatgctcggtttctttggctgcgtggggcctttctttaaagcgtccgatcagcctgtgccactgtacattgatgtcttgtcctgacgggtcagactctcttgtttgcccaccatactgttctgaaacttttactctcttgcactcacagaaactaactttagccactcgggagttgtgccttcccttatcgccaccgacagg

SEQ ID NO: 55707 - DNA, 475 bp, Triticum aestivum
  Clone ID: PAT_TA_55707
ttttggaataaacataaacgttaatttgaaacacataacccctctgcatagagccgcacgaacaaaacaaggtagctgagcgctggttgggaatgtcatcgcaaggcctcctgaaaccagcccttaaaactgactgcaaagttacacgactccaagcggcacatatattatggtctgagaacgaagggccttgcgagcgactgatatcctgtactgggcaccggcaaacctcttcgggcccggaatgaccttgaacccgtcggcagggccgtcgagcgtcacaccaacatacttcttgttgtcaccgcgagcctacatgagctcactcaggccaaactggggggcactcaggatcttcaccttgacgacgttcacgtgacggagggggaagacgcttgatgcatgcacaatacatctgctttgcgatcacctaaaggaagaacttgcacacaagctgcttgaaaccagatctagc

SEQ ID NO: 55708 - DNA, 603 bp, Triticum aestivum
  Clone ID: PAT_TA_55708
ttttaagatgcaccaaccaaaataacatagccagtagcttggtatcagtacacaacatcaaccaaaacagaacatcatcaaaccacagccaatctctggtccatattgtggttcacatgtccagtcaaagaaactcatcaaccccaggtcgaaacaactcaacatcaaaagtaccaaagccaacatcaaccacaccgtactaaactattttaccttcgaacagattcatgagatgcgcaaatctagcatcggtggcctcaactctttgcagtaacaactggtactctgcggcgcgtgcagcttcggtctcctctgatttcttcttgacatcaacaagctcctctcgcatcaactcagcgactcgcctctccttctcaagcttgtactctagttcttgtacatgagcatccaaagcagctgcagatctgttgaacttcttcttggagcttgactcaaggccaacattttgaggaatgtgctggagggacattctttagtgagaatgtcagcaacaacagcagcaacattctttggttctccaccttctggtaccccttgttccatagctttttccatgtcagctatcgccttcttaactggctc

SEQ ID NO: 55709 - DNA, 562 bp, Triticum aestivum
  Clone ID: PAT_TA_55709
ttttattattatctttttccttgcttggaatccaactatctaactctctttgacgtgtagttcttagcaagggcaacaaacacggcaaagctgagcaaagtgatggcgacaacgagcacgaagtagtaatctaggcgcccatcatccatttccggtggaaaccatcccgttctgcccccagccgaggtgacggacgccaccagcgtcaccagctgagaattgatcacattcccgagcgagatggacaggaagtataacgccgtcgacgcgcccctcatcgtctccggcgactggtcgtagaacaactgcatctgccccactgagagcgacgcgtacgagaccgccatcacggcgtactgcggcagcagccacgctatgcccatttgggccgcctcctggcccccggccatccgcagcctgcacgcctcggtgcacgcggacacggtcaccgcgcctgccgccgtcgcgtgcccgagccccatgagctggatcggcgtgaacgccacagatggcgcgacggccctgttgtagaacgtgacgtaagccgcggcgagcaccgtct

SEQ ID NO: 55710 - DNA, 526 bp, Triticum aestivum
  Clone ID: PAT_TA_55710
ttttgaatcaaaggaactgataatcaatctgctgaattatataacataccgaatttgcgtacatggagaatcatagcagagatgacgttacaacaaaaaaactggacaggtggtcgctctctatgcgttacaggcaaccagcctgccgacatgcactaacaaaaatatgtctcgagaggggaccactgttcagtgacttgggaaaaccaaatactaaactgcaagactcggctcaggttgaggacccctccatcggttatccaggcatgtcaacacaactgggggccattccacataacctgaatccagcaacatgctgatttttgcttatgtgcattacatacgctaatttgcggacacggaactataatcaaaaacggcattggaagaaagcctaaatgattcatcctagttatcactcgtacagtaacctttggaccttttctgcattattttgggatacaaataagggagagtcctgatctccttgcatatcctcccttccagtagccgaactggaacccag

SEQ ID NO: 55711 - DNA, 589 bp, Triticum aestivum
  Clone ID: PAT_TA_55711
ttttggaagccaaaaaaatagatgaaagcaaagtgcattccccatgggaaagacttcataggctcacgtgtacaatgcagacccgaaatagtgacctgaaaacaaatggtatgggaagaaagtcacaagcaaaacacacagcattgcgcccaatcaatttgatatgccctgattattagtagttggtaggaaacaaattgattgcatttagtgcaacgcatgcaaactaactaatgggtcacactttttaaggaagcaatcccgcttgaggctgtactgccgaatctgatggtctgatcctacaggcagacatctctaacaccaacaagacgtggcttaggcaacggccatctgtttccatcagtatttctgtgtgtcccgccaggcaacaaccatctgtttttgtcaccctccataatagtatcatctgcactagcccattccttatttacgttcaacaagaggcggcaaataagatccctcggcaggaacggagtttcttcctcatcataaaagttcattccaacaaaattcccatctgtgtcaataagagggcccccgatcccagccttggtgattttacaggtgg

SEQ ID NO: 55712 - DNA, 573 bp, Triticum aestivum
  Clone ID: PAT_TA_55712
gacgaggcacatagcttaagcctttcttatgtgtgcacatgagaataacaatagtgaccaatgctcaacacaagcaatagtaaatgatagggggagtcaacgatggttgtgcgagtaatcttgatcgccccgtattcaaatgctaacagaaacaaggttataatccatagaagatgctgcctgtgtcttagggaattgagttcattccatggaggggcccaggagcgggtctatggcgaaattcagacgcggacaccatattcagatatacggatcaccctttcttccaggacatgtctcctgtttttcaaatcagaggccatggaagccacctctgctcgtaattcaagagactgtcttgtaggaataattcttagttgatccatcaaacctgcagctgctgattctgctttgtaaatagatcttataacggactggatttgcttaccagtagatctcaaatcagttcggccacgctgcagatcactttcaccaatgactactttgtccagggtgtatttggaatcctttctcaagctctcaatagatgttttgtattcgatcatactttgt

SEQ ID NO: 55713 - DNA, 538 bp, Triticum aestivum
  Clone ID: PAT_TA_55713
tttttgtggcatacaggttcagatacatatcacatgctctaaggttcttctctcttatgaatataacaagcacgaatacttagggactgactgactcggaaaagagaagatcacccaccaaaatgactttactgttcaggagacgcacacttacactcatgacagacaatatgatacagggatgaccaagcacggatccaggccttcggattcttgcctaacattaagtacaccctgtgctcaactcctgctgttgcatttctccatcgcccttggtgcaaggccaataacttctgatcccttgattatccaaaggcgctcgcgtgactggactaacatcccccactgaacgttcccttacgagcatccactcgccggccttgtcctggtacgccggaacatactcggatccattgatcagatccatcagcttgctttcattcatggcgttcatccctggagctccacatcatccgatggagaatgatctgaacattttctcgagggccttggacaggtcctggtatgatcttgaaca

SEQ ID NO: 55714 - DNA, 609 bp, Triticum aestivum
  Clone ID: PAT_TA_55714
aaacaccatgtaaatggatacttagatagtatctttatacataatggtttatacttgagtcatggtagcatgatagcccaaaagactaacgatgtacaaagaaaggtacgaaggcaggtcatgcagctcatttacattgatcttatacatggcgtgtgtatagggtcacactgtttccccatatacaatggtcactcagctcatctttcatctatgtagttctcaccacgaaattcatagtgtttattatgtttccaaagcgacacaagttacataaaggaagccaggtttttcccatggacaatgtattccccatcagctaaatggacccttttccatcgatggcccggttctgtggcgttgttgctgaggcaaacattgctgtgtgaagctctgtgttcaagtttttgcctcagagctggctggattgataagcatgcatttggaacagtcacaggcaggcttcgacgctgcttgagcgatctgtggttcttatgcatagcgcatggactgcacggggttggctaagaatggcttaagggaaagcataaataacctgtacgacacatgcttaccgccaatatcttcgacaggtatgtggctagcatc

SEQ ID NO: 55715 - DNA, 426 bp, Triticum aestivum
  Clone ID: PAT_TA_55715
aggaaaaaattccttttcattaattgcctgaacaagtaggtcaggcccctaacacgtacacatttgggcttgcctggggtgcaataaggaactgacagttcactaacgcatacgggcgtgtgcctacatggcggataaatttttatgcacacacaccgggtgtgcaaggtccagacctaggcccactactgtaaataacacccgccagcaaatttattttatttctttaggaactcatccttttctgctgaacactccctcaacatacacattaagccccacacaagcgcgtccatgcatgcacctaggaagggttatttattgaacttgcctacaccgtcaccagcttggggacatgccattggggaagggcacactaacccccaccttgcccggccccccggaaaccttgcccatgtttatcga

SEQ ID NO: 55716 - DNA, 531 bp, Triticum aestivum
  Clone ID: PAT_TA_55716
ttttaaatgccagattattctgtctattaacataactggcgcggctcagaacgcgaacaaataacgtccaaatgccttggggtgcgacacaaaacccaagacatggcgtgctactaatggtatgccaggtttaacagatggtactacttggggacaggattctaccgtttgggagcccctcttgctccacttgtcggacaggaaaaagatggggaatggcggctaaacgtgcctaatttatgtcgtagaattatgaacatgaaaggcaactggtgttgtaagatgaagaaccggtgtaactgcaagccgtaaccttattgcagaggctgtccagccactgcatggtgacactttctggtctctcaagcggtaggccaagggcacggacaccagatgatctgaaatccaatagctatgctccttgagacaccggacaagacagaggtataccgtgcttcatttaagcctaagaggctgatccacatgccactgtgagcatcgacagtgggccatgggtttatcacgttgcct

SEQ ID NO: 55717 - DNA, 619 bp, Triticum aestivum
  unsure (1)..(619): unsure at all n locations
  Clone ID: PAT_TA_55717
gntaagcgcggnagagtgtctccaggagtatcctttgttgaacaagnatatggtacttggaggtttgcacattcccagtgatggcctagcgctcgcagcccgtgccacacaaatcctcatcgaaagcacacgcattgccggtgtgagctatcgagaacacacacttgtcactggcatcgaacaagcagatggccatgtcacgggtgtgacgaccaacaacggctctattccggcagatatcgttgtatcttgtgccgggttctggggcgttgagatcggcaaaatgattgacttgaaggttcctttgcttccgctgggccaccagtacgtgaagaccacagctgtacctagcctggttggaagggaggtgaataagaacatcaatgctatgaacgccgagctgcccattctgcgacaccaggaccaggacttgtactacagggaacacggagagcaatttggtattggctactatggccatcgcccaatgcccgttgatgctggatctttgggcgtcacacccaaggaggtagatgacaagaacatgccatcccgtctcgacttcacccccngagactttgagcccgcttggcaagccacaaaggagttgcttcccgcc

SEQ ID NO: 55718 - DNA, 488 bp, Triticum aestivum
  Clone ID: PAT_TA_55718
gccgcaattagcagtacttcctgagtgagtagagaaagagcgatcccctcaccgtctccacgactaattctttttcgacccagacaccacgactaactccaagcatacctcaaggaattacaaccaaggactaaccacttgaccgggctgcccgacatggacgaccgtctcatatcggctggagaactgatgaactagcccacacgcatgactgatccgtccggtgacactctccaggggtggatccagcaaagggttgtttacgtgaagtcacaacgacacgaggcatgtgctgaccgtacttactcgagggcgcctacgcgccgacgagcccacctgagaagctcatccacgaatccggcagcactggctcaacaactacgaccatccacttacatccgcacttcaagatctatgacatacactcgcgatgcgaacagctatacgctgacacccaactgctgcacgctaatttgcaagacaagctc

SEQ ID NO: 55719 - DNA, 138 bp, Triticum aestivum
  unsure (1)..(138): unsure at all n locations
  Clone ID: PAT_TA_55719
ccgggtcgacccagcgttcgtgnanaacctgtgtaccttatatggtcagggatgttatacgtgcagcgaatatgatgatatgtgctacatgtaaccgaattggccactaaacttgctggatgccgnctgagnagtctg

SEQ ID NO: 55720 - DNA, 542 bp, Triticum aestivum
  Clone ID: PAT_TA_55720
ttaaattggatactgaaaaggttcgctgcccacaacctttattacaacaacacatacactgccctcctagctctctacagcgatgagccttttggcatatgggactccccatgtccagctccctggcctaggttaaaaatatgattgtccacgttgttcagcgtggccactgaagccccaggcctaaacaaccttataccttccaactccaagctgacctaagccttgggacggctccaatgacgaggatcacaatgtccctctcattcttaccaatcgatctgatgatcttcgatggccaagttaactactccagccgactcttgacactcagtgaagggactgtacataagcgactaaggctgaggatatctgatctagggacaaactaattaaacgaagagtggccagctgactactgagacatgcagagctcaactatgctacataggagatggacgctgtaaccagactgagactgctatcattctaatctagagggccacgggcatcagcgcaaaactgtgcagtgagaaactact

SEQ ID NO: 55721 - DNA, 591 bp, Triticum aestivum
  Clone ID: PAT_TA_55721
agaaaaccaaccatgaagggggccaaatccaaggcgccgccaaggccgacgccaagttggcggtgaagagcagggggcggagaagccggccgccaaggggtaagaagggcaaggccggcaaggaccccaacaagggggggggggggccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggag

SEQ ID NO: 55722 - DNA, 368 bp, Triticum aestivum
  unsure (1)..(368): unsure at all n locations
  Clone ID: PAT_TA_55722
ccggtcgccccgcgtccgnccgncccgcgcgtgcccccgttccagctcctaccggacctctattggaacacccaactcgcgagtgggtcgcgctgacaccgtgcgaccgctgccggcctcggccccttggcgcctctgcgttccgggcggcccggtgccgggggggccgccgggtgggcctggcgtctccgctggtgccttccctgtacagacttgtatgttgtcttgccggtcgttctgtgcttagtgtctggggggatcctggtcccatgtgccatggtgtcatttcccgtggtgggctgcgctgagactttggtgctgggctgcctgccggtccgctgtttttggtgccttttggttgcggcctg

SEQ ID NO: 55723 - DNA, 281 bp, Triticum aestivum
  Clone ID: PAT_TA_55723
tttttgaaatccaaagttgacataatatttgcctggtcaagtttccatgaatggtggagttttaaacccgtaaaaaatccgaccagaccctaccggtaactggtcgaaatcgagaaaccgaaccctgtgcgacacaaacaagtatctggaaagtccagccaactgtgcatatttatttaccactgaaatttcgactggaagaagaactaactaaagtatgacttggcgattggatgaaccaacaaataacgctgacaggtactaatcgatgcgtacatagc

SEQ ID NO: 55724 - DNA, 593 bp, Triticum aestivum
  unsure (1)..(593): unsure at all n locations
  Clone ID: PAT_TA_55724
ttttgaggctatcctattcgattcactgctatgctagtaaaactatatacacactgcgcgccatcctggcaatgcaagtaaaagttccaacgccaaactcctccgtgctgaacttgttcatgatgctcatttcacattattacgcctcatctccttccattacaataatgacttcaggcgcttctgtagctctggctctctggaaggaccatcgctacgcagacgacggtcttgcggatcgtacagagggtcaggcgtcaccgtcgccttgatcttctttccgaagtattcgatctcaacagcttcgccttctcggacgttgcccggtagccaagcgtatgccacgggcttgcgcactgtgtatccaaatgctgcggtcgtaacataaccagccgccttgccgttatagaacacaggctccttgccaagacacatggagcggccatcatcgaccgtcaggcatcgtaatcgacgggcggacgtcttcctcgacaggggctccaacgcggctttcccagcaaagtccgcctttttgtccatttggatggcatatgtcacgcccgcctccctggnattgtgttccgaggtcatat

SEQ ID NO: 55725 - DNA, 605 bp, Triticum aestivum
  Clone ID: PAT_TA_55725
ttttgtggaatacatcgctcggtaccttggtgatgccaccatagtacatgccctcattgccgttcgaagtaaaggagcaaaggacaccaaaatacttgtgtccacgagtttatgtatacatcttattttttttatataaaagtgtataacttttcagccctctgaacttggtatccgttcgtctctatttcctaggcatacatgatgtggtaatcaatctggtccacatttgaatactcacgatcgaagacgctccgagatgacagcgttgcaccctactcagtcctgtgactctagtgctgcttctcgtgggcttccctcctttgctgggcgatgaactcgaacaagctgccatcaaagcaacggcgaacagcttctcgggagacgaagccctcctcgtccttggccagcacgtacagcagtatccactctcccttgctcaccaaccatccaaagaagtcatactgcagccggttgccttcggtcatcctccagatgtcgccgaagctgagcttgtccggcgccgtgcgggcgtacttgctgaagatgctctcgaaattaccggcataaaccttccctccgtgtcgtaggtcgaggagtcgctg

SEQ ID NO: 55726 - DNA, 126 bp, Triticum aestivum
  Clone ID: PAT_TA_55726
ttttaattatgcgagcaccggctttcatttaatatatctggagtgcaggacaaacactgtgacaggactataaaaagataactagccatccgctgccacctcacaatgacttaaaccccatgggcc

SEQ ID NO: 55727 - DNA, 610 bp, Triticum aestivum
  Clone ID: PAT_TA_55727
ttttaatttacaatattaacactgcaattacgtactgttctaaatcatgcccaagcagcagcagcagccgccgccatgattgcaacaacggtgatgatctacccttccaacttcttttctctatctttactttcatttaaggaatgagctcctctgaccaaagaccacttcttttttacacgaacgcgcaagaaataccgcatattgtctggttcctcgcacatattcttttggacattggtcacaacatacacagaaaataaaaagagcagaggcagagctgctgaaaatgacaagagcctccccatcgatccctaacgccgcttctttcctcgtcctggctcaccgagttaactgataaaacaacaaggccgattcagggatgttgcatagctgaactccacaagaagcaaaagaaaccgcatgccccatgctgtgctgttcaaacggcctgtgttgcgccacaagatgtcttcagtgaattcatagccttccacaacgcagactcgatctcaggactccctgggtccaacttggctgcatccagaaaagcatcgcatgcacctccatagtccttcaataacatgagtgcttcaccctgccggtagca

SEQ ID NO: 55728 - DNA, 595 bp, Triticum aestivum
  Clone ID: PAT_TA_55728
tatagtagacatattgtataatattatgcgtccgtgcatatacatagccaccgatagcattcacatacgagcatgctttctcgagccatgttggtacatgaacatggacatacacatattcttaggaacaaatgggaggggggaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccatgagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccct

SEQ ID NO: 55729 - DNA, 127 bp, Triticum aestivum
  Clone ID: PAT_TA_55729
aaaaaccctaaggggcttccaacaagttaaggggccaattcggttccatggagcaaatataataattttcggggcacgtataacatccctgcaccatataagggccccaggtttttcacggccccgg

SEQ ID NO: 55730 - DNA, 162 bp, Triticum aestivum
  Clone ID: PAT_TA_55730
ggggggggtaaaaaacccagtaaagtagtctgggtggggcaggggagcaagggggcgggggggggcctgcgaatgttttgtcaccccccagcagatgacaagaggatcgggtgggacgagccacccccggggccaggttggaacccctacccttggtttggg

SEQ ID NO: 55731 - DNA, 576 bp, Triticum aestivum
  Clone ID: PAT_TA_55731
ttttattttttttttttttaaccttttatagtctggtttgtcgtctttgtttttttttgacatatatttctataccagtttttgtttgatttattattaggactactgagctatacatccatccactacgctagcgcgggaagctctgtgcaggaggacggagcacctggggcggaagaggccagcctagcgcgcctttggcaccacggtcgcccgggggtgggggaacctcttgggggagcggtgaatgagtccatgggctgaatctggggggggtggtggaacctgttgatgaactcggaggggcgcgcgtccacctaaggcccggggctccccgaggggcacctccggcccacgctccttctgttccggcggcagggggaggcataaaattatgggcccgccgggggggcggctaaatgcctccagcttcttggggagggacccggccccttagtggcccccccccggggggttactggggggcccccccccccccggaaggttcccaaaaaagggccgaccaaaaaaaacaagggggggtccaagggggcctttttttttaaaataacgggg

SEQ ID NO: 55732 - DNA, 455 bp, Triticum aestivum
  Clone ID: PAT_TA_55732
ggccggttcaatttcgggggggtcttttgctttgccccccaacccaaattaacccccccacaatggtcaaacccctcccttcattctatggacattcagaccggcaattctcatcaatcatccctcacccaagaacgagctacgaaggcgcccccctgatcatgaaatgtaacccctgaccagcccgggggaattgcattcttctcctggccttgggcatatgaacttgcccccattctttttggccatctaataaagggccttggggctatacccaaaacccttgggcaggacaagcgggggattctcgggggccatcaattccttggttatgtaacaaacaagcttcgaggggggccgctttgaaaagggcaaaggctccccgagtttccggaagccccccaacgacaagggggcttctttggggcagttgcccccaaagcaaaatggagtct

SEQ ID NO: 55733 - DNA, 500 bp, Triticum aestivum
  Clone ID: PAT_TA_55733
ggaattctaattggggccccggggaacaccccggtaacaacaatattcccgggcccccagttttcccaaaaccaaaacccccccctttccaacaaaaaaggttttttagacttttaaaaggggcaaaatccgggggcgggggaacattttttaggggggaaattcccccttttggccccggggggggcccctgggggaatctttaaaaagactttttttggggaacggggggggaaaaacaagtccaaagttaaatttttaaaggggccccaaagccccgggcccaaattttaaccgggccccaaaacttttatggtttaataaaaaccccaaggaagggggggaaacaggggggaaaaccccctttttggaaaattggggggggggcccaggggaaacactgggaaacacccaaggggggtcatttgggaaacccacgggggaggaccccaaaatgatttgaaccgggggcccatttttttaggggaacgggatacccc

SEQ ID NO: 55734 - DNA, 548 bp, Triticum aestivum
  unsure (1)..(548): unsure at all n locations
  Clone ID: PAT_TA_55734
gggggggggggggggggggttttttttttttttttttttttttttttttttttttttttttgactcttcacgtgggctgcacctagtaccctaaaggggtaacttgtttagtatgaccatttttacctatctccaaggtgccnattattgggggtagaatggggatcacaaattaggattctaaaaaattggcatgatcgaaatggtagctagatttacttacccagtccatggcattcttgatgaacttgacgtcctccaaaggaaggctcccgtgcaccaaacgcccgcgggagctggacccggcgccctgatccacctacttgaacggcgtgtgccggtctttcaagaacccaatggtcccggcgaaaagggcgacctccaccacggtgttccacccgagcacaagataccaccaggcccacccgaggaacggcaggacaccccccttggaccctggccccggcgcgtaaatggcgcccgtgcctgcaagctgctcccgcatggcccgcaagcgcctcgggtcggcggcgcttcgcccggacccc

SEQ ID NO: 55735 - DNA, 600 bp, Triticum aestivum
  Clone ID: PAT_TA_55735
tttttagagcttatagcatatctttacaggcagatcagacagtaaacacaatagactcaatcacagaatgtattcacgatacagggtacagggcgcggccgagcggtggcacatagcagatcacatccggacctccaggcctccatcacttccagtttagcttcctactcgtatctagctaggggaacgtacactcgaagctgaactgcttgcgcaaagcagcagtgctttattcatttgctccgtggatccggccattccctctgcacgagatcatgggatgagttgtgattttgacccggccatcacgcctcatcgggcctctcttcacccttcaggagattgggatgatccgcgatgactttggctttggctgcccgttgtcgtgcctccttggatcatgctgttgctgcattccggggagcgcccagttctgtgcaggctgcctggcaccgttggtaccacggtttccagagttgtcaccattagatataccagcattttggttccagcctggtaagtgttgtccagcattgcccttccatgattcttcaaatccaggtaactcatcttcattgagattgtgcagtatctgtgtac

SEQ ID NO: 55736 - DNA, 601 bp, Triticum aestivum
  unsure (1)..(601): unsure at all n locations
  Clone ID: PAT_TA_55736
agtgctccatccaanatcctcctcactataatagtatcagttatcacatcaatgtgctcctatggcctcccttggcttgcttcgtgcactcaatgccccgaagatgccgtggagcaatgtcctaccgttggtcgctctggcaactataagaactttcagtgcccaccagggtattacaatggtatggcatcacttttcttcaatacaaatgatgatgccatacgcaatcttttcagcactggaacagcgactgagtaccacatgtctagtcttttcatcttcttcgttgcaatctattgccttggacttgtgacttacggaattgccgtcccatctggtctcttcatccctgttatccttgctggagccacatacggtcgaatagtgggcacactcttgggatccatatcaagtcttgaccctggactttttgcgcttcttggtgcggcgtcttttctcggcggaacaatgagaatgactgtgtcagtctgcgtgatccttctagaactcaccaatgatctgcaaatgctccctttggtcatgcttgttcttctaatatcgaagaccatagcggatagctttaacaaaggggtttatgatc

SEQ ID NO: 55737 - DNA, 591 bp, Triticum aestivum
  Clone ID: PAT_TA_55737
gccagcacttgtgacagaagggtccgtcgtctcgctcggtggtgccggtggtgggcggttgcatccacccgtcagccaagccaagccaagcatggcgccggaccacggctccaaggtcgacatctccttcgccggccgcttcaccgccagcgccatcgccgcctgcttcgccgagatcaccacgatccccctcgacacggccaaggtcaggctgcagctgcagaagaaggccgtcgccggggatctcgctgggcccaagtaccgtggcctgctcggcaccgccgccaccatcgccaaggaggaaggcgccgccgcgctctggaagggcatcgtccctggcctccaccgccagtgcatctacggcggtctccgcattggtctctatgagcccgtcaaatccttctatgttggcgagaaccatgttggggatgtacctttgtccaagaagatagccgctggcttcaccactggtgcccttgcaatcgctgtggccaaccccactgaccttgtcaaagtcaggcttcagtctgaggggaagctggcaccctggtgtgccgcgccgttatactgggggcaatggatgcttatgcc

SEQ ID NO: 55738 - DNA, 634 bp, Triticum aestivum
  unsure (1)..(634): unsure at all n locations
  Clone ID: PAT_TA_55738
ggttggncaaataggacaccttgtcccatagggtcggcacactccgctccctaaaattacaggatcggatgccgtgtccggggagaattggtgcactggagcaaacgattcaggggtgtgcagataagttggatatgggaaaagtaggcttgacattgagaaggcgaagtgtatgcaggaagatgtctacggatgctctgggaagccaatgtagtggctgaacaagactgggatcatgtttacgatacattttccatcgatacagagggcagtgcttacaaaaagaggaggcaagctgaagaggaaggttggaagaaggagagcaaccgtgcgtagttctgactgcctcttccacctgtcgctaagtgtcataggcaagaggaccaagtgcgggcgggtgagcatcaggagtctagctggtcggcttcagcctttgaggtgttgtaggctagcggtgccgcttccgagcatctcctcaccccttgctcctgtggccccttcaataggtcagaccccctctctctcaagactttgctgattaaatatataataacaaataattatcatacattgagctatatttggttccctatagaaggaaaaatgcgccttttgtgtaattgtggtgatcaat

SEQ ID NO: 55739 - DNA, 484 bp, Triticum aestivum
  unsure (1)..(484): unsure at all n locations
  Clone ID: PAT_TA_55739
taanaactcatagccaatcaaagccggtgggttggcgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccggcgccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactna

SEQ ID NO: 55740 - DNA, 621 bp, Triticum aestivum
  unsure (1)..(621): unsure at all n locations
  Clone ID: PAT_TA_55740
ctttgttcctctganaagatgggtcaaaatgtggtgccatgcctgacgtgtggcacgattaggtttataccagtaaaatggcgccttctgttagcctttcgccatcagtgggctttgttttttccatccacccatcgccgtcagagagttggctgtctgtgtagccaatttcccatcatctatcgtgcattcagtgcgcgactagaaccgctagcccactgactcgagactattcaaacaagaatggtattagtaacgaagctgtattagtaatctctagtccgcgattcgttagtctatacgcgctgattgcttttcctagtggatgattattttacagcaccactagacgctaatcttcctcctattttgctttccttgtgtatatgcagtgccggaaagctcattcagaagaccttgaccactaggaaatcggggaagttctggttgtcatcgcagagtctccggcagatatgtctttccgcagcatagtccgcgatgttagagagagcttcggaagcttatcaaggcggggctttgacgtgaggatttcaggcctccctggtctttccggtcatcatcaccggggngaaatctttcgggccaccgggtgagccgcac

SEQ ID NO: 55741 - DNA, 401 bp, Triticum aestivum
  unsure (1)..(401): unsure at all n locations
  Clone ID: PAT_TA_55741
gcccagcactcgtagnnggccaagtgccatcctcgtncnngtggggatttgctcctcgcggctttgccatggcagnncggtggcggccccgaggcgnngcggctgagggtgnntcgtgcggnagaaccgcggnntaagcgccgcctgnatcccgtgccgggttctgtttctctggtggnngcgccgtcnnngccgggtgcgcgcggaggcgagggagctgctnnngccgcggcgccccgcaggggcntnngcggaggggatggggcgggcaccgcnncgggcgccaccggggcgcgcgccgtctgcagggtgccctngggagcagtnccggccccgtcattttcggcgtgggctcccggacccgcgcccggcnngctcccggncgcttctgcaangctcgg

SEQ ID NO: 55742 - DNA, 575 bp, Triticum aestivum
  Clone ID: PAT_TA_55742
gcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctc

SEQ ID NO: 55743 - DNA, 511 bp, Triticum aestivum
  Clone ID: PAT_TA_55743
gctaggaaatgattcatttcatgggtacgataaatgccgattttaaaactcttatcccgctcgatctcctggggagaggccaactcccaggtgtccttatacatgaccgtaggatggactcgccggcacgttcgctattgcgaatgggagctgtgcaagcgatcgcgtggcgcgcggcacggcaggggcaacttaccgaagcggctaccgcacacggttgagcaaggcgcgaacagccgagagccgtgtatgtccagctgcacatactaaggcgcacgcatcgtcttcaccgctgtgatactcgactttatgtgctagggcggggactccaccaaaggcaacggcaccggcggagagtccatctaccgggagaagttaaccgacgagaagacagtgcacaagctcaccaagcccgggatcctgttcatggccaacgcgggccccagcaccgacggctcccacatattgatctgcaccgccgctctggacttggctcgacggtgcagcacgt

SEQ ID NO: 55744 - DNA, 611 bp, Triticum aestivum
  Clone ID: PAT_TA_55744
gccggagaaggagctgtccgttggaggagcgcaacctgctgtctgtggcttacaagtaatggcatgcgggcccggcgcgcgtatctgcaggcatcatcttctccatggagcagaagtaggaagggggcggcaccgacgcgcacgccgacaccatgcgctactaccgcaggagtacgaggccggactacgctacgatgctgcagcggcatactcgccctcggttgattcccgacctagggccatccgacggagctgccgggttcaaagtcttgtatactcaagatgaagggcgactaccacagagtgcacttgctgagctcaagatcagggaggagaggaaggaagccggcctgagcaccatgaacgcgtcaaactagctaggatatcagacctaggagatttggttacaactccaccgcatcaggcttggacttgcacgtcaacttttgctgtgttactactatacacatcttcgaactctaatgtccgcgcctgcaaccttgctaaacaagcctctgctgacgctatcatcagagcatgaacagccttattgcgagggaatcctacatagacagcactgtaatcatgcaggtactgcgtgacaatatgac

SEQ ID NO: 55745 - DNA, 585 bp, Triticum aestivum
  Clone ID: PAT_TA_55745
ggttcagctgaatcaaacatccatgtagcgaggacagctgaccgacatagttgcatcatccatgcaaactcaagtacttccaataacatatttctgcttgatatataatacctagaaatatatgcgtgaagtcatctcacttctcaaatccagctcattactactaatcaccccacaagtttttagtgctgctaccacaacattatctcatatataagtcttgctaggaggatgaaagggctttatctccatcggcatgaggtaaagatctagccatcattggataaaccaacgatagtgagatctgccttcacaatgcagctcgaccctacaacatagcctttcttgagtttcttgagagcaagaaagttaggccaaccccatccgccatcacatatgaagagacctgaagttttagtcaagtgtttcccattcttttggttcaggatggacagagtcattacagccaccttcttggactcgagatggagctcattcgaggcatccagggataagtacaagctgaggcaatcagtgctgtacaagtcaccacgcgggtacatgctgatgcaccatttatgcccg

SEQ ID NO: 55746 - DNA, 460 bp, Triticum aestivum
  Clone ID: PAT_TA_55746
cggggaacccccacggggtgaatcaagaaaaaacggggaacagggtcctatttcaggggcccgccgggcaaatgtaacagggcaacagatttcaaaaaggccttttgggggggagggccgccaccagagtaatcaagggtcaggaaactaggagacaaatctttagctacagttcgcagttgcgggggtctgcttttgcaaactgacagcaaaccattatttcccgccagctaacgtccttttttaaaaaaaagggtcttttttagaaagaactttccttttttgaacttcggggcttcgggggaggctttcgcatatttccagccaaggagtcgtgggcagcacctacaggaaatatcggtcactgggtgcaatccagtcaaaaaatggggatcctcattgggaccaagggtcacattcaccaccctatcaaaaaggtaggcccggccggggcggcacc

SEQ ID NO: 55747 - DNA, 523 bp, Triticum aestivum
  Clone ID: PAT_TA_55747
ctaggctcctatttatttatttgtgtcagttcatttgtttttattttttatttacttcaacctgaacaggctcctttcttttttaacccaaaagaagggggggaaggccgggccaaaaaacaggaagaggagctgaggcccagaaacccggggcatatcaagcagggaccaggggggccaaggggtttgtttaagccggaagggcaaactgggggagggcagggagcctcccataagcaaagccgcaaaacaagacggcagaggggggagggaaacaaagggcggcggggaacatatcaggggaccagacggaacccaggccccaccggcattaaatggtagaaggggaatttccccgggagcaccaaaaaaattgtagaaacgcccggggggccgggggagaaaaccaccaggttgaccccgagactggagaaggggggcccttaacgggggggggaacacaggggcggggccatgcccagagaagccccgcggggggggagatactggggggggcccgggc

SEQ ID NO: 55748 - DNA, 564 bp, Triticum aestivum
  Clone ID: PAT_TA_55748
aggactcccaaagcccactggctctggatgttcattaggcgtgctccctactctttcgacaagtcgataccgcaccataacacttatgacacaataccgccccgtcctacaaccgggggaaccctatctccaaaggggatttgcacctgacaccgatatatcaatttaactgtggttcatgctctcttaggagggacatcccgactttgcacacatcacatgcggttgtggacctcctttggcgaggcacaacccatatgatcccaccgtttgaccttgaagaccgaccattgaccaagctgaaccaccccctatgccacccaaggactgaccctgcttaaaccgacttgacgactgactgagaccataccgccaggacccatcactgactccaacgacaaagacctccccaaatctgattatgtcccaaccaagtagctaacggacacgtccaaccgggtcttttcagccaaagatgaacccacccgatggaaccgatttctgctgacttccaaaattgaaaccattctgggcattatcacctgagggcatgacctcattttc

SEQ ID NO: 55749 - DNA, 629 bp, Triticum aestivum
  unsure (1)..(629): unsure at all n locations
  Clone ID: PAT_TA_55749
gnacgagttccctttgaaaagcagcggtcataggacggagcaagatgattcgaaatagagggctctgtactgcaggacaacatattcactatcaatatatggtctatttccaatataaggtgtatgtcaagttatacactgactacagaaagtgatgctcgacgacgaacatctgctcgaggacaccctgctcgacgatgctcctcttcgctagcatctccattgcatgatagggggagagttcttgtactcagagcagctgttgatctgcagcaactctagaagtaggatttaggataatcatagtttcagtttgccaagcagggagtataatttaactggaaatcaaccaactattgctttgaactggagtataattaccgaagcgggtcgaagtgggacgatgtggttcggtggtcaacggcggctgcgcgggatgcagtatggtatggcttgagcatctcgaggaggggctctctccgcaaggcatcctctacgccacggcggaggtgttcgagtagtctgtcccggggctgcgcgtggagcacgtcgacgtctccgtcttgccattgctcagcaccgccctgccggctggggttcttatttgccatcgaggccttccgcaactg

SEQ ID NO: 55750 - DNA, 644 bp, Triticum aestivum
  unsure (1)..(644): unsure at all n locations
  Clone ID: PAT_TA_55750
cggccgcgtgggttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctgctggaggcgcttcctggtgacaacgtcggcttcaatgtcaagaacgttgctgttaaggatctgaagcgtgggtttgttgcatccaactccaaggatgaccctgccaaggaggcggccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggagctggaggcgctgcccaagttcctcaagaatggtgnacgccgtatcgtgaagatgattcccaccaagcccatggttgt

SEQ ID NO: 55751 - DNA, 630 bp, Triticum aestivum
  unsure (1)..(630): unsure at all n locations
  Clone ID: PAT_TA_55751
tgtaagcagggatctcgcggntgtcggtcttgggttcgcacactggagccgtacttggtaataaccgatctacaatcccatctctgtctgtatagattgtgctgtgccttgactttgggattgaactaactggaggtggtgtggcaatgctgctgtgctaatcgctgagattaagagtgtgaattctactctgggttgattttttgggctggattctgcggcaaattgatgtgcggtttatgtgttatctacttagtagtagctcagtttttgttgaattagtcggctatatcttactttctttgtaactgccggttgtaattcttcattagatagaaagtttgaaacaacttcatcttgtatattattagcagaaagtaccaccatatcatgctgatcataagtagatggctctttgctgccgatatagcaaattattgaacaagggtgatgtttcagtggctatggctacatcttgttagtaaatatggcttcgagctgaattcctcttgagaaagggatgtttataaagttntgtccagtttcaggccttatgacagggaaaactgtcaaaaaccaacgtttcattcagtttatgtcactgaaaaattctatagtatntcatactaa

SEQ ID NO: 55752 - DNA, 545 bp, Triticum aestivum
  Clone ID: PAT_TA_55752
caacaaaaggcttgtgcactggtgcagtgcgactagcctgcacggatggtgccgccacccatcgccgacgctgacggacaaggacatagacgtcaaccgtgtcgattgtctcacgcagccgtagaggatcggctgcactgttcgtccgcaggaggacagccgtggccgcatcggcagaggcggccccgccgagaggtcgagagcgaacgtcgacatggaagaagaaggtgtatagagcgaacaagggtgccgcggcacggtgaggctgctgtgcgacatatgcaaagcgaagaagaacaacgtctagtacgagagcagccccaagatctattgccgctgcccgacctgcaatggcgaccggtacatcttgagccacatatgcacggtctacagatgcatcacatatcctgaaagcaccgaatgattatcgacacaggcatgcagaggatgcagatcgaactgaagatcctatgcgcgagcaggcggttcttgtacctaccttatgctggcatgctgacagctgcgtgtatcgcacgatttacttc

SEQ ID NO: 55753 - DNA, 377 bp, Triticum aestivum
  Clone ID: PAT_TA_55753
aaaaacatcaggcaactcaagcaaacacacagcgaaatcaagacatgacgtcctactccaagatcacgcatacgcacccaaccctgaggcatgttgccaagagcaaacagaggattcaaaagctagccactggcgctctaaacaaggccatcaactccaatgccgaaccacatgcactcattgacagggactgcctctgttccatattcaccatccctggtacttctctacgtgagggtggacaaagcgactgagccccctctgagcttatggcaagcactgcgggtctgcatgccaggtgttagaacctggttggggctctgactccttggctctctttatttcactcgcgcgggtcggtgtgcagacctgtctga

SEQ ID NO: 55754 - DNA, 470 bp, Triticum aestivum
  Clone ID: PAT_TA_55754
tctttctgtgagtgtcatcactgctggtgcgagacctgtacctgcttacgacagtcgtgaacttgttaaaaccctgcacattgaagaaggatacaccgggattatatatccaaagcgtgcgcttgcagtggattcttgtgctgcaacgctttgcctggtggatgagtgacgcagtctggaacagcccccgtatccgtgctcacggagcattgggggctagtgcgaccggactggtccgggacgaccaagagacaggacctggagcaccgcgatcgctgcaggagtcgccagacgagctgtgtacggtcgcctcgacagatcagaacctggtactgtatgcttgtctaggctgtggccgtcctctcccttgtagtgaacgtgggcggatatgctccggacaacgccgagcattacggacacatgtgcgggggctgtctctgaacaggacaggaggatctgcgcccaggagc

SEQ ID NO: 55755 - DNA, 294 bp, Triticum aestivum
  Clone ID: PAT_TA_55755
aaaccgcaaaccccaaaggtgcgcagcccccgaacacaagacaaacacccccagaggaacacgagagaaccacctggggcaaccgccgccgccgcacccgacaaggccgaccctgtcaaggcagcggagggggggaaagcacagccggctcacaaaccacaccacccaaggacctacggccacgctggcagaccctgccatggaaacatctaatccggagacgacgcacgcacgctacaaacaaacgcggagagaggggaaccaaagcccctcaagaaccaaccggaccacccc

SEQ ID NO: 55756 - DNA, 637 bp, Triticum aestivum
  unsure (1)..(637): unsure at all n locations
  Clone ID: PAT_TA_55756
cctgtttgnaggtccattgaaataaatatttgggtcttgaaaatggcattctagatccatcagccattttattatctcaatatggctacctcaccttcatggattgcaaggtaacacttcgcttttattttttctcaaagtttattactccctccgatccaaattaattgacgcagtctctatacattaattcagatcggagggagtatatttatttgtccagccagtatgattgtttgttttaacatcttaaggctgttgttatgatattaggaaaagtgccttcaagttcaaatttttgattgaactgcagtattggggctattcaaacatgccaactcgccctagcatccctttccttattttgtgtggttcacgcccagattttgctgggaaatgttaattgcaatgttgtctgttaatatttttgtagtgactgagactcgattttgtagactgcctcaccttcctacgtctacttctcggaactaagtaaaagccagcaacctcaaggtcggctgccattcaagattntgttggcattttcaggtttgcaacataacctacccaagtcgcgtgggtattatatgcgagtcttcgagtgcaaagagctgcacgtgctcttttatgtgcgtca

SEQ ID NO: 55757 - DNA, 658 bp, Triticum aestivum
  Clone ID: PAT_TA_55757
atccgcccctcgctgccgctgcatgtggggtgcaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctggggtgtttgagatacacatacataggcatcaagatatctgttgggtgaa

SEQ ID NO: 55758 - DNA, 625 bp, Triticum aestivum
  unsure (1)..(625): unsure at all n locations
  Clone ID: PAT_TA_55758
cctccgtctcctccgcagaagagaacggggcgaaccctaatccccttcccaaatcaagccggccgcccgccttccctccctcctcatggcgcccaagcatcttcctccggagtccctcccgcggcgcatccccaccggcggcttccacccgatcacgatccacgtccgcgtcaacaggggcggcacgtacctccccaggttaatgcaccaaggcggggtttcttcactggaaatggccatagaagcagctctttactggcctgatggcgcaaggaagcgttcaaaatcagatcacgctgagagagcccgtaatggaaggcgccaattacttcaagctttggtggacaagcataacgaggatcacaatcttttgggggattttgcgtatgaactcaaagatgttgtggagtgcaaagtattcagtgagaagcgtgggtggtactatcatctcaatttcactttgactaaaggagctgatagtggcatcgaagatctattctttgtcgaagtcaaatatgggcgaccagtaaaacaagaactgtcggtcagctgcttctgcatgattaaacctaccgataatggacactgctatggctgtaccaacatggnagtgtcaatatgaagc

SEQ ID NO: 55759 - DNA, 536 bp, Triticum aestivum
  Clone ID: PAT_TA_55759
acaaaacccggcaaaccctactagttacccgtcgcccggggcttaataaccgccgaacctgaggcgctgcggtctttcgttcgaaagatgccggccatgggtctaagtccgagcgcgtatgggcccccttatgggccccgttcggacgctgtcggcgggggtgggttctcggctcatgtgccatggatctccggcaatcgatcgcttgcgcccggtggtgtattgtgaggagaagatggccatggatggggaggaaatgcaccggctgcgcgcccagactgaccagaaagcgcataggagttagaaaagctggacgctgaggggtgctaagatgatgacatatgaccggacaagatatggctgcagccggaactgcttatattgaagccggaaggcatactactgtagccattgaaagcatagtgggagattttgggaaaacacacaaggcatgtgacgttgctgtcattaactggccagtgctgattatccatatggccatggctatcaagtaacttcagcatgcatatgctgct

SEQ ID NO: 55760 - DNA, 193 bp, Triticum aestivum
  Clone ID: PAT_TA_55760
gggaaaggccgtagggacgcaggcgatgggcgtggggcgaggcaggaagctggaggagacctgcatgagcgtggtgaggaggggagcgcggacgatgcctgtgtcatgttaatcagcatatgttcatatatctttttgaaatggaacggggagggaaggggacgtaccgaacaaactatgtgaagcctgcaaa

SEQ ID NO: 55761 - DNA, 656 bp, Triticum aestivum
  Clone ID: PAT_TA_55761
gcccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactacaacattcagaaggagtcaacccttcacttggtgctccgtctccgtggtggccagtaagctcctggccatggagctgcttttgtctctgggttcacaagtctcgtcttcggtgtccttaaggagtctggtctatgtct

SEQ ID NO: 55762 - DNA, 480 bp, Triticum aestivum
  Clone ID: PAT_TA_55762
gtttgcgcctaccttctcctggtgcggcgccatccataccaatcgagggtcgagcgattccttcgctcatgattagagagccgatgagaagatcacctacccagcaggagacgagcaggggctcaccttcaccaagctgtacattcgcttgtcaggcaagaacgatatgcgggggctgatggcgggtcttgaagaccccggcatgaccagcgtcctatgcaagctcaagctcggcgagatcgtaaccaccatcctcacgatcagggtgcaatgctgagaactgtggagtgcaagaacattagctgaactggctgctatgtccgaggtcaggacaggatcacgtcactgcggaggcgtttcttacatgacacacatggtatcagatgtgttggggacagcttcttactgggaccgggttgactaaggatgggatgagcttcacaagatgctacatgatgatgacccacgtgatggtctgct

SEQ ID NO: 55763 - DNA, 571 bp, Triticum aestivum
  unsure (1)..(571): unsure at all n locations
  Clone ID: PAT_TA_55763
gtaagggagcttcgcgtgccttactcataaattgaaaacccccaaatattgtaatgggagatgtcctccaaaatttacaggaatggacctttgagaagcccagtagaaacaaaggtgaaaagatggagatgtagtcacttcattgtcagactcattattaacaaaaacaaaggttggtaaaaaaagagtggctatctatagtctccaagtcttggtctgatttacctgaacaaagactacagaaagaatataccagcataacacctatctgcagcagctttccgcggagtttcttggtgattggcagtcagggcatccaccttcgctcgcggtgctcgagataggcggccgacgaataggatattaaacacggcgaccgggaggaagggtcacggctgaggttgacgaaacagtgtacggaagcggcatccggaggttgaagatgcagtcgacaatgatgtctgtggatgcatcagcttgcagcctcagacttgacctcnacgtgcagcgacgaggaccggagggcactggtcgccttaagctttcccccgcctactgcactggggacacc

SEQ ID NO: 55764 - DNA, 595 bp, Triticum aestivum
  Clone ID: PAT_TA_55764
tttttcagatggatacacagttaattcattcggagtaattagacaccaaaaaagaacgaaaaaacatccacacataaccaatcccacttgagcaacagctgccctgtttacttaattatcccctctctctagtcaaacagcgagcagagcaagcgacgacgaacactccatggagccggagtagaagccgccgctggctagcattcaccggctaattcttttacctaagcaatcacgagcttaacttggaagccagcaagtgcgctgacgcgttggccttcccttgtagctcgcgacctggcgtctaccataagcagacggacgcggcgctggcggcggccggcggcgcctttccgcgggggatgcggccgtagcggaacccgtggacgccgccccggcggggcgaggagcggcggcggagcgcgggcgcggcccatccgaagcataggcggatgcgcgcgcggagccggcggagccccttcgcggcggcgcggcgcatgcgtcgcgccccggcccagacaacgcggcgcgtgcgcgcgcgcggcgagacctcggcgtcgcgggagaagtggtagctccggaggaacagctgccg

SEQ ID NO: 55765 - DNA, 531 bp, Triticum aestivum
  Clone ID: PAT_TA_55765
gcaaactgcaaaccttgtggtgatcaaagaagtttttcctgatgaccatgctaggataacattcattgacactggtagcaaaaacaaaatgcacagagcatgctcttctgtcattgacactgaaggaagacgaacgatccacaccgacggcagcagggcaacatatggaaggttgaagaaccagcaaaacgaccagagggatctccagctggatctgcttgctctgcatgcctgtgtacatcatgattccgtgctttcatgatatgtgatgcatctgtagaccctgaatctgtggcacaagatgtacccggcacgactttcaggtcgggcagaatcaatagatcctggggctgctctccgactttacggaactcttgttccccttgtataagtttaacagaaggcaccccaagccggcgcaccctttttggaactctacaacttatttctgaatggtcacattccactacacctgcggaggggccgcctatgtcaccacggtcactgataactacctgctgacaggcacac

SEQ ID NO: 55766 - DNA, 558 bp, Triticum aestivum
  unsure (1)..(558): unsure at all n locations
  Clone ID: PAT_TA_55766
tagcgnngccgccactccaatccttttgttcatgacacacagggtacagttatacatacgatacggacagaggtactcgcattggacagaaactgggatagcgttagaactagacggtcagacctagcaccagaggctataagaaaaagatttgatgtttaaacggacgatctattgggttcattgagtgaactgaaggaggggcacatgggggtagcaggatgcgcaggatcaggggacgctagcaagcattcgccggcgctgacgacgacccactccactcgggtgactccatccatgatacatacagctggcatgggcctagggcgagatatctttttagaccaatgcagcaaacggcgcaccataagcctcgggcaaatgctctccaatctatacatgactatttcgcatgaggtgacgactatctactcaccgacctaaacagcatacatagcatcgaccgctgattaaaagcctagctccgagtacgagtacagtggtctagaccactactggatgatggaagacctgctgatccttcggatgcttaatgct

SEQ ID NO: 55767 - DNA, 427 bp, Triticum aestivum
  Clone ID: PAT_TA_55767
aaccccctcttccagaggggatatgccgcttattattcatcggggggaaggagcaccggtcgggggcccgtccggacatatagggggggcgatccacacacactggggacccataggggggcaaatgacgacccgtttacggggttcgggcctgggcgaggggatgctgcccccaatttttaaccttgggcgccttggagtccaacttcgcgcccgggggggccaccgggtcggcccccgggggggaggaccccccgggcgacagggacttggacattcacgccaggacccccaccggcggcgggccgaaagcccccgaagagaagaacccggccgtaaaaattgggggggggaaggccgcgggcaccaacacgggggtgaaaaacaccaacaggggggttgccacaaacagggccagcaccgggcc

SEQ ID NO: 55768 - DNA, 552 bp, Triticum aestivum
  Clone ID: PAT_TA_55768
tttttattggcggaaaacacatcaccttaatattatacttaggaacgttttacaagaacaacccgaacggggaatggaccgcataaacgcgagtgctcaaccacatgaaatgaaaataagcgctgcctagttaactgacggataccggactaacaccaaagcagaggctgctaaactaggactaatgggcccccgcataaacaacaacgcagggagcacgcatcctcaagcacaccaactcgggcactcaaacgaatccgctgccgccaaagtagcacaccgacaaccatgcggttgtaccgctctgctgaacacctatccgcaaacatggaggacaccacagaggaacgctacttgcgaaagatcctgacatatgccgctgtgatacaaacaggatatgtgacctagatcttgtgctgctacttgaccacagagggcgctatccctccatgtgccaggccaccgatgatccactgcaaacatactgaccagctatgcttcatgctgaacaagactctgcacggtccagatccactacaacaccatcaagga

SEQ ID NO: 55769 - DNA, 605 bp, Triticum aestivum
  Clone ID: PAT_TA_55769
ttttgagagaacctttgcattactgcttattgcttacgtggaaacgaatgaatcaaatggttccacacatacacagatgagctatctgggagctcgactgagttcagttcatacacaacagcgctagtcttatcttatagaactatataaatgtctaaaacttagacggtggagttccagatggacgaggacgtacgaattctgcacgtgtcggccttctcaccttgacgaggtcccgaccaacagggggaagctcatgcgtgcaatatgacgcgcgcggagtccccaggctcgcagaccagcacgcgacgatccgcggggatcttgctcaccagctctggctgggccctctcgtactcggcgccaacgtatgcagccgcctcctccgcacggccgctttcgacgatggcgaggcagcagcctctgaagccggcgccgctgaaccgcgcaccgaggacccccggcgccttcaggaggatctcgtacagctgtatcatctctttgctcccgcattcatagttgactatggagctgccgccagatgcagagatcagctgtccgaattcttgtaggtccccacgagcccatgcgtctcttcccttaac

SEQ ID NO: 55770 - DNA, 625 bp, Triticum aestivum
  Clone ID: PAT_TA_55770
ggcggggggggggtggttgtttttttcaaccaaaccagccgcattgtcaacccaatagatagtattacaggaaaatctcaatttatttacagtaaagcagacgcattatcagtacagcgaaacttagaatgatactgaccacacaaacgaagtgtgtgtgggtgggtaataataataaagtaacaaggccaacaggggagctaacaataggcgctaggaaggaaatcctgctcaatttgtcagcgtagctttctacccagtggcaacagagactattcttatttgctttgtgtcttgcaaacaggaaagagcaaagctacttgggtctccaacttcttgtgctgggtccagctctcggctctcatatacaaagctcctctctgctgccctcctgcaaaaatgcattcggaggcaccgtggcgacttccttcacctcaggatcaacgcccgtgaacacagctctgagctctttcttcttggcttccagatcgttataatcccagtagctccagtctgaatagcatccaaatggcataccaacatccaagtgaccaccagtgtattcatccgcactgttggggtgcttcatattgacacttccattgttggtacagccatagcagtg

SEQ ID NO: 55771 - DNA, 610 bp, Triticum aestivum
  Clone ID: PAT_TA_55771
tttttccctcctcgagcttttattgctaagttcaatttatgtaatgcgtgcacaaaatcaaccgacaggtcgtctcttcaacacacacataaaacagggtataaaacaacacatgcccttgctcaggctggaacttcatcggaagaagggtatgtctgcagaacgtgaaccgggtcgccgaccttgacgatcctccctttgccctttgctgacaccgactccttgcagaccaggttttgcccaaagtataccttctgtttattcttgtggcttggacggatcacttcaccggaccggaatgtcagcatggtttctgttggttcggtgccgccaggtattccgttctcttgattaatggtaggcaccttgcaacggtcgcataacttcacgccgtcaaatgttagcttgtttatcttcatggttttccacagatcctctgcgtacgggtggcatccatccactaaaatatttggtctgaagcgattgattggtacaggttccttaagaagctcatttagtgcatccagtgagccctgggatgctatcaggaacgggaagcaatccgtgaaggcgatcttgtagccttgagcatactcaggattagttggtc

SEQ ID NO: 55772 - DNA, 572 bp, Triticum aestivum
  Clone ID: PAT_TA_55772
ccacgaaaccagaagatgataagtgactgatcaacgcgacaaaccgcggagcacaactactgagctaccgatgatcgatcgggtgcagcaaataagttgacgaacgacctgaaccctaatgaatgcccaatcctctactagatgaaatacagtcagacgccattctgcggtagtctaaaactcgcagtgccttctcatcccaggaactggtgttcagaggttaatcgggtcatctttcttcatgtcctgcttttgggccccatctgcatcctcctgggaggagctgctgtcccctcccttcttgccgaatatcatctcgtcgaggtcatcgagcataccgtcgtctccatccggctttgctcgagaaccggccggttttctgaccagggcctcttcgctcccgacggcagtggcatcctcatgttccgcttctgcggcgatcggtatggccaacggctcttgttccgcgtgcgctggcgccacgggtttcttcatctcttcgtatctggatagcactttctggatctcgtcgttcacggtcagggcctccaagagcatggcctcgttgtccc

SEQ ID NO: 55773 - DNA, 196 bp, Triticum aestivum
  Clone ID: PAT_TA_55773
ggttgttttttttggaggattaacatattttgttcggtacgtccccttccctccccgttccatttcaaaaactttatgaacatatactgattaacatgatacaggcataggccgcgctcccctcctaaccacgctcatgcaggtggtgctgccgcttcctactcgtccacgccatcgcctagccctacgccttccc

SEQ ID NO: 55774 - DNA, 477 bp, Triticum aestivum
  Clone ID: PAT_TA_55774
ggatgggatctttccccattcccacaaaaatcacagggccaatggcacccttgctcgacaaatctgacgggccctacaaactagcaggccctacaaacaggaccccatcttagcccatgaaaaaggggtctaaacaacaatggctgggctatggggaccacggctaccccttggggggggggggcttcttcttgggggacctgggggggggcttctttttgggcaaattggcccccttttcggggggggggggggactttttggaaaacaacaccgagttgatgttggggaacacaccccccggggcaaagggaacccccgcaaacaacttgccaaactcctggtcgttgcggacggaaaacaaaaagtggcccggaaaaaacccggtctttttgttgtccttggccccgttgccggcaaactccaaaacctcggaaggaaggtactcaaagaccgcggcaaggtaaacgggggccc

SEQ ID NO: 55775 - DNA, 579 bp, Triticum aestivum
  Clone ID: PAT_TA_55775
agctacgccactcacttactataaagacacaggactctttttaggtgttcactttataaacatcttatggctcaaagatcactaatacactactctgacagttgaatcgcacttgcgcgtagctggctcagtgactgtctgcacctcatgaaattacacagttcattccggaatagcttatcaccatcccatcccaccacaatccctacgttcccggtgtttcaatcctccatccaaagcgctcccagctgctccaaaatcttggaccagaaacttatgacttgctggcactgttgctggacacccagtccaggccttcacttcagtccctcccctgctgtaccacaagtgcgtctggatgtaccacatgacgctggcagaatggagatgcatgccaagctctatcattgatctcagaaaaagtctcatggcattcatcaagatcttgcttgataacatacacactcagcacagcactcacgaactacttctcattcatcatactgaggagctcatcccttgctctaacaacactggacctattgttggtgtccacaacaaagatgagaccctgcgtgc

SEQ ID NO: 55776 - DNA, 99 bp, Triticum aestivum
  Clone ID: PAT_TA_55776
ttttcttgaaagatctaactgatgaatgtttgtgttctgacaagcctgataaaattacagaattccacttgatgataaaattacagcgacgataacttc

SEQ ID NO: 55777 - DNA, 513 bp, Triticum aestivum
  Clone ID: PAT_TA_55777
gcttggcaaccccttccgggtgacattcgtcaaataacattaccaaatcttttaagcaagcagtttcacaagtttgagacgagtacaatggctttaatcgaggaagggggggtcaaaattcgagtaaacaagctttcgctacaacgttacagagtacaggacagatgggattattgctttgcatctcccaaatgggggatcatgtgaagcaatccagaccacatgcaaactcttgccggtccagtactttcctagatcaaatccatgggagcactactactcgcctccctccacccggggaggaggaactctgctccacttccggatcctcgcgcccaagcccttcattttctccaccgatccgacgcccgccggggacactccgggggtgacggtcgtggcgccggcgcccaccaaaagagaggcgacggcgaacgccctgaatggcatcgtcatgtcgctgccgcccttgcctcgccggaaccaaaccagcgcgccggtgatctgggcatc

SEQ ID NO: 55778 - DNA, 617 bp, Triticum aestivum
  unsure (1)..(617): unsure at all n locations
  Clone ID: PAT_TA_55778
ccggaaccggccaattcccggngtcgnacccacgcccgtccgctctnncgctcgcatcacaacaaacgcggctctcgccgcagcttccggnaacctctccccccgntccccgntcgccacccggcatgnggcctccgccgtctccctcgnccgcctcctcnnctcgcccctcgccgccttcgccgccacctcgccctcgcgcgcgggggggcgccgcggccccaccacgcgctcgccggccgcgccgcggncccgcggntcccagnngcccaggcactccgcgccggnntctcaggccctcgccgggagggccgccggtggggcactcggnnccgcggcgctgaccggtctgtctgcgtctcgtccagggggccaggagcaccagccagtccaaatgttcccgatggttcacgatagaccaacatgtgcagatcactttggtttatagagaggcgagnattcgctgtgtcttggttgggaattcttgggcttcatgnngtgtggatccttggcaaaatgaattgaacctggttattgggtaagctgtcgaaaggagtatgatagggaagcttgaaatgcttacaagcctcaacactggatgaggaatccaggacata

SEQ ID NO: 55779 - DNA, 543 bp, Triticum aestivum
  Clone ID: PAT_TA_55779
catcaaagacccgattcccctccgctcgccggccgtcgcttcgtgatggcagctgctctacgaggcagagccttttggactctccttacagccctccaggcctctagtcaccaactacctgatgaccggcgaggtccaaatagcaacgctacgcagacggttcgctcgataggagaggcggtcgcggggtaaaacctcacaaggactgtggtcaggatgggagacaagtggactgagggaacgctatgctgacgggatctgtagatatagatgatcgtcgctgacgatgctgaaacagactatgccttggccggccggatcatgcacaagatgacgcagaaaaccgtcatgtgctgcatcattgaaactacagttgcctgagggcgaagagacggatgcattaaggtgtgggagactttgctgacgatatatgctgcaacacgcttaaccagactcgaagaaacataacacatgtgacgtaaaaacgctggataaatcaagaatagactacaagtggtgagggaactacatactgtgaacaaa

SEQ ID NO: 55780 - DNA, 580 bp, Triticum aestivum
  Clone ID: PAT_TA_55780
tggtatacaattactaccccgcacgcgggtctaatcatctacatccatgctgcaagtataatatgtaccccgctactcaatacatgcatctgcccgcatgcatcttcaccgtaacaaggcatcacgtaagaaaaagcaaacaagcgctctactgcatgtagcacctcaaacaacaacaccaagtgcatgccggcccttgcaggctcaagatcacccgcatgaacgtccggaagctgaggcgacatcctatgactcctactcctgggctgcttgaaggaactatgcacatgggcttccgctgcaaggcgcgcacagaaacagcatagctagtggagggcatttggcgagcgatacagcatagcaacacgacctcattggtgtgaaaacgaagtttgctgttctgggactggactccacgatgcacaactagggcagactatcctagatcaggaccgcactccttgtactttgatacataagctgatgtaaactgcacttgttataatggagaccatcttattcacagatgttaggctatacacatgctctgacatgactaggacctaattcagaagcatgc

SEQ ID NO: 55781 - DNA, 647 bp, Triticum aestivum
  unsure (1)..(647): unsure at all n locations
  Clone ID: PAT_TA_55781
ngaattggtgtagtacttgttacggtagcttctcacttctgttcaaacttcaaactgcttagcgactagagagtgacttcagtactgcgccaacagcctctctttagttatgtccacaaactgccaatttattctggcaaaccatctgaatttgaccaagtactagtatttgttgaaggggaaaatggtagaagctaaattggaggttcgaattctactagaggagtatgcaagtgtttctgaggaatttgcttatatagaatttatttgggactacagtagtaaactgcagtctgaattggcaaacaatttgcaggtattatttgaaggacgtggcccttgaaggcggccaaccattccacagggcgcacgggatgacggcgtacgagtacaacagcacagacccacgcgctaactgcttgttcaacgaggccatgcttaaccactccaccatcatcaccaagaagctcctcgagttctacaggggcttcgacaacgtcgagaccctcgtggatgtcgccggtgggcgttggtgccacagcccacgccatcacctcaaagtacccgcacatcaagggggtaaactttcgatctcccgcatgtcatatccgaggcgccgccctaccctggcgtgcagcacatcgccg

SEQ ID NO: 55782 - DNA, 652 bp, Triticum aestivum
  Clone ID: PAT_TA_55782
acatgttctcgtactgtgcatgaactatgttgctttgacgatgcttgaagaggggtctggattcatgcgaagccatgctacaagctcggagttgggatcttggatcatggaggagcaactataacaccattgtggggagaatactttctttcggtccttggggcatatgactggcccgggaacaacccattgccaccagaactatggatgatgccttatttcttgcgctatgcatccagggcgcatgtggagtaactgtcggttggcatatttgcccatgtcatacctatactggaagaggttggtgggtgctactacatcaaacgtactagacttgaggaaagagctctacaatgtcccgtataatgagattaactgagacaaggcttgcaatgggtgtgccaaggaagatctttattatccccattcacccatacagaatattgtgtgggccactctcaaaaaaatgggtgaaccggatattatgcactggcctgaaagcaatcagtgaacaaaagctctggacatatgacatgaaacatataaagggtgaggatgaaacaactcattatatatgcattgctactgtcaataagatgttgaatatgatctgttgctgggtgagaacagccaatgtcagaagccttcaaac

SEQ ID NO: 55783 - DNA, 637 bp, Triticum aestivum
  Clone ID: PAT_TA_55783
gctcctcctcgccacccccttcctcctcctccccctcgccgtatcctcaatccccacctccaacccggacatcgacctcgactacctcatcaagaacgccggcctcgacgacgcccccagcgacgaccccgaggactggctcgacgacggggcacccgcctcccccggcgacgacctcgacgccgactacgacgaggaagacctcttcggcgacgacgacgggccggaggagtcctcccaccccgaggtcgacgaggcccacgtgctcctcctcaccgccgccaacttcaccgccgtcctcgccgcgcgccgccacgtcatggtcgagttctacgcgccctggtgcggccactgccgcgcgctcgcgccccactacgccgccgccgcgacgcacctcgcagagcagggcgtcgacgtcgcgctcgccaaggtggacgccaccgaggaccacgacctggcgcaggcgcatgacgtgcagggctaccccaccctcctcttcttcatcgacggcgtgcccagggactactccggcgagaggaccaaggacgccatcgtggcttggatcggcaagaagctgggccctgcggtgcggaacctcaccgccgtcgacgaggccgagaaagacgtcaccggcgac

SEQ ID NO: 55784 - DNA, 730 bp, Triticum aestivum
  unsure (1)..(730): unsure at all n locations
  Clone ID: PAT_TA_55784
cacacnnacacacacacgnacacacagnatggnnncacttcnnnctgctaatgncnncgctgcncnntcgttgnagccccttcccggntnngatccacnnatggnagnnaagcttgnagaacnncggggnnaaagnngggcgcgnacnncatgggngnngtcatnnccgcgnatnngcctgcgnagnaacnntggggatnntcttcgnagcctgctnnngaaccatgnnncatctcggcccgagcctgggatggacgagnnntggagcgggtgggagcaaggggcgcactacnngcggcttgggccgggagggagnncagttcaaggggagttcnngcggcgaagaaccgctggnnaggccnnggcgagnaagggggcgacganncgtgaaggggacgtagnactggggnnagaagcacnncttcnnttcgtcccccgccacctnntcccgnncctccaacncnntcgccgnacccctgcnnccgnnacctcgnacnncacncacnntacnaggcnnnaagtgnanntgaagggnaatntcnnngcggcgngnnagaaatcgagaaaaagctggnncggagaaaggggtgctggnaccccctgctgnntgcgagnnaacctnngggcctggnagnncagggctacncnntgaagcgnnagcattcnngccggttcaagggggcncnncgacgttnncggcaccaaggggtgagnncagctanncccaccg

SEQ ID NO: 55785 - DNA, 648 bp, Triticum aestivum
  Clone ID: PAT_TA_55785
gctccaacattgcgacgcgcgctcgctaccctcgcctctcctccccgcgagcctgacccagagtgggcgctactccgcctgctcctccggctgcatctgttattagaaatgtattactattgtgagaagaacatgtggtcacataaagttgtttgtgaagccagaacaaagctatttgccatcttgcttgcatggcaaccaacgagaacctcccaccaaatgtcatcaggcaagtggttaaggaattgaagaatgttgaccagacacctgcacaagggattagagagagtgtgaatgacgatgactttgcaagtatctgtgcagatatagatggccctggcgggactcctgatgagaatggggttgaccgggtgaagctagggttgaaccgtgacttgcctcaatactcaccaaaaggattttctgtgagcaaaatattgcatccaaacatatatagcagcggagagagctgcgttaacacgttgaaaaaggattggaatactgctcatggattaaggcatgtactactggtggtgagatgcctactgattgaaccattgccagaatctgcgctcaatgagcaggctggaaagatggttcttgagaactatgctgactatgcacgggatgctacgctgtacaccagga

SEQ ID NO: 55786 - DNA, 148 bp, Triticum aestivum
  Clone ID: PAT_TA_55786
ccaaaacatagtgattttgttttggtattgttggcttgtggatgaacatcaactgtagtctagtgtgtatgaccaattgtttcttcagctgagcaaccatgctcggatactgatagcagatgattgatgaatgaatgattttgtaatc

SEQ ID NO: 55787 - DNA, 413 bp, Triticum aestivum
  Clone ID: PAT_TA_55787
gacgcaaacgccgacatgcacagaaagaaaacttacttgatggtctaagcacagatagctgccccacaaaaaaaccgcggagatgtccaacctgtacgcgataccaaaacggttttgctcagcggcctgctggtgggagcacctggggccggtgtgctgctgggccacctggacgcagctccggctggatttaacaagcgtgccccactgccgatcggttgcagaaagcgagaagaaggaatcgagactaacaggaatgcaagcacacagtgtttgcttgatcgaagagaagggaggccttgaaggaagccactgccaagctagcgtagacggggtacgaatccttcggacactgtcaggaatatcaccggaataaagccctacatgataggaaccatggctgaaggagctga

SEQ ID NO: 55788 - DNA, 550 bp, Triticum aestivum
  Clone ID: PAT_TA_55788
cctgacattgagattgagattgcaaatggaatgacaaaaaacaacgcaagtccatacatttctcaccataattagcaccagttcacccgataacgtcattaaagttcactggtagtggtaatactacatcttgaatggtttaattcagctggatctcagcaaggaattttgagcaggagctgatcggaatgcatggtggtttgccatcagtccgaccacggcgagctcttgtcgatgcgcacgttcagggccacctccatctccatgccaccgccgcccgctcctgggaccaggtacaccgccggcaccgccaggaacgtcggctcgctggcggcgaccacggcgcccggcgaggtgctgctcctcatctgcatctccaccagcacgatgtccgtcttgccgccgttcgacgccgccaggttcgcccacatcttgcacgtgaaccgcggccgggtcgccgcgctcggcctggcgcagaccacggacacggcggacgcggacgcgccgagcgcgcccacggtcaggaggaacacgcggccgtcgtcctcgc

SEQ ID NO: 55789 - DNA, 595 bp, Triticum aestivum
  Clone ID: PAT_TA_55789
ttttagagcaaaccaaataggtgccgcttattcaagcttgagtacgtacacggcatttatttagtcccagtacatatccgggatatacatgaccccgtacgtatgctgtatgcagcaaacttgtcttactcacttattagcggatcgaatccaccacttagttagtggttggcgacgagctgctgcgcctgggtctcatacttgaacaggtaggggctcatcttagagctatccgccgaaaagatgaagatccccggcagcttgccctgccgctggagctccttggcgccgctgatgccttgatccggcgagagcaggccggtgacgttgccggtcttgaagctggcgagcagcttggtgccgccggagccggggtagttgcgcgcctgctcgtcgtagaactgcacgtagtactggacgacggtgttggcgccgtagccgtagaactggaagttgacgtagtcgatgaccccggagtacttcctccacagagcctggtagtacttctggttgaccgggagctcgtagggcgcgatggaggtgcggatgttggggaagcgggccttgagctgggtgagcaggcggccgatgccct

SEQ ID NO: 55790 - DNA, 514 bp, Triticum aestivum
  Clone ID: PAT_TA_55790
ttttgaacacaataaagggacctacacactttgcttaatttgaaggggccattgccaagcggtacatacaccttactatgatagcgcattttacacttcagacggctatatacaaacgaaagcatatctgctacaaaccgatctactgctacaacattaaaagcggacacctcgacaagggaacatgttaagggcggactatttgccctcacctgggctggctacataattccaaataaggccgggaccaacccggacatattattgcccttgcccttctttttgctacgatacacgtaagaagagctaggctccatgcccacgtgcattccttatacttagttaccagcttcaggaccatggttgcggataactacaaccccgttaggtgccgacaatcttcttggctaccatcatgagcacccagatttaggcacctatgcaccgtggattgccgtcttaggtgaggaccctcgaggggatggactgatacatgtggctccctcctgttgtc

SEQ ID NO: 55791 - DNA, 610 bp, Triticum aestivum
  Clone ID: PAT_TA_55791
ctttttctttttatgtggggaatttaattttaccactcattcacatatttttgaggaaagagttcacaaaggcttgcttactaagcaaaacctcatcatgtgaagcattgacatatacaaacaactctgggaaagtaccggcctcatataatggaatgcaattcacaacactggtctatgaaagtgcaaggagaccggctcctatctaaggaagtcatcacctggaggccaacgaaaaggcaattcccagaaccaaaaacaaaggtgaacacacagggtttggcggattacttgctattctgctagccttatgccctcaacatgctcctggggttttgtgcccaacttggatcaagagccactctgtagcggaccaacttgttctcaagtactaagagctataggatggccgcccaaattctcaacgttcttccgggtgatctgaagcctgcaaggggcggtctgcactgcggttgctctttgaggtgctagatggagtttaccggttgcttgcttattctaccccatgcatacaacattaagttgcctgcgaacaataacaggattgacttcagattgcatttatacttgccccatgtgatgttgatgc

SEQ ID NO: 55792 - DNA, 618 bp, Triticum aestivum
  Clone ID: PAT_TA_55792
ttttgaagctattgggacactatatagtggggtagataagagaatttgcagaaactttacatagcacccaaagcttttattcacccagagggattattcagccaccctcctgtgtgaaatttatgggggcctggcatacttatagaacaatccgacgggtttcagcacacaacttatacagcaatctcagactgcaacagctgaaaagaattggacaactgattctacacacaggtaattttgtgggcagtttctcagaatccgattctccagaatcggcaggtgaaaagaactaaccgataccctagggaactcatccatcaaaggcttgattttgctgaggaacccataacgatcatcactttaccgaccggtttcctatctctcaagtgcagcaaaagcgagatgggcctcagcgagcctgtaggtctgtgaaagtttaactgttatcaaaccctttgaaagccatgacaggagttcgttaagtgagtcaatgagtactgctggccggtgagttaagtagcttccccagtacagaccatgaattgtgcagttcttaataagtgcaatattagctcgaataactggaacatccccactagcaaatccaatgagcag

SEQ ID NO: 55793 - DNA, 149 bp, Triticum aestivum
  Clone ID: PAT_TA_55793
gattacaaaatcattcattcatcaatcatctgctatcagtatccgagcatggttgctcagctgaagaaacaattggtcatacacactagactacagttgatgttcatccacaagccaacaataccaaaacaaaatcactatgtatttgg

SEQ ID NO: 55794 - DNA, 637 bp, Triticum aestivum
  Clone ID: PAT_TA_55794
ttcatccccctctccggcgagggcaccgcaccatctttatatcattagattagtggtactagtttgagtttcaattacccgcacgcaaagcactctctatcactctatctcataccatcttcgtatcgctactaatagttccgtatcgaagcaagcttgctgttcttgtgctgcagaagggttggtcctttgaatttggctgtcggagatgacggtgacaccgcagatcacggtgagcgacgggaggctggcggtgcgcggccggacggtgctgtccggcgtgccggacaacatcgccgcggcgcacgctgcgggggctgggctcgtcgacggggccttcgtcggcgccacggccgccgaggccaagagccaccacgtcttcaccttcggaactctccgcgattgccgattcatgtgcctgttccggttcaagctgtggtggatgacgcagcgcatgggcacctccggccgcgacgtcccgctggagacccaattcatcctcatcgaggtccctgccgccgccggcaacgacgacgacgactcggacggcgacagcgagccggtgtacctggtgatgctgccgctgctggaggggcagttccgcacggtgctccagggcaacgaccaagacgagctc

SEQ ID NO: 55795 - DNA, 511 bp, Triticum aestivum
  Clone ID: PAT_TA_55795
aggaccacggccgtacgccggagatactggaccaagggagtgcagactagctgtctaggtacaactgcgaacatggccaccggagtacggacgtacggtgcgcttggtccctcctctgttgcccctgcaggtccgtacgtgatcgctcggacagcacggtggcttgatgcatgacaggcgacgtgctcaagctcgtggtggcatcgcgacaacatgaagccctgcatgtctcttgcctacttcataatggcatgacacttaactcgaatgaagcgtacgtgcttgatgaaaaaaatcagggccgtaatgtataccagacccagtacaaggggatcttgcaacgggaacccgctctcttgcgagacgctgcgctagggcaatttagttgccggtgcagtctaaaccttctacacggccatactcagcgagttctactacataagctactgcaaatcaccggatgccgccagcggggctccatacggagggtccagcatcggaatgggccctt

SEQ ID NO: 55796 - DNA, 476 bp, Triticum aestivum
  unsure (1)..(476): unsure at all n locations
  Clone ID: PAT_TA_55796
aacagaaatatcgcccgcttcaacaaggggggtgataaacacaattccatcacataagttgcagcaccgtacacgttgtatgataatcaaatccactcgatggtgaaactacattggtctgatgataattactaatgcagctagaggcagaacgcgggacatctatggctcgacggtagtcacttgctgccattcaccgaacctaggcctcccaaagtccacaatcgccagcgcttctcaggatggaaccgtcgtcatctggaccgcaccgaaggaaggtgagcagtgggaaggcagggtcctcaatgatttcagaacccctgtttggaggctgtcgtggtcgctgacgggcaacatcctggcggtctccggtggcngccccactgtgaccctctggtaaagagcccgttgacggtgaatgggagcaagtgactaccgtcgagccatagatggcccgcggttctgcctctggctgc

SEQ ID NO: 55797 - DNA, 176 bp, Triticum aestivum
  unsure (1)..(176): unsure at all n locations
  Clone ID: PAT_TA_55797
gggtgggagcggggnagcagtccgtcgtcggcctgtcgtcctccgcgacgtgtgtgtttgtgtttcaggcctcggatcgagaagnagttgtcctatcgattagcctactttcatccccgttggtttaacttgtctgcaactggaaattgcttaaacttctctgctaagtgctgctg

SEQ ID NO: 55798 - DNA, 526 bp, Triticum aestivum
  unsure (1)..(526): unsure at all n locations
  Clone ID: PAT_TA_55798
ttccgggttcgggcttcggttcgtgggtagaggcgcgagtgagctgagcctagatctagaggttgtcggtagagaaggaagggnagcatccactggcggnagaccggagtaccnnngctgctgtcgtgggccggccctcgtcctggtgccacnncgacgacaacaacactccagctaggccttcagccagtacggcgaggatcctgggcgccgagatcatcaacgaccgcgagacggggaggtcccgtgggttcggcttcgtcacgttcggcagcgaggagtcgatgcgccaggccatcgaggagatgaacggtaaggagctcgacgggcgcaacatcaccgtcaacgaggcccagtcccgccgctccggcggtgggggcggcggcggcggctacggtggccagcgcggcggtggcggaggctacggcggtggcggtggcggctacgggggccagggcggcggtggttacggccagggcggctgtggcggctccggacagggcggcggtggctacggtggtcactg

SEQ ID NO: 55799 - DNA, 650 bp, Triticum aestivum
  unsure (1)..(650): unsure at all n locations
  Clone ID: PAT_TA_55799
gngaccccctccaacgcggcctcccgtccccccttcatcaacctcatctcctctgggagaggaggccacggcgccatcaccatcgccaccctggacatggacgtagacatgggggtggaggcggcgcagatgggcgcggaaccggcggcgcacgggcggctgctgtgggcgactgacggcgagcggaggtacatcagctatgatgcgctgcggggggatgccatgctgtgctcccggccaggggtgccctactacaactgccgcatcagcaccaccgccaacccctacaccggcggctgcgagtccatcacccgctgccgcgacgacgacccttcctaggtggtccgacggttcaagcgtcctgtggatgtatcagagaaggaaattgatgccgcgggagatggcgatgtgttggtcattttggatctcagagccgatcaatcattgatcgaagctggagtggctcgagaggttgtaaacagaatccagaaattacgggagactgctcagcttgaacctacagacttaattgatgtttactacgagtctgcagacaacagcagcaatacacttgaagaaattttgcagtcacaggatcagtatattagggacgtgcttggtnattcactagttccaaaggcagtagcaac

SEQ ID NO: 55800 - DNA, 528 bp, Triticum aestivum
  Clone ID: PAT_TA_55800
tccggtacgacaagggctccgagctggctcagagaagattggaaaggaagctgtgacgagcagtgcctccataggcgggggtagtaagtactcagtaacgacttggctcatgtagcggcacaaggcatgaggacattcgggcgtcctgcggtggccaagcgggggctcaagctgtactaagtgctggagctggccaacttgcataaaggtcgtcgttagggtgcccaccaagcgctacttgttctaacctaccgcagccggacgaggggagaaatcctatctgtttttgcctatgggtagtacgtaaaaagtaagggcttgtgctgcatgtttttgtatactatctggctgtatacctaattgtgaaaagggatatcgataacttgctgctgctgctgctgacttcgttgtatactacctctctgtggtgattacacggcctatcttttttgttgggctctaatgtgcacgaaaaaactggtgtagagaatggaattaatagcctgtttgttacaaacctgcacaaaa

SEQ ID NO: 55801 - DNA, 660 bp, Triticum aestivum
  unsure (1)..(660): unsure at all n locations
  Clone ID: PAT_TA_55801
gcagnacaggatggggattccgagtgattccagtgcttctaatgcttctgccgtttgcgataacgctgcagattccagttgtgaacaccagaatgtttgatcaaagttttttttgttcttgtccaagaaattaatctggaaaagttccgcgtagcaaaaccaaaaagaactttcttggcgacctattatacacatagataaacaattagtgccatctgaattttgtggcttaattttaaacaacacaattacagatcagatccgtgaaacacgcttcaaatttgaactcgactaatttcaaccgccaaccggagctggagattgctgccatcacaccctttcaactgttcataataactgaaactcaaacaagtaacactgttaacaaaacatccaagttcagtgcgtttagggattattacgtgcctgctgtagctgaagcgccgtagttgataattgtggtggcataataacagtttcacttgatcaggtgttcagtatgcaccacagatgggaggtgttcagaggggacagcaccagctcaggcgacctgctcttcagcgtgaagacaacttcgctgatccaactcaagacggagatggatgtcttcttggnccggaacaccgcgcagcaggtctgcgacttcaagatcaaggcagc

SEQ ID NO: 55802 - DNA, 594 bp, Triticum aestivum
  Clone ID: PAT_TA_55802
ttttcaaccaccggaaaacaggattcctttattcgacatgaggagaaaagaaaccaaatcagcaagatgacaaccacatcatcatcaaacagatatggaattcaaattcagaacgattttatgagagcgaccaaatcactgaggtgcgtgtgggacgacccgcgctcgttgatgccatcctccgcggccatcttcagccccttcatcctctccccgatctcccgcccctccccgctgtccatcatcctctcaatggcggccttgatactcgctctctccagccgatgcgtgccgtcgacctccacgcccaccttccacacgtcggccacgtacctggcgttgccgtactggtcgccgtgcagcgggtggcagatcatcggcacgccctccgcgatcgcctccaccgtggagttccagccgctgtgcgtgaagaaggcgcccaccgccgggtgcgccagcacctcctcctgcggcgcccagctcacgatcatgccgcgcccgcgcagctcctccccgagcccgtcgggcagctcgccggactcgaacccgcggatgagcttgggccggacgacccacacgaacggccgcttgctc

SEQ ID NO: 55803 - DNA, 593 bp, Triticum aestivum
  unsure (1)..(593): unsure at all n locations
  Clone ID: PAT_TA_55803
ttttgcctccaatccaactcttatttttattcttgtcacggatcagcgatccacatgcatttctgtatcccttatgttcaaaagatagggcagttcaagtctatatcacaaaagtcgtttctctagaattccagcattcggcccctcaggatggcctccgcctttctgacttccttcactggtccaatgatgaacaccctatctggaggtccctttgcaccaccgatatggatttcaacattgcaagattctttcacagccattattgatgatccttttctgccaataacacgacccatttttccaggaggcacatctaagagcgaaaggatatccacttcaggaacacaagcttcagcttcaatgtcatagtatagctcacttcgtactgccagacgccatgaagatactttgcttaacttctccatcattttctcatgtatattgagaaggaagcgcacatcatctgtcgctgctcgaatcatcatttcagacaagggcctatttttccagaaatttgggtcctgccttanaagggtgcggacttcttccttttcaggatatggcattccacaataacgaggatcggcaag

SEQ ID NO: 55804 - DNA, 592 bp, Triticum aestivum
  Clone ID: PAT_TA_55804
ttttagacggtaatacctgagaacaatttcatgtatgtctggtataatactaattaaccagatcaatctgaaagagccagaacatatttgacatcaacatgaatctcatgcatcacggtatgcttgtattggtgctgaggccatctcgtgcaccacgagcttctcgacggtaagggcggacccggtggcgttgttgaaaacgcacaccctaccagccgcatggatggcctccatagggtacacgcgcgatgtcaccgtcatccttccacccatcacaaagctctccacaatcgaatgatccacaagcacccttgcggataaagcctctccatggagcacgggcacggtgcttcccaccacgcgcttcagcagttccttggctcgcgatgaccctgactcatcatggcagaactgggtccggaggcccccatcaagacccttgtaaatgtagaagtacactgccagttgttcgctgccgctgttggtggcatggatgagaagaccaaagggccgagcgtgccgcgttcggtggcaccaccacttgtactacaattgtagctgacatcggcctcgttgagggcggcgatggctg

SEQ ID NO: 55805 - DNA, 605 bp, Triticum aestivum
  Clone ID: PAT_TA_55805
tttttcgttaactggctcgcgcgcactgcaaaaatggcaccagtctacttgtttgttgatgatacaagaaattttacaacaatcatgatattttgctttgcttccacttgagctaactttatgtacatgtaagaaagctatgtatcagcaactgctatatgtacaacactacagcggcctgaagcctccctgcattttgtttcaggaatgtttgccacgaacccaccgctagtgagaagcacaaaaagttccttagcgtgcaaaccacgagcaaccatgttattggatgacgcgcagccaacgagcctaagccttctgacattacacctctgcgtatactacattgagcatcaaaaagcagaagcgggctccggtgtatgtataacattctgcggcagctcctcagcggggtcacaaagatggaagattggcttagaaatgtcctcactcctatccttttatagtagacatacttgccttttccttttccattttcttcttctcagcttccacagttcgagcattttcatcacgtgatttcttgaacatattcacgaaaataaccaaaatcgacgtaactgagaacagaaaagcaagaaagcatc

SEQ ID NO: 55806 - DNA, 578 bp, Triticum aestivum
  Clone ID: PAT_TA_55806
ggggggggtgggggggggggaacatcacaacatctgactttattatcgggcaaatgaaaggaatttttctctacacacgacgcacacacaccgaatgcccatcgggacccgtactgcacccacgcattatcaccttattattatcaagatcaggggggggggggcaccggcttaacacccacagtgcccagtatctagtgtccggggcaagcaagcaagccagcagagctggaggtcctaacctggagatgctgttggggatacccctggccatggagcccctttgtctgtcccttgtggggagaggtgccggggtaaaccaacctgtgggggaacttgaccctacccgtgcggttcttgagccacgggtgacacgttcatggccaccacctgcttctcgatgcccttcagcctgatccacaacctcctgaacgcctgctgcaccttgaggttcgacatacactccgtcgtgcctggctgccccatgtacacctcggctgcagagtgcctgaacaggatcttcatcaccgagatgcccaccagctcctgaaactggctggcgatggtgaggatgaatg

SEQ ID NO: 55807 - DNA, 513 bp, Triticum aestivum
  unsure (1)..(513): unsure at all n locations
  Clone ID: PAT_TA_55807
ntttttaaaaaggcttgtagcccgacacgctatttattgcattctcacacaagcgttttggagcacatacaagccaaacaaaaaagcgccgccgcgtggtcaccaccgtaggttgccaatacaacggcaggcagcaccaccagcagcaacgtgtggaaatccctgtttacaattaggtttccctaccgatcggatgcatgaggaggagaacacgcccttactttttacgtgctacccatgggcgagaaccacataagagtcctgcccttctacggctgggggaggctagaaaaaagagcgcttggtggtcaccctgacgacgggcttaatgaagttacccagctccagactcttgaacgagtttgagcccccggttggcctcctccgacgcccgtttctaatncgccttgggccgtgccttggccacatacttctgcgtcttctcacagacttggcacgctgatcgaccaggttgctctcaatgttattgagcctaaccgaggccttgtggac

SEQ ID NO: 55808 - DNA, 619 bp, Triticum aestivum
  Clone ID: PAT_TA_55808
gccgccgtacttgccgagcgtggcctcggagttgcccttgcaccgcgcgaggaaggtggcctgcgcgtcggcgacgttctccttcttgccggcccacttcttgatggtgctctgctgcagcgcccggccgaaggagaaggtgagcgtccagggcttgagcaccggcagcttgttcatggcatccaggttctgcgtcgcctgctcctcgctctgcccgcccgacaggaacaccaccccgggcaccgccggcggcaccgtgcgccgcagcgccgccaccgtgtactccgctatcacctccgcgccaaccttggggctgtcggagccgggggtgaccatgttgggcttgaggagggtgccctcgaggagcaccttgtggtcgttgagcgacttgtagacggcggcgaggacgcgctcggtggcggcggcgcaggccttgatgtcgtgcggcccgtcggtgaggatctcgggctccacgatggggaccagcccgttctcctggcagatgagcgcgtaccgggccagcccctcggcgttctgcttcacggcgagctcggacggctcggcgccgggcccgatcttgagcacggcgcgccacttggcgaagcgcgcgccggcctcg

SEQ ID NO: 55809 - DNA, 622 bp, Triticum aestivum
  unsure (1)..(622): unsure at all n locations
  Clone ID: PAT_TA_55809
gtcgccatgcacgcgctacgctaatcttggaaggncctctataaacggcgcgccgctttttttctttttttttattttttttttttttattttttttttttttttttttttttttttttttttttttttttttttttttttttttttttttttttttttttttttttttttttttttttttttttaaaaaaaaaccgggggtgggttttttttcccaaaggtggaacaaaaaaaggggggggtctaaaaagaaggggggggggatttttttttttaaccggtacaaagcccaaaccagggggaaaaaaaaaagggggtaaaaatttaaggacaaagggtttttttttttaagttggcccccaaaaacccaaagggggcaagggggggggaccaattgggggggggggaaaaattgcacactggggggaggggctgaagggctaatttccttatttccccaaatggggggagttggggaggtgggaaaaaaccccgggcccgggggttttgctaaaaaggggggaaggggccccggcccaagggaaattgtgcctaaggggggggaaaggaaacccgccccaacgggggggggggtggttggtgttgttgttggtgttggggt

SEQ ID NO: 55810 - DNA, 579 bp, Triticum aestivum
  Clone ID: PAT_TA_55810
ttttgtcatccatcatccaacgcacttttctcacgaacaacatcgcaccatgcatacatcactgacaagtttgtctaaaaaatacatcactgacaataattttagactgtgcattgttactactagagataaagtgtgtgataatagcagagaaccagagaccaaagtagaccgtgagcagtgccgacagctacatcggcggtcactcggttgttgtggcggcggcggcggccttgtcgagcgtgttggcgatgtcgatgaccaatcgatacctgacgtcggccttggcaaggcgctccatggccgtgttcacgtactccgcgccgatcacctcgatgtctgccgtcacaccgtgcttcgccgcgaggtctagcatctcctgggtgtccctcatgccgccgatgcagctcccggccagggtcttgttcctggcaaccagagcaaatggagggacctcgataggcttctctgggaggccgaccatgaccatcttgccgttgggcttgagtagcccgaagagaggggccatgggaatgtttgcagacaccgtgtttatgatgccatccatggtgctcatcg

SEQ ID NO: 55811 - DNA, 495 bp, Triticum aestivum
  Clone ID: PAT_TA_55811
tttttgggagagaacaatgtctcatacatctaaaaaaggccgagcctacactgactaaatccggactaccttctgggtaaaactgactatagagggggtgtatactggcccaagcgtctttaatatggaataacacgggactggggggacctatggttttaccgatacagacctaaaaaatgactgggcgaccggtccaggaaaccgaacaacaccgggcgtgatactggactcaaaaagcctacttgatgcgcctatagacatctatagacccgaccagactcaactcagcacatatgttctgtatgccataccaaaacacactaaactgacgccaatgcatggatggcacgacaaacgggaaaccccgcgtgcttctaaagagatggaattggaaccagctgatactaccaccagctgaacctacatgaatgatagactcctctctacccaacagggaagccgaggcctgcagaaaccatatgggcctgacat

SEQ ID NO: 55812 - DNA, 562 bp, Triticum aestivum
  unsure (1)..(562): unsure at all n locations
  Clone ID: PAT_TA_55812
cctcctttccccaacccanaccaggagcgccctctctcccccgccccctccccccaggaaaaccagccatgaagggggccaaatccaagggggcgccgccaagggccgacnngccaagttggnncggtgaagaagcaagggggnngcggagaaagctcggctcgccaagggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagctatgaggacgaggacgatga

SEQ ID NO: 55813 - DNA, 622 bp, Triticum aestivum
  unsure (1)..(622): unsure at all n locations
  Clone ID: PAT_TA_55813
gcgcagtgcacactacgattactctgcacgcgatcaacatcccaatcttctgtcacatgnatgtctggtaccaagctagcgggcagcgacactgggtggaccgggcactcgcccggcgacgggcctcgacaagctacgccgggccggcgccacccaacccatcgccatcaacacagatgcaggggatgcgaataagcagtcgacggcgatgccgacgaccctgaccacgccggtgacggcgtcgtcttccacgccgccgagcggaggaagtgtttggccgagcgttatccacccggggagcaacctggccaccaagagcctgggcgccaacctcttggtccggccgcagcccaacgtccatccacgtctacgactggctttacaggcacgagacgaggacatggagcaaccaccgctaaataagagcctgctgccagagaactgaatgcagggtgctcaacaacttgtgcgacgccgtcatgtttgctgctcttttggttatttaatcctgcgtagcgtacgttggttttccaggctgcatgtggagttgtcttcaactttgtactactgattactagtgcttgtaactatatttacttggctcggcatgctagatgcatgc

SEQ ID NO: 55814 - DNA, 644 bp, Triticum aestivum
  unsure (1)..(644): unsure at all n locations
  Clone ID: PAT_TA_55814
ngaccagnacgggnaggagagagcggcggcgaagaggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcanggcccgagagatcatgcaccagcaccagcggctgcagctcccgctcaggcagcagcggcacc

SEQ ID NO: 55815 - DNA, 567 bp, Triticum aestivum
  unsure (1)..(567): unsure at all n locations
  Clone ID: PAT_TA_55815
cacccaccgagttgaccccacaaaaccccagctcgagcacccggnaccatggccctcctcgccacgaccccactcctcgcgccgctcgccctctccccggccccgatctccgcctcccagagctccctcctcttcctgcgcgcccccgccccagccctcctctcgctccgctccgcctcccccggcgcccgcctcctcgcggccgttgcgtccaaggagcccgagctcggcggcggcggatcgggaggcggtgacggcgcaggatctgggggcggaggcggcggtggaagtgacccgcaggggggcggggacgagggggaggacgagaagatgggtgaggggctctccatgtcgcagaagctcaccctcgcctacgccgcgctcgtcggagctggtggagtaatgggttacatgaagagcggaagtcagaaatcactggctgcaggaggcatatcagccctggtgctgttcttcgttcacactcaactcccagtgagaccagtctttgcgtcggcgatcgggttaggtatatcggctgcactgctgtcagtcatgggatctcgcttc

SEQ ID NO: 55816 - DNA, 656 bp, Triticum aestivum
  Clone ID: PAT_TA_55816
tccgggccgtggccgtggcgcggcgtgacaggggagctggttcggacgaggatgaagtgcggtgacggcagcgaggtgttggtccgcgcgggagggcggtacggcgagacgggcggctacggcggctacgagggctgcgacgctgccgtcacgccggtgctgggcgcgcacggcaaggcgagacgcgagcgactacgagcggctcatcaactatggcttcctcctgacatggaagcccccgcggggcagtaaaaagacgacaagaatgttcataatatgtgagtccaatcaactatcaagctgctcggcccatctagtccttcggttcttaattccttgctccaaattatagcataatatggagaataagggggcaaaatctcatgatgaagaattaatcagatcccttggttgcttcatgttgctaatgcgttatatttgttgtgaacagttggatcattaggcggtcttgctgcattaacggtgttcgtcttctatctcttgcaccaacgaaagaggaaacgagctgtagcttcagacgagttgatgcgaagtggatcttcaatgacgtcatacagtaaagaccttgagctgggtggttcgcctcatatcttcactttcgaggaacttgaagtagctactgatggatttagtgc

SEQ ID NO: 55817 - DNA, 521 bp, Triticum aestivum
  unsure (1)..(521): unsure at all n locations
  Clone ID: PAT_TA_55817
actgttctctacgcgaccgagccctacccttccttgtatataccacacccaaatctgctcttttgtttccctatcatggatgtttgcacngattcctatccgagaccaccactaaattatagtatacctgtgcggtctgaacttctgccgttcatccggtcataagtgcggctctagatcatacctggatccttatgaggaaagaacatagctcctccgcgtgttgtatataccacgcgtgacgaacggactaactgggtccctacgcagaggacatgggtttgtgttaagacgaacccccctgatgatgccttgaactcagcgtagccaccacaggacgttactaagaatccaactactgatgacgctcctgttcgtgcagcaaagggcccatactctacacacccacaaacagagcctctgttaccacaattgcttcaaccaatcgtcccgtgcaacagcaaccgatatccccatacttcctttgaatactgtgcacgctgctgatccgttcaaccaaa

SEQ ID NO: 55818 - DNA, 493 bp, Triticum aestivum
  unsure (1)..(493): unsure at all n locations
  Clone ID: PAT_TA_55818
gggtatttccaaggnncggcgtnnggcagcacttgtggnacnngacatcagcatgnaccagnnatcagtgnntttgttggctttttggnntctgctactttacaacnnttgcacannnataagtgnncaatcggnatttaaatgacacannnacgtgcacannnatagctanncttgatatgnnnagcttgtgnngagaaacnnttgaggaaacnnaaggttaataggatgcantttcagtangagctttgatcgtgcangattttctntgaattaaagcctactgataaagctaaggtttctatgggtgaaaggggttgtaccaatttacaggacccaaagtggcagaagattctacagctgcgtaaaccatcaggtacttcgtgagtgatgatcaatcaattcgaagaaccacttgcttcggcactgttattgcccaactatgtattataccactggctaccaagccgttttagtgaatttctatttgacc

SEQ ID NO: 55819 - DNA, 608 bp, Triticum aestivum
  Clone ID: PAT_TA_55819
ccccattcttcagtactctttcccgtcggccttctgccatagcgcaacccacgcgcaactgccgcatcaggcacgtacacgggccgttccgcacgtcacaggggcagggaaccttaaaccgaggtacgttcggccgttgtctgcatgcctccaaaaagccaagatctgccggcgcctggggcaggcgtgttggcctgattgcgctggtcatggggccgccacagagcggaactacttggggctgtgagctggcgcggcctggggcgagccacggcatctgaggcatggggcgtcaggtgtaccgatgacgctgcatggagacgggggtggagcggcgtcggaggcgccggtgcacgctggagcttctgccgagggctgggttaactgctgattgctgtgctcgttggcggtggaagtaggacgagatgaagatggcgcatccgccggccgtcaagggacaggtggtaggatggccaccagtgcgcagttacgagaagaacaccatggggatcatattatgtgctcccaaaatcaagtacgaggccgactcgaggcagacaccagcaccggattggctttatgtcaatgctagcatggatggtgcttct

SEQ ID NO: 55820 - DNA, 439 bp, Triticum aestivum
  Clone ID: PAT_TA_55820
gacatcgcttcacatggttcaagacaaacaccagcaccacactatctccacccacaggactggcacgcctgctaccccgcctctgacagaaggcctctttacatacaggcactcgaccgatacaggggggggcgcggaccggaaacaggctgatttccatcggctcacccaaggggataatcaccacacgcacaaggcgcacctaggccagatgccgcctccgtcttctgaacctaatccctctacgagacgcacgcagagagataaggacccagaccacgctcgctcacacaaaaacaaagaggaggtggcctcctatggatccaacctcacctacgccttcatgctacaccatcacctctatatgaagcaagaccacatagaagccaatgaggccagctgtacagaagaagcacctccactaacgctagatcacccc

SEQ ID NO: 55821 - DNA, 561 bp, Triticum aestivum
  unsure (1)..(561): unsure at all n locations
  Clone ID: PAT_TA_55821
ctcaggggnaanaagggaagagtggggagcggagctcagctcacttcagcgggagctctactcatggccatggcgacctccaccttctccccgcacccgctctcgctcaagccccagctcggccccaggccccaccgcctccacctcgcccccttcccgcgcctccgctcccaccgccggctcgccgccgccggggaggcccccgtcgaggcgccgcccaagcccgcggaggcggatccctcccccgccgcgtccaacggatccgcggcagccgcacccgccgctgccgctcccgctgctccggtcgccgcggccaaggccgaggcggtggcgtcgcccaagttccaggactcgaggtgggtcaacgggacctgggacctcagccggttcggcaacaccggcggtgccgtcgactgggacgccgtcatagacgccgaggccaggaggaggaaatggctggaagattccccggaggcaaatagcagttaaatacgccgttgggttcgacactttgattattccatggtgggcatggatcaagcgggttcatgttcctggagc

SEQ ID NO: 55822 - DNA, 374 bp, Triticum aestivum
  Clone ID: PAT_TA_55822
gccgggccggcaatcccgggtcggaccagcgtccggggccaaccaaggtaattgattggggatacgctaatgacacggcttgcagccaggcagaggacgtgccagagattgactggtgtgagccaggcgaggcggctgtaatgagtagcacttctgggtaccaaggatgggttcctaacggagaggatcaagagctatgtatttgaccggaattattccacaaagccaacggtattgttcggtctcttttcctacctgcattctgggcatattccagcacaaagatgctctctcgaggctaaaaaacgtctgcatcttactgccaagtcagtggatgctctattggaggagctgataataaggacagagctagc

SEQ ID NO: 55823 - DNA, 547 bp, Triticum aestivum
  unsure (1)..(547): unsure at all n locations
  Clone ID: PAT_TA_55823
gcgtggtttttgtgggttttttttttttttgcaacccaaaaccagatttatttctatatagacaccaaaaaccaaccaaacaatacactaactttgagggggatcatcatccttgtgagggggaccacaccaattcatcancatccagacccggggggggagaaagaaaaaggggaaaaatgccaagggggcctaccagaccgagtgcctggggttccctgaatgcgtggacttggtctcaacctctaggttgacggagaccggggctctcccacgtgtccgagcccgcgctgttctcaccgctgctcaccttgccggaccacaggttgctcaacatcttcctcggcatctgcagcggccccttgggagtcgccttgccgcccttccctccggtcttgttgttgcccaggccgctcatggaccggaacgagctggtgtcacctgacgccggcgccccccccccccactgggcatcctctgtcctcctctccctcgtggcaaacctacctgggagctgccatacgaggtgccgttctctctggggagt

SEQ ID NO: 55824 - DNA, 488 bp, Triticum aestivum
  Clone ID: PAT_TA_55824
ggcgggggggggggttgttttttttttttcctttttttttttttttcttttttttttttttctttgttgttttttttttttttttaaaaaaaagcaaccagctctttaggggggatttagactatccaaatggggttcaaaattaggcatagcggcggggcgggggcatacaaactctcacccgggggggtatctaaatgtggcaactctttcacccgaatgtagccttgcatgagggcatgtacccctggcctaaaactgtaagagccacagcatcgggtgcacaagcgagctgcatcaaatcacatccacacctgaactgaaaataaacaggggccccacctcagattcggtaaccaaaggagcagccaaattcgggcggatctacaaagaagcagcaccccccgctcgcggtgacttgaactcgggtcttgatcccgggcgggggatccttagcctggcctgggcgctcggaaacccggcggata

SEQ ID NO: 55825 - DNA, 612 bp, Triticum aestivum
  unsure (1)..(612): unsure at all n locations
  Clone ID: PAT_TA_55825
ttttggtaccatattcagagctacatttcgaatttttatttgtacatcatgcatgtggtttatccgaaggggtgatcccacnngattctatgcaacctcataaaacacaaaaggacacatgttcatgttaagacctttatgtccatcatcttcttggtcgtcgttactattatagtcattattattgttgttgttgttcttgttgttacaatttatttgtggggaacgccattgcccgtcttgttctaagagaaaacaaaggaacactatctcttgtttcctcacaagatacccttgcctgtctttttcattcacgtggatgtgtgcaccaccttcagaaacgaaattgatcgttccaagagggatttcattgctctctcttaggagacatgctccagctgccacaacttgccatcctattttgatccaaagggctcgtgagcatggtcgtcttccgtaacaggttggccctagcaccctggatcagacgcgctgggagcttgtagcttgtcctggtcatactgctatcctgtagatgatattcacagccaaggaagatacatggggccagccttgcatgtgtgcttgcttcaccggtacatgcatcaccat

SEQ ID NO: 55826 - DNA, 455 bp, Triticum aestivum
  Clone ID: PAT_TA_55826
gttgcttttttaagcgcaacagggtgcttgaaacttgtgatctaagattaccattcagggtgatacctctcaaacttattgaatggacacaatggcgaccatcctgcttgaataaatttactgagacattatctagagtagatcgcctatgtgacacgacagccagccatatacactaaccaaagggccgaaacacacaactgatctgactgcgagtggtttgagacccaaaaacagaaccagagctgatatgcctactgcagacggggatttgtgactcgcgctgtctgtgtaacccattactagctccagcctactaccagggcggtgaccgcgagggttagcctatgaaacatgggacagcccctcacccttgttatatttctcccgatttttccaagccagatgcggtgaactacaaccgcggactccgtctacatatcctgagcggcgac

SEQ ID NO: 55827 - DNA, 569 bp, Triticum aestivum
  Clone ID: PAT_TA_55827
tttttgttgattataatagagatagatagatagataacaaagtgctagcagcacctcgagcgttcggggtgaaaaacacacaaatctgggtcaaacttgtgtcacccaacagatatcttgatgcctatgtgtgtgtgtctcaaacacccagaagcactagataccaaggatcgcgggtgggggaccacgcacaggtgcttacttgccaccaccggtttccttcacagcgcagatctgtgcttcacccatgggggacatcacagacaggatcaggtccttgccatcagcaaatccagtcttgatctggccaagcagaacatcatcagtgggaagcttcaggtgatccttcgtgtggccactctcaggtagaaggcggacatatccatcatcagttatgtgaatcagctgataatcttggcggtcaacatgggggacgtcacaggtgtgggatgaaggaacgatatcctcaagcttctttccattaaagatgtcaatggcaacaaagtgacactttgcgtgaccatgcttcccagtcttggaggtggagacctcaacaaccttgcagggac

SEQ ID NO: 55828 - DNA, 608 bp, Triticum aestivum
  Clone ID: PAT_TA_55828
tttttgatgctgaatatctcaaccctatttcacattctcagattagggtagcaagtattctggttttaataattagagtgatatcagatttcgacctcggctcacggagaagagaacatggctcccttttagcagcactagcaccaagatgtaaaatgatgcttcaagaccttattctccccaagttgctcttgcattctgactgataatatcgtctgataaagtaacaacagtgcaaagaggagtacaaagagcattcaactattcacggcgactcatgtacgttttggcctacgttcggggtttgcggaattatgttgaactgggcgggcgatggtcccggaatacagaggaagagccaccggatgcagcaggggaaggcgacgatgctacaaagttggttgctggtaatgatgccgaggggtggtgtccctgatgcccagtacctgcgaagcgagacgggcttgctgtagagaaaggtgctgctggacttcttggagtgttgccagggttgtggttgcgagaaccgaatggagacctagcaaaagaggctgttgaaggggaaatactgtggacatgatgcaaggggcgtccaggagtgccctggt

SEQ ID NO: 55829 - DNA, 595 bp, Triticum aestivum
  Clone ID: PAT_TA_55829
cataccaaaacatgcatctccacggaaaggaaggcgcgcactctgatagaaaatggaaacaggtcacaaacatgtactgcatcaagttcaggcaaatgccacgggcacacatgatactgtccttgcagtcgccgctcagtctagctctttctctctctctttttcccggccgtcgatcaggcggcgtcctcgatgttgctcccgccgacgtcgacgacaaagcggtagcgcacgtcgttgcgctcgagcctctcgaacgcctggttaacgtagtccatcttgacgacctcgatctgcgaggtgagccccttgtcgacgcaaaactggagcacctcctccgtctcgtccatgctcccgatgaagctccccgtgatggtcttcctccccagcatcaccatgggggacacgaagctgagcggctccgcgatcacgcccatcagcaccagcttgccgtccatcttgagcagcgccaggtagggctccagcgggtgcttggcgaccttcacgcccatgtggcccacgcctcccaggcccatgatgccgccgcggaggccgggggtcatgagcccgaatgcttcagcgggctgtacactgt

SEQ ID NO: 55830 - DNA, 613 bp, Triticum aestivum
  Clone ID: PAT_TA_55830
ttttggtataaacgttcctactcctcaagggagccgcatagtatgtatttatattgaggccgaaagagccttgccgtagcgtacaagtccagagagaataccgatctggttcggtttaggagatagagatagctacgggagatgaaagagatagagataggtttgagattacatgagataaacggttcaaactctaacactaacaaggcggccaccgtaccctgtgataaaatgatagctctctcaacctcgtcattagcgcctgaaactttcaaatctcccacaacatcttcagccacctcctcccgttcccacttatcctcaccaagctgcacatcttccttcctaagtgtatcgcaactctaccttttatccaaaccaatgtcctgataattgccactctggttgctatcgggatcacctgcaacttccctgtcatccccaggttgttgtgctacaacactcatgtgtggagcagggctagtattggggggaacgctggtttgatctacagctcctacgttggctgcactgcttgcattgcctgctggagcatgaaatgtaacgtcctcgaagatctgctccttggtgcttgttgtggtggagtttgctt

SEQ ID NO: 55831 - DNA, 617 bp, Triticum aestivum
  Clone ID: PAT_TA_55831
atattgtactttcattaaaacattcattatcatgtcacaaactaatagtacacaaacgacatcatatggactaactggaactcatgtcatatatttgacatagccacacggcaccttaccaaccagggcaacaggcgtgcctggacgttcattcccagacagggggcatgctttgaccggggaaaagaccccaacctacgacaggttccacaggacgtatcaccacattagcttaacggaggccgcataagaaaacgggcgtggttactcttccagcgggtctaaccgagggcctgttcttgaggcggcggggacccttgccacgcagaccaccgaatcttttgctgcagaggcgagaccacccagcccacggtgctggcgcacaggctggcttagccagttgacccctggatcaacccggacagcgccttgagcaacctcaacaaagatgacctcgaagtactcggaggcggagtcctcattcacccataaacgcagttgccgacacgtaaaaccaccaagcctgcgcccagctgttttctcaccaacagacctgttgcccctatgaaacttgatttgggcaacacccccgtgcttgcgcttgccataaacaatac

SEQ ID NO: 55832 - DNA, 572 bp, Triticum aestivum
  Clone ID: PAT_TA_55832
aagaataataatgtttgctcttctttgtggatcatgcccacatcttttgcaccattcataaacaaaaatatccactaaccagacaaacattcataattcatatttcataccacagccaacaccacacagacagtgctcaacatgctaccaagtattctatacggaaaatcaatacgggttcacaacacctaaggggaccataaccatacaactacattgtccatctctacaacaaataatcatcaaaatgaaaaattaggcgaaatgtgcgaacaggggggggggggggggaatatggatacagaggggaaatgaaatggcttcctgtcatcacaatacaaacgctgctcgatgctcaagctcagttagagaggtgagtaacacaatggatccttccagctgtaggtaggtaggtaggtaggtaggtatacactttgatcacgatgcggcgaagcggctcgcaaacagccaggggcatcatgggcggaaaaattaagaagaataacacacaggaggttgatgattttcagcaaaaagatttatctgcagccatgaaacttcagctagttatc

SEQ ID NO: 55833 - DNA, 535 bp, Triticum aestivum
  Clone ID: PAT_TA_55833
gtagtacaagacatgtgtttgtcttttattcccatgtttgaactagtatagctcgggttcttacatgatgctgcatgtccctctattttttcaccgctccaacgaccaaaccatgggctaacaaaacggggggtcatatgtctactactagaggtcttctcttctcagttagcaccgaagaagccaactggagcaatggtgcaatatggagggatatagacattgcacattgcaggtagcgtctctagcgctagggtccttatttcctcaaactggggcagttgttgaggctggacagagccctgggcctgtgggttttgctgagatggctggaaggagccctggcctgatggatattgttgttgaggctgttggaaggagacctggctcaacgcttgccgatagctgctgttgttgttgttcttgttgttgttgatgcataatactctcatgaacaacattagtggatggcttggcaccagcgactgctcggtgatctggcacagctgctgacaacacaattgttgcaccagct

SEQ ID NO: 55834 - DNA, 455 bp, Triticum aestivum
  Clone ID: PAT_TA_55834
ttttgagcaaataaaaacactctttatatacgtactccctccgttccgaaattatgacgttttagaaaacgtcccgaccaggtgaaaagggaggaaagtacagaagtgcccctaatttaaatcgctattgccgtcgtcttcctcgccgagcagatcctctccatcccagtcgccgctgctgcttgcttcctgccgccagggtcgccccccatcccagggccgcccctctcccagggccacccccctgtcgcctgcgccaatccagccccctgtcgctggagggggcctcaccaactcgcctcgtcggagggggtgctgctgcagaccgttgtccccctcccaaggcctcgccagctccagagagtactgcttcagatcgaggtactgctcgccggagggggtactgcttcagatcggcagccccaggtccagatcgccgcgccctcccatgcagc

SEQ ID NO: 55835 - DNA, 601 bp, Triticum aestivum
  Clone ID: PAT_TA_55835
ttttacatctcactacttcacacatttccgaaatgtatacaaaaggacacaagcactacgtgatgaatacctcttatccacaaggtaatcactgatttgcttgatgagtagattttcatcccgtgttgtattatgaatgtcactgaacttttcgttgtcaagttcatagagtaagtccttgaaaacttttttgatatctgggttctgacccactgggacaaaagccacacgatcaaattgggctttgatcttctcatagactgctttggtgagtgttgtcttgcctagcccaccaacaccaacaatagagatggtcttcaattgctccttggaactcccgtcctcacaaatcagtgttttgataagctcatcccttgtgcagtcaacgccaacaagctcccctacatctttgtgcagagctaacacacgagggtcaatggtagcaccattgctagtgctacgcatgtcaagctcatactttttacgcagccccaccaactccgtggcaaggtcctgagcttctttgatggcactagagatttgatgaagtgctttgccattaccaaacaatttggtggtcttcttgaggaacttcttgaca

SEQ ID NO: 55836 - DNA, 553 bp, Triticum aestivum
  unsure (1)..(553): unsure at all n locations
  Clone ID: PAT_TA_55836
nacacatctatacaagtcattgctcttttgaggctacctagcaatctatgtctatgcactgaacagagatcaccactactgttttctgtataactagaaagatcgccacattatgaggaggaaggagcaataagagttattttcatgcttaacatgtccctatgacaactatcaaaccttgaatcacgctaacaaacgatctatgaacgacagggacataaactacaagagaaggtccgacacacggtcacacagcactgaaaaactaacaacattgtgcatggcgtcgataaggcactgatataggtgcgacaaagacagcatcaataatgcaacgaactatccctctggagatgctgtgctttgaggttccggcgctttaccaggtatattcactggacctgttgaatatgacagccatggactttccatagttgaacagactggctactaaaggggatatcttcatctctaatgccatagctctgttcacatcattggcggtggacgaggaccaaatcacatcagacaggagcgaaacataaaacgctcg

SEQ ID NO: 55837 - DNA, 397 bp, Triticum aestivum
  Clone ID: PAT_TA_55837
acaaagctagcaactaacctgatcgtttaacaaactgaacaagatgttactggcctgtcaattcaaattattcatggctactctgcggcactttgagcatatcttggggatacgtgctcctctaccatcctttcaggatcaattgaaataattcacgcacaacctgatctcgctgcacaccttgctgcttctgatttcgctcatctacagaggaggacctcatgcatctattggctcttcctatcttcacgagaggtgcatcaagcagcctgtttctcaactactttgctaaccgaaacccccgcctgtcgatctagattccggtgggactatgaaactggatttacttaacacaatgctgctagctcgccatatgctcgcatcacaatgattcacg

SEQ ID NO: 55838 - DNA, 460 bp, Triticum aestivum
  Clone ID: PAT_TA_55838
ggcgtagacaccctgctccccaacgagaggcctgagaagacacgtccagggataccgatgcgggggcacagatcaagcgacgaggccagccgagagcatcggtccaccgaactcgcccaggagccgctcgtagcgctgggatgatgagggccgtgggtgagccggaccagggagggatggcgaaggggtcgcaccctaagcctactcgacacgcgctcaccaccgatggccatcatgaagatcgtgcgaactctgctgcgccccaagacggggacgcgcctggggtaagaggatggaaaggcctcataacccgagaggacaacgcactggccgggtgcgacggcgaggcggtgctggcccacagtggatctggctggatggagagccacgcgtctcctcacaatggtactgcctccgggtctggtgcagaatcgtgaaccctgactcgtatgaccgaata

SEQ ID NO: 55839 - DNA, 643 bp, Triticum aestivum
  unsure (1)..(643): unsure at all n locations
  Clone ID: PAT_TA_55839
cggccgcgtgggtccatttgtcggactaatcgccgcagcgtgtgggcagctggatcaggtgctgcaggacagctgcaatggccatgtggttgcggctaaacacaagctcggtgacagctcctcaacacccctagtacaccagaacgggcacgcgcagaagcaagccaatggtggtgtagcaaatggaacctgccatgccaacggcaatggcagtacccatggttagcgtaccgtcggtttcgccaaggggatcatctcgcctgtcttctgtggtcctcatcgtcccgtcgactgcgacaaacggctgagcaacttatcagcagggccggcggccctacaagaagggcgacggtcagagcctaggaaaaaaatagaggactagcattttatacatgagcaccttgtatagtattaggttctgtgctgatatgcagccgaatgtttttgatccttgcgtctggactaaataataaggtagaccatcttagaaagtcttagtcttgtcgagacagagcctgggttgttgggtgtgtactttgatttcctttaagaaacttatggttactgtttcttcccagttaattccagtttctttctctgtttatagnttgtagagctaactaagataagcttctttgcattc

SEQ ID NO: 55840 - DNA, 613 bp, Triticum aestivum
  Clone ID: PAT_TA_55840
ggcgcctaacgtctctacaaggcaagctcgacgcccagcgccgtatcgccgtcaagcgcttcagccgctctgcctggcccgacccgcgccagttcatggaagaagctaagtctgttggccagctccggaacaaaagaatcgtaaatttgcttggttgttgctgtgaagccgatgaaagattgcttgttgctgagtacatgcccaatgacacactggcgaagcatctgttccattgggagtcacaggcaatggtatggcccatgagattacgggttgttctgtatcttgccgaggctttagactactgcataagcaaggagcgggctctctatcatgatcttaatgcctatagagttctgtttgatgatgactgcaaccctaggctttcatgtttcggcctaatgaagaacagtcgggatggcaaaagttacagcaccaatttggcattcactcctcctgaatatatgaggactggaagaattactccggaaagtgtcatatacagctttggcacattgttgttggatgttcttagtgggaagcatattcctcctagccatgctcttgatctgattcgtgatcgaaacttagtatgctcatagacttctgttta

SEQ ID NO: 55841 - DNA, 350 bp, Triticum aestivum
  unsure (1)..(350): unsure at all n locations
  Clone ID: PAT_TA_55841
gcaaacagcagcagctcccctctagggaggtntgccccggctcgctcctcccccaccgcccgcccccgtccccgcacacgccaccccatggaagcgccgccggggccggagcccatggcgctggacgcgccgcccccgctcgttttctccntcccnncccactctttctgggggggggggggggctttcgggggggaccctctcacnnncctcntggggggggggggccccgccggaagaacggccatccgcggaggtccttttgctgcttgggtgggcgggtggttggttctgggctgtgtggcgttgcgttcttgtcgttttgcttgggggcgtggtttggggggggg

SEQ ID NO: 55842 - DNA, 636 bp, Triticum aestivum
  unsure (1)..(636): unsure at all n locations
  Clone ID: PAT_TA_55842
gtggttggcctcccgacccctatcttctcccccactaatccccccattcccctcgccgccgccgccgccgccggcgtcgcctgcccaaggaagaagaaggccgttcacaagaccacgaccaccgatgacaagaggctccaaagcaccttngaaaagagtaggagtcaacaccattcctggtattgaagaggtcaacattttcaaggatgatgtagtcatccaatttcagaacccgaaagtgcaagcatctattgctgcaaacacatgggttgtcagtggaacaccacagacgaaaaagctgcaagatttactgccgacaattatcaaccaactgggccctgataacttggacaacctgcggaggcttgccgagcagtttcagaagcagatgcctggcggtgaggctggcggcgccagcatcggtgctgcccaggacgacgacgacgacgttccagagctcgtcccaggagagacctttgaggaggcggcagaggagaagaaggaacccgaggcgaagaaggaagcggagccggaggagaagaaagagtcgtcgtcgtaatcttgtcacgccattcattgttgtgaagggttccttgttggttgagggttgattggcatcttattactgtatatgcc

SEQ ID NO: 55843 - DNA, 601 bp, Triticum aestivum
  unsure (1)..(601): unsure at all n locations
  Clone ID: PAT_TA_55843
cggccgcgtgggttgaattcaacccgctgtcctcccgtcgtcttatccatttctcttgcgacagcgacggcggcttcgcccattctgtcgtgcgcaggcgacggccgccgccatgcctcgcgcgggaggacggagggcgctcgccgggaggatggaagacggcgcggcgaggcggggcagtggtggtggcgtgtgcggcgtagacggcgcggccaggccgggcagtggcggtggttgtctgaccgtcgtgcctcgcgcgggaggatggacgacgctcgctggggcgtgtgcggcggagacggcttctgccgcgcatcgaggtggagcagcagaggacgggaaggcaaggaggcagggtgggtatgctgtgcaccagcgccgccttcgtccttcacctcctccaaaagcgcgcgctcgccgcgggcgctggcggtggcgcggnggtcctcgcccttgcgcacccgtactcgcacgacgaccgcgccctccgcaagatggtaagtgccccggccggtcacccgtatttgctggtcagcagggccattctcgcggaccacacggtaacggggaagctcttggggcactcccgagggccggccga

SEQ ID NO: 55844 - DNA, 467 bp, Triticum aestivum
  unsure (1)..(467): unsure at all n locations
  Clone ID: PAT_TA_55844
ccgcagaacacacgcggcacctaggggggtgccggcaagcaaatcgtacgccaggcgagaccaagggcgcctgccagtacccacccgccgacgcccaggccctacccacccacctccccgccggcgacatgcatcctccgcccgccgccgccgccgcctccgcagcggagtgcgggggggcgcccgctccctcggagcacgcggcgtacccgaggctctcgccggaggacctggccccgccgccccctcccccgtaccacgccgccgcgtcctactccccgccgcccgtctccggcaacccctacgtctccggccccgccgccggctccgtgccgccccccaagaacaccatggactcggtgaaggacttgctggggaagatgggcatgagattcggcggggtcgtccgcatgactgagaacaccggcggcggcttctggcngcccctgtatactgggccaagtatt

SEQ ID NO: 55845 - DNA, 519 bp, Triticum aestivum
  Clone ID: PAT_TA_55845
gtgccttaataaaagacccgctgcgcgtgccctgatcgtcgcgaggaaccagcgagagaccctggagccagaggaggaggaggaggagatgagctactacaactcatgctagtcaccctgtacggcgccccgccgtcgtaagggtacggggactaagggcggctacccgccggcggggtaccctccggggggctacccgcccccggctcagggttacccggcagccggttaccgccagcatggctacccgccggagtacgcgcagcagtctgcggcccaccaggagtagcagcaggagcagtgggacttgcttcatggagggatgcctggctcgtctttggtgctggtgtgtcctggacgtgtgcttgtgatgagggagggagggaggaagacgactattaacttattgcaactgggactgagctattcttttatgacggagaaatggtgctaggagcttaattattatttgtcgtcgggcattatcgtttactttgtttgatccatgtttatgaacct

SEQ ID NO: 55846 - DNA, 503 bp, Triticum aestivum
  Clone ID: PAT_TA_55846
gcaacttatatacctatatagcccaagcgtggaggggggtgccgatggcctcgtcatgcacctcaaccgctccttaatcaggggttcaggttgacctccagggtaatcttcagctgctgatcaaaagtgctagacgatggagtgtgagcaaacaaggacgcaaaggggtcagcgggcgtggtccatctggggcttaagggagcctgagaaacctgcacgacctggcagcgggaagtacgggaggcgctgtctaacgcaggatcaactcgcctgtgccgactccaagtgggtgatgctgccttcagtggagaatggcagggtgcctgatatgtgagcacacatggtaccgagccggctacaactgccgagacgggccaaagggcgatgtgcatagcatcagatgctggcgcatcgccacatgggatgaatgaggctgacgaaaggaataagatggctgtgaccacatagcgcgggtcaccattacatatgactggcgccaaggg

SEQ ID NO: 55847 - DNA, 185 bp, Triticum aestivum
  unsure (1)..(185): unsure at all n locations
  Clone ID: PAT_TA_55847
tggtggccttgnanagnanaaagggattacccccttnacaccgggnaagggacggtnnnacctgcnnaaatttgagnaaagtccaagnattggcttgcttcagnnttcaaaacccttcagcgnnttgtcgcttgtnntgatgaagnaacagnattgggctgcnntaacctnntgtgnnaaatatg

SEQ ID NO: 55848 - DNA, 520 bp, Triticum aestivum
  Clone ID: PAT_TA_55848
gcggcgcgggggggggtggggttttttttttttttttttttttttttaaaggggaagctgcttaaatttccattccatcccaaagctacatccaaaaaacagtcaaggccaggacatacagcagggagatgcgggcattacacccaaccccatgagcggggggggaggctagctagctaccagcacaaatctgagggggggggccgattcccttggcctaccccccaaatccgtaaagggggcggccctggcgcttgagggggtaaacaacctccatgggggggacgggcttgcggggggcgtgctccttgtaggggacggcgtcccgggtaactttctcaaggaaaatcttgagcaccccccgggtctcctcgtaaatgagccccgaaatgcgcttaaccccgccaccccgagccaaacaacggatggccggcttggggatcccctgaatgttgccccgggacaccttccgggggggcttgggcccccccttgccgagccccttccctcccttgccggg

SEQ ID NO: 55849 - DNA, 579 bp, Triticum aestivum
  Clone ID: PAT_TA_55849
gactcaaataactttaatgaataaaaacatagatctgatcataaactcaagttcatcggtcctacaaacacaccggaaaagggttatatcaaatagatctccaagagaccattgtcttgagaataaaaagagagagaggatctagctactaactacagacccgtaggtgtacaatgaactactcacacatctcggagaggcaccaatgaggatgatgaacccctccgtgatggggtctagattggatctggtggttctagaacttgtggcggctggaattgattttcgtggactcccctagggtttctggaatattagggtatttatagagcaaagaggcggtgtggaaggccatcgaagtgggacaacccacctgggcgtgcctgggcccaggcgcccctggtgggttgtgctcccctcggagccccccctctgatacttctttggcccaacaggtgtgttctggtccagaaaaaatctccaaaaagtttcgctgcgtttggactccgtttggtattgattttctctttgaccaccagggtgcatccattttgcagacaactaggccgagctctcccg

SEQ ID NO: 55850 - DNA, 514 bp, Triticum aestivum
  Clone ID: PAT_TA_55850
ataggggaaaccacgggagattttatttagggggggggttacatgcgtgggagggcacctgctttgctcatgcggggggggggggacatacatacaaaaacccttgaccagggggggttacacatgggagtaaatggacccatccatcataaatataatgcaccccccccggaggggcatgcatgggccataatccatgatccatgatctaacaactgcaacaggagcaaccccaactggggccccacttgcactgggggcaaccccaacccccgttttccccccccattttcattcccccggagcttgccttttggggggggggggcggaaaccaagaggggggggcccgggggctcaacctccgggtacatgttgcaacccccccaacccttgccccacttgcaggggctgccccaaccccaatttcctccgaaaaaaaacatttttcaagggtgcttgggattggatggaggccttaattggggttggactcttttgtgcccgacccgtgg

SEQ ID NO: 55851 - DNA, 485 bp, Triticum aestivum
  Clone ID: PAT_TA_55851
tttttctttaactgcgggagcctcaaacaatgggccctccttaaaccacgtgcctagaaagggactacagaaagggactccatcaacaaatgctaaatgagggggaaaacttaggtaacgcgcgcatcaactaacatgcacgcaggcgtctcgtgccaacatccaaggacattttcaaacaccctgggcaaaacaagggctcctctggccaaaccccgcacatgaaaaatgagcactgcacggaggcttggacacaccctatctcttgacaaggcctacacttctttaaccccattctctgagataccacgatgaacaacccacgaactggagccgcttatcatttacatcctttgtattaaactaactctacctatgcgctcaacaaaaccacggagaccaaattcttccaagaacaccaatgattgcaacaccacctattaaactaacagtcttgatagccattgtgaatggcggtctaacac

SEQ ID NO: 55852 - DNA, 522 bp, Triticum aestivum
  Clone ID: PAT_TA_55852
aataaaggggcaacaaaaatttttttcccagcagcagcagccaaaaagcaacaggggggccggagatcatcacccaacattttatttttttatcccagcatcataaaaggcaaaccacaggggggacaggaaaatgctttcagggccccaacacgggggccccaaaatgggctagctatagtcggaccctctaagggccactggggcagctagctggccatgggccccaggggcctgccggcccctaacagggcggaacgggaaggcccaagaactggagggggtcccccccgggggggctgcggatgtactgcccgaagggggggcccttggggtactggaaaaagcacggttgctgcccccgaaggtggccgaaaaactccccgttcggtttggccccggaaaggatccccaaagcccacaccgccagttgggacccctggaacgccgggggccccccgcccggggccgccgccagcaccaccagcaccagcttaagggccgccaccacctgttttttcc

SEQ ID NO: 55853 - DNA, 495 bp, Triticum aestivum
  Clone ID: PAT_TA_55853
cctcaaatcgcccactgctactgaatgaaccctaacacccacccatgactaattccaccaccaagtacagttaagagcctatggtcagagcttgagagctacccttgagcaccccacaaagagtcaccgtcccggcgcgggtaacccaacccacatatactgggtttagccggttctttgagttgcaaggcgaaaacgggtcccttcgtatgcaagccagggcattccttgaatgatggcaaccgggccacggaaccctttgttggactccctatgagatgccctttaatactgcctctaccttcaccaagggtgtacatcctaaaggtgtctagaacccagcggagtgatcgttggctacgcttctcagccatatattgttaaaaggggaattgccgggactagcaggctggatcctatgtcctccgtctgagaaagcacatggaatatccagtatgtaacatccatgaccaagtaaccctctgagatgcaatg

SEQ ID NO: 55854 - DNA, 525 bp, Triticum aestivum
  Clone ID: PAT_TA_55854
ttttgtggtaacaaacggtctgtcttttatacaaggcttacactagctcactggtattcatacacaattttagacgggacgtggaaacggaccccgtgccctccggaccataatctacttctaatgttactcctgctggcacccaaaatagcgggccggcatcttgagatcagaagttctaaaaaactctttgacaaacttatttaactggtaatcctcatgtgcttaatggggacatccgtcttcctgatctttgacttggcacggccttcctacttgcctgagcgagacttatttcctatcgtctgtgatgcgagaggccatggggcattgatatttacctgtatcattggacctgcgtgagggatatatggcgttcccgctttatattgaagcaccatctcggacatcttgccttgatgagcacccagagatccacaagactcattcttgctatgactgaacagctggcgctatataaagggcctctgcctcatcagattgcgcttggaggatcaggccttg

SEQ ID NO: 55855 - DNA, 424 bp, Triticum aestivum
  Clone ID: PAT_TA_55855
tttttacattgacaaccataggatcgaaaatacgcaacatatccggtaacattatccttatcgaaagaaacacttatcccctgttagaactatccaactggggcacgcaatacatggcctgtacagacatcaacgaaaacgcccacatggttttggggccttttaacaactaacactggttgctgacaacccatgggttgagcaaagtgacaacagatgatcaggatctttatatatgggccggcgggagtgacctgtttagggatacccctactcatcattaatcttgggtgggtaagcagaaaaccttactcactggacctagagcgtgtcctgtaatccttatatgctgacatactctgacaggtactccttgtagatctactgcaatgacgcttcatttgcctggacctgatctactcct

SEQ ID NO: 55856 - DNA, 319 bp, Triticum aestivum
  Clone ID: PAT_TA_55856
agggcgctacaagagttcggctttgaattacgatgatcatcaaccgggcatgatacaattgtagggtgcgccgcagtacaagacacaacaagaagcaccggggccactggcgctgggatgcatattggtgggccgcagaactgcacgcgggaggggtattcaatgatgcacacagccgaaggggtctgggtcctccaactggattaacctgagcggtaacgatgccgtctctggagaggagtgtgttgcacctgagtggcctggtgacaccaaatagtaagggagcttacacgacgcatctataaaaactccgttcttc

SEQ ID NO: 55857 - DNA, 616 bp, Triticum aestivum
  Clone ID: PAT_TA_55857
ttttgatgatatgattacaatttcacattaaatggggaatcgatccagagattttacttccactcattcagactttttaacaaacaattagaaccaacaaacgagtaataatagactaatttgggagaactcgcaaacatctaccgcactgaatcaccgacaacatgtgcaatcagtgtgatacacatacacataccagacaaacaagacaatgtgccttcctactccaaacttgaggtggagataaccctggcgccatctctatcaagctgcgcgacggtggcggtggctttcagcttccccactgacaggaaggcgtcaaccatgctccgggcgatctcctcccccttctcctctccctcgatgacagccacggcggtcgggcccgctccgctgatggtgcatcccagcgctccggcttccagggcggcggccttcaccgcggccatgccgggaatcagcggcgccctggtgggctcgacgatgaagtctgacgacattgcggaaccgatgagggcggcgtcaccctgcagcacggcggcaacgagcgcagcagcctggctggaattgcggacgtggttgccgagggtgacattcttgggcagggcggcgcgca

SEQ ID NO: 55858 - DNA, 595 bp, Triticum aestivum
  unsure (1)..(595): unsure at all n locations
  Clone ID: PAT_TA_55858
gagaccaaaacaactgattaatcacaattatacgtccttcagtcatgcattgcaataaacattaaaattgaatagccagctggactaaaaataacattctgaactaagtacactatcagatatggccgctcgaaagatcccaatcaaaaaccatacaaggcatagggtctctgtgaatatacatcggatgcaacgcacacagaacaccaaacacaaatatacaagaaaataggggctagaagaaccgcagaactcctgctcctgaagcttatgtggagctacagtgacaaacacataaccagtaatatgaaacaaattttctccagggctttgtgcattcttatcacactgggcagtgggcaccacaaaccagtggtctgaagatacacaagataccataaacaggtaacatggtacgtccacatttgataagccttttacccgaaaggatttccacccacagcaccataggacggtggggtgtttggctgggaatacctaggagcagcttgttgatcatagcctacgccgagggaaccagcacctccttgttgccttggaagcatgccattaggtagctgctcangcatgttgt

SEQ ID NO: 55859 - DNA, 542 bp, Triticum aestivum
  Clone ID: PAT_TA_55859
gagggaaacgccacgcttgggcgatcagctcatattagtatatatatccatcatgtacagatgccttgggaaacaagggcttgacccagccgtgtcaatcatagacagagatacaatccgataatacggggagggctgattacatgccaaatatacaggatatttactttaacactattggactgcctatattttgcagataggttctttacaaggggaaccaggcgcacgagtctttatgtgtaccttggggcgagctctgtgatggaggaatgagtctccaaagatatctgctcatttattagctcagtagtctctgagtagctcctgcttctatccaagacataggctggcctgtagggagcttctaaagagacggtgtcgctgccgagcatgacgacgatggacgacatggatggccggtcattgggtttctgctggacactcagcagcccaatgttgatgcatttcagaacctcgcccctggggtagtgcctgcccaaactggggtctgctatttctgcgattgtgccctccaccca

SEQ ID NO: 55860 - DNA, 614 bp, Triticum aestivum
  unsure (1)..(614): unsure at all n locations
  Clone ID: PAT_TA_55860
ggcggggtgtggggtggtaaaaaaaaacatttggcatttcatcattgggaccacatacttctctctttctcttacatagcatcccttgcagaaatctagagttcgtgcgtcacaaaacaccatctggggctcccagactacaagtctacaaccggggggggccaaacactcagtgggagttgttgagcctcctgcagttcttcctgatctcccccttggacccggtgagcggcgagatgttgcccatgttcaccattgactgggcaaagtgctggaagaagaggtgcacgtcgtcggcgtacgccttcaccagcgccgccgtctcggggctcttggtcagcagcacctcgtcggagctcaggaggcccctgccggcgaggatgttcttgaagtagaagttgtcgaacttggtggagctgacggcgtcnagcgggaagaggttgttgtcgccgccggagcgggggcagccctgcctcaggtgcgctgcgaaggacacgtccagcgtgctgtcggcgaggccgttgcccgactggttgtacagcctctgccggaagctggtgcagcggcacaggccgatggtgtggccgcccgagagcgcgacgacgtccacgacg

SEQ ID NO: 55861 - DNA, 606 bp, Triticum aestivum
  Clone ID: PAT_TA_55861
tttttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagacacgccgttctcccggacgc

SEQ ID NO: 55862 - DNA, 510 bp, Triticum aestivum
  Clone ID: PAT_TA_55862
ttgtttacaattagaaatagctttaaatcacaaccaaatcaggcaaaacattctaatttctcctaggactgctaagctacagaaaaggggtacggtgtgtctgcgaacatgacatgggcgcatcatctaaaaaaatccgacgggggggcatgcgaccagcctccttgacctcgtaatctgagagtcaccctatgcgccttaattaattcatgggagctgtgcctcatgctttgaactaacagacatacctttgcgccttccaggtatgtgaccccactagcctctggcacactggccaaggggagaacgaatgcaggccagcaggctgacaccgctgcactgctgctgactgtgagagtccactgatcgtccctgctggccctcatcaagcttgctgtggacattgctgctctactttgcttcctctggggcatgaggaggaacctaacactctgggccctcagcactattcttcttggaacgtgcagcagatcccttcttcctaccgat

SEQ ID NO: 55863 - DNA, 621 bp, Triticum aestivum
  Clone ID: PAT_TA_55863
gcgggcggggtggtgttttttttaagggaaaaaaacttcttaaactattatgtgcgggggcagtataccaactccatttggccttcatcaacatacacatcatgcgttcaatacgtgatgattggtaacaatgacatacacatctccttatcttacctacagcgcagagggagagatgctaactggaaacccagatgcatgtcaagcaagccaaaaccgggatggcactccatctgaaggccagggtgagcacagctgtgtagggacttacccgcctccttatatgccagcggccttggaggggactaatctgacgcactggacctactgcatgtccgtcgtatacatttatgcggacatactcctgagggggctccattcttaacctcctccagcaacgcataaaccggcctggggtgatgcgcacctcaaacatagagcggtgcccattgggcaccatcccgtcataccaaccacccacggagatgtctttgcacctcacggcagataaacacagccctgctcaactctaggctgggcacccacttgaagcggctcatggcaaacacctgctataagaggggctcctctccatcccaggccataaggacacagtgctga

SEQ ID NO: 55864 - DNA, 489 bp, Triticum aestivum
  Clone ID: PAT_TA_55864
gggggggtggttgttttttttttattaggtatattcttaaccccatgggggtccggggggttgtcgtgaatcacacctaaaacagggcatgacggtggcacccattaagccttaacaaaatcgattgggcaagaagggattaaacaagtgaagatgtgtgggtccaagtctaagctgagtcaggaatctgctagataggggaaacaagtccagcagaatggaataacaacgtgccaaacgccaaagatgctgaagtggggatcttcactctaagctaagctgatatacatggggagagccttggggtccttaccacttatggtgctgcaaataataacgctaggcgagggaactacttattgagcctgacatcttctagggcctagggggaacgtttgtgaacgtgcggatttttatgacatcttctaagggggctgtgcccaagtacgtgcttttcctgggccctccgagttgaaatgggggcccctt

SEQ ID NO: 55865 - DNA, 539 bp, Triticum aestivum
  Clone ID: PAT_TA_55865
ggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtcatgaacgacctccgcctgagggcctcctacctgcgctacgacctcaagaccgtcatctcctccaagaccaccaaggaggaaaagaaggacctcaaggacctcaccggcaagctcttcgccaccctcg

SEQ ID NO: 55866 - DNA, 142 bp, Triticum aestivum
  Clone ID: PAT_TA_55866
cggtgagccctggtcctaggagaattggggattgttttatacatgttgtagcgagggggcattgatttatacatgttgtagcgagggtggtgatttttctggatatacagtgaatgtcatcgtcacaatggcaggtgttatt

SEQ ID NO: 55867 - DNA, 557 bp, Triticum aestivum
  Clone ID: PAT_TA_55867
cacacacactgcacatcttgagccaaagcacatggtgctagaccttcaggcccgacgtgcctgtcttgcacgcgcccaagctctactggctcgcgtatggctggcagcgcgcttgggcccactctctatgctgaccacacccgccggaacagtacgcttatctaaaacatcatcgtccactgtccctagctaggattatgacatctactactaccggcctctgttgtggtgaaagaggaggaaactatgacactctttgactgcgttgaaggcctaataagcgagcttggttcgttctcgttacatacacatatagtgggtctgatccagcctcagcatctcatctataatgcaataatggctgtctttggctggtcaccatatggaataagaactgattgaaccagcgctctgcttgttctggaatctgaggatggatagatatggccccccttttatgaaactcaacctaacgtacgcatgcatgcaacgtcaaaaataaaaaataaaaggcacctcaattcaaatgactcagcgttacgtacacaacgcatgcg

SEQ ID NO: 55868 - DNA, 563 bp, Triticum aestivum
  unsure (1)..(563): unsure at all n locations
  Clone ID: PAT_TA_55868
gtaggatccaaaaagnacggccaccgtggttttggttttgttacttttgctgaggacggtgtagcagatcgtgtagcgcgaagaagtcatgaaattttgggacaggaggttgctgtagactcagctgcacccgttgagggtggccccagtcgaggcggttacattgaaccacctgggccgtatggagcttacagcccgatgatgtcttatggccagttctctggcagtcttggttatgattatggttatggtcccagtggaagtagcagcagatcaagagtacaaccacgctacagaccctactgaggcactctcttggagccatcacagcatttaagcgacatggtagtagcatgaagatgcttatgacattgtgagaacatgatagtgaaaaaaaggatgttccgttgtcaggattctatggtaccgtgtatacttatgtttgtttttgtccaggatatatgcgtaaccctttttgttcatgacatttttctgtattcatgtgccaccggaaatttaattatatggtgtggcaaaaaaaaaaaaaaaaaanaaaaanaaaa

SEQ ID NO: 55869 - DNA, 640 bp, Triticum aestivum
  unsure (1)..(640): unsure at all n locations
  Clone ID: PAT_TA_55869
aagccctctcctcttgcttgcgcatcgtattttcagtagcacaagctcagggagagggaagagagatggcggcggcaagcgtctccctgaagagcagcctcttcctgtcttcccctctatccgacttcgggggcgcagccatctccatctcagcccagaataggagaaggtcatggcagccaagggggcgagaatgcaggtggcagcagctgcagactccaagaacattctcatcatggggggcaccaggttcatcggtctcttcctctccaggaaacttgtccaggagggacaccaggtgacattgttcaccagaggaaaggcacccataacccagcagttgccaggtgaatcagatgcagagtatgcagagttctcttccaaggtgctgcatttgaaaggtgataggaaagactttgatttcgtgaagaccagccttgctgctaagggcttcaatgtcgtctatgatattaatgggcgcgaggccactgaagtatcccccatactanaagcgttgccgaacctggaacagtaagctggttacttgatcggatgcaaagcaaaacgtttgcaaatttcagtgccctgaattatctggaattctggtactattttcaggtttatctattgttcatcggca

SEQ ID NO: 55870 - DNA, 621 bp, Triticum aestivum
  Clone ID: PAT_TA_55870
attggttttctattcaccgcggttgtcactggcatatttggttttctcagtgctttgtcacctaactacatgtgcctattaaccctccgctttattgtcggtatgggattgggtgctggtcatgttcttggtacttggttcctagagtttgttcctgctgcaaacaggggtacttgggtggttgtcttccattgtacctggagttttggaacaatccttcaggctcttattgcatgggtattttttttaatttccctgccctttagtgcccaattatcagtttgctgtcaatttacaatttcacatatttgtcagtctacactatttattagtgttattctaggttttattcttttaatattataagcaggaaagtatcctagagaataactatttaacagtaaaagggtgacttgtttaatagtaatcctagcctcctggatcttaacagtaatgtttaatgtgccgtatagtacacttcagaatgttctccatgtattttctctgttagttaaaagttatttcccatcattaagaatcagcactttaaccagaggagacacaaatatggttggaaattggaactactcaagacatctatgcttattgcaggctatcatg

SEQ ID NO: 55871 - DNA, 544 bp, Triticum aestivum
  Clone ID: PAT_TA_55871
gtggattagagcgtctattctgtgaggaaactagggtgtgactcctgtagcgacatgccgcgctaaggcacgggtcctagtaatagctggtgatgatggtaggaaatagactaactacacgcaagagtctgaaggtgatgattctgatatataggcagcattgcgagaaagttctcagccttcagctacaaccataaaatctacaactggatgacatggcaagactgctactgtgacatggacaattgatgggactgtaatactcacatacttgtgattgtatacaaaaaccatgctataacatattagcatgttgatacctgaagaaagtcaatgtatctgctatggaacataattaatgaaagtattatagaagagctccgttactaatacaactactactataggactgaacgtgttatgattgaaaggacatctactctactgcagagaagatctacgaatctcttcatatttattcaagaatagctacagggccacatactaggatagaagttggatgaaagaagttgaacagtactca

SEQ ID NO: 55872 - DNA, 377 bp, Triticum aestivum
  Clone ID: PAT_TA_55872
cgcaccgctgccgcagttcacctgcgtcagctatagcagtggctcgatgacgacgcgcctgtgtctgattgtacgatggagaggaaacacctgtgaacgctttccctatggctatgcatactacattatacccgtacacacatcgctgcgtgagacgaagctatgcagtgcgctgcaacactgtaggcaactatttgagcggactttgttgcaacccgataccgacacgtctgcaacgacatggtacaacggcttcccaggtcgcaagtgcaccgaggccggccgcgcccgctgtaatgactaccacctgccttgctcaaccccatcaagagtgcactttaatatcccctgcatgcaatgcagttcactagcgcgat

SEQ ID NO: 55873 - DNA, 535 bp, Triticum aestivum
  Clone ID: PAT_TA_55873
gtttcctggttgatatattggaagagcattgttagtccagaattaatcagtataattcagtttggttcagttcaggacatattaagtatgctttagaacaaataatcaaaattatctgttatgaagaacatattaggcttgtgttttcaatctccctgtacttctatggttccaaatcttctcctatagttttattgtcttaactgcttgtagaactgtactgcaagttagtttattattgaagaaaaaatcatttattatgatgttgtcagcttgtgcttaattttgtgattgctaaaggcaaggaaaagagatggtgcagaaggagcttcagcaggcatgatggttcgttaaccacaatgtcgcaaggccatccccatggcttggtaacactatttcaggtttgcctctcgctccctacccagccaccctgtagtggatgttattattttggttactccatggactgattggttgctgttgtggttactccatggactaatatgaccttcagcgaaaccattacttttacaaa

SEQ ID NO: 55874 - DNA, 622 bp, Triticum aestivum
  unsure (1)..(622): unsure at all n locations
  Clone ID: PAT_TA_55874
ncgaagcaacaaaccctagccccctttcccaggctgttgcgccccgacccctccctccaccctcctccccgatctcgatggtcgtcgtccctctcactcctcctgcttcatcaagacagccagcacgtccatccctccttaggcgccatggtggcggtcgggacggagcgggggcggaatgccgtggggagtccgccggcaggaggaagcagtataggggctgatgaagcgacggatgtgatccaccgcctccctaggtgctcatccgcctcggctcgtgaggaagcagcgggaggagggatgagctcaactgggcgcatcagagaaagagggaaggagcggataccagccaggaggctgctcggctcagtccagccatggagctggcgctgcggattccctgctagcctccttcatcttcatgtggatttaggtggcacactagatgttgcaccaccgatggcagtagccagatttggcgttcgtggtgcaatggcnttggtgttgcccttgcttgatggtgctggatatgtcaataaaactgatcgtggattatctccaactgtgtagttacctctctcgctctcaatggtgaacgtagatctccttttgaccgatatgc

SEQ ID NO: 55875 - DNA, 633 bp, Triticum aestivum
  unsure (1)..(633): unsure at all n locations
  Clone ID: PAT_TA_55875
taaattattgagaaccttccaataaagttgggtgtctaggtgcttgcacttactgcaagacaaagcatgctcgtggtcatcttggaagctattctatagacagcttgatcgtgtgaaaattgttgtctcagaaggtgttcgtgagatatggttgagcagtgaagatactggtgcttatggtaatttcagtatccaaattgttatagatttacgcagtgttacatatcatatacttccattctacttcgcctctgtgatcttgtattttttaggtagggatatcggtacaaatcttccgaatctcttaaatgcaattgttgctgagcttcctgcggacagaagcacaatgcttcgcatagggatgacaaatcctcccttcatactggagcatttgaatgagatagctagtgttttgcgccatccttgtgtttatactttccttcatgttcctgtgcaatcaggaagtgatgctgttttaaaggcaatgaatcgtgaatacactgtcagtgagttcagaatggtagttgatactctctgtgagcttgtcccgggcatgcaaattgccacggatattatttgtggctttcctggcgaaactgatgaagattntgttgaaacggttaaccttataaa

SEQ ID NO: 55876 - DNA, 532 bp, Triticum aestivum
  Clone ID: PAT_TA_55876
gaactcgactggactccgagaaagaatgggggtgggaaataggataaagaattagacaatatggctgcagtcgatctaccaaagaagtacaaggcggctgtgtacgacaagccggggtccatctcgacgaagattgaggagttggacatgccggagccgggacctggagaggtgttgattaaggtcactcactctggcgtgtgccactccgacatgggcgtgatgatgaattcctggtccatcctgcccttccccacacaagcaggtcaagtaggcggccacgagggcgtcggtaaaatcgtaaagctgggccctggagcagaaaatgcatccgtcaagattggcgatcgcgtgggaatcaagtggatggctagcatctgtctgaactgcgaggcctgcagagcaggcatggatggcaactgcttcaacggcaaaatctcgggatactacaccccaggaacgtttcagcaatacgtgctcagtcccgctaactacgtcacacccatccccgacggcctcgactctgccgccg

SEQ ID NO: 55877 - DNA, 662 bp, Triticum aestivum
  Clone ID: PAT_TA_55877
gcaccgcacctgctccgttggaagggagcaaaccctccgtcgcctatttagccgagaccccgagcgtggtcttctccatcccatcccatccgcagcggctttacctaccgagaagaagagagaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaggtgccagctttgcaggatggtgacttgtacgtcttcgaatcacgtgctatttgcaagtatgcgtgccgcaagaacaagccagagctgttgaaggagggcgacatcaaggagtcagcaatggtggatgtgtggctcgaggtggaggcccatcagtacaccgccgctctgagccccattctcttcgagtgccttatccatcctatgcttgggggagccactgaccagaaggtcattgacgacaaccttgttaagatcaagaacgtgctggcagtgtacgaggcgcacctgagcagtccaagtacctggctggagactccctcagtcttgcggaccttaaccatgtg

SEQ ID NO: 55878 - DNA, 583 bp, Triticum aestivum
  Clone ID: PAT_TA_55878
ttttgcaaaatgaaccaagtttaagttaaaaacattcaagtcagatcagcattcaacacccctccaactcaactgtacagagcacacacacccaaaacacacatcacctcttgcgcatttcaccatccctccttgcacccgtccgaactctagttcgtcggcggggcaaacacgacgacgagggaaagcacccttagcacagccttacttacggcgaatcgccagcagaccgtcccaactcgctacataccccagccttgccggggagaaaaaaaatagcaaaactgggggtaagtaatttattgcagcttcttctccgtcctccagttagtgagcgaacatcgagtcctcgccctcggccgcgttggccctgcggctggagttctcctggttaggcgaggtcgacaggctcgcgtctcctctggtgtccgagctgtgcagcggcctgttcctcccggacctaggccggatgttgttcccgacagggaaaggttcctgctcccctgcgttcgggccatccttgtggaagagtatagggcggcaccatttgtcttcattcatcaggctagaattccgaaaatga

SEQ ID NO: 55879 - DNA, 411 bp, Triticum aestivum
  Clone ID: PAT_TA_55879
aacaagcctacacgctggttccgtgattcacgagacactattttgtacagacacaaccaaccaacgaagcattatccatgacaacatgactgcggtctaaaaccacagtcgcaaatcaagcaggaaggcccaaggcagatattgcgcctcaggacaggcaaaaacagaccatccacaggcgctcacaccacaccagaggcctctaaaacaagaacataacctagctggcagtagctgaaccccgatattttatacatgccgatagctccataagtgtaaccagcatagacagcgctgccatacgcgctccagatgaagcaagtgcagctgactatctggttggtggagacagggacctcctgcctaatgacctgcacggatgtgcttcgactcatgaacccagatcttgac

SEQ ID NO: 55880 - DNA, 574 bp, Triticum aestivum
  Clone ID: PAT_TA_55880
tttttttttttttttttttttttttttttttttttttttttaattttttttggtttttttttttttttaaatttttttaataaatgggtttggcaaaccaaaaaaaaaaaaacccgggggggcatgcaagcaaaaaaaggtccggacaaaagggggtacccatttttactgggaaaaaacaaaaaagaggttaagcgggtccatgaaaaatccaggaacggaaaaatgcttttttggctacaagggagtgccaaaggaagaaacgtttcgagggtacaaccaaggtcttaaaaaactgggagggggacaaaaaagggcctcaaaagggggagtggcggggaagtgcccttaaaacaggaggtagtttcaaaggggcaaaaaccctaagtgtaacaaagaatgcccaaaaaatggggcaaaaaaaaaagggggctggaaagtccaaaacgaccaagggggccaaaaaaaaagacttaatggggccacactaaaagggggaaggtggttataaaaaaaacctctgcccaaaaaagtgggagtttttttggggaaaaaaacgggaaaaccgggtccc

SEQ ID NO: 55881 - DNA, 534 bp, Triticum aestivum
  Clone ID: PAT_TA_55881
gcaaaaaacatgatcaacgacttaggctgttttaagcacaattatgacaggggggtcccatatttgctgactggcgtaacgattcatcacaaatggcgttagacaggggttagtgccgaatttacaaaatagtccctgatgttttgcatagacacccttcattcataatagcaaaaagcaatcagcccccgatctcgcccatctcgctcatccccgcaggcgctccccgccggccaccgcatgcgctgcacgccttgacggccacgcctgcaccgttcctcaccggcctcgcccgctccctccacctccttgcgggccgcgtttggccagcgccggccccacgctggagtccgaggcggggccctttgtaaggccggcccgcacgtcgaagcagcactgcatgtcaccgtggcgtgcctcaaggaggagttccaccagcgcctgaccagcggcagctctggcttcgcgcccgccacggccacgggctagtccaggtcgaagtcggcggccacgatcgaggcgcacgggtcgacc

SEQ ID NO: 55882 - DNA, 604 bp, Triticum aestivum
  Clone ID: PAT_TA_55882
tttttccggtccaaccaacagatgcacactgaacacaatttctttcataccggctgaacgattaaaatgcgcactctaatacacgagctgaggctgatctatggacacaccacacacactaccctgagactacagtgcggatctacactgctcccatcgcagctggtacacccctttcgtttatagctagaaagcatatagacacggtggttgatatcacacatgattacttgagccaagatgactgcaaacctacgcactaatctcttagggggcggaggcttaactcatattgacgctactcaagccgaaccactaactgttccaagaccacatcatgccaccgcttctgacaaagggaaccactttgagcttctgcaggacaactggctggaggtacatgttgcagcggccctactttcttcggctgccgttgctgtatgacctgcactggctatgtgcctattgctcttccataggttgcaacgaagtattgccggtaacaggatggagcttcacatgagtacacacaggatcctgggtgtgatcctgacgaccaaagctccagcccatgctcaggatgacactccagatacagctgcat

SEQ ID NO: 55883 - DNA, 581 bp, Triticum aestivum
  Clone ID: PAT_TA_55883
tttttgagcggtgagaagttggatgatttccatttcatttatttcagaagtatttgtacaataattgcgctctaaagcaggggcaagatgatgcttcctggcaaatgtacttgtatggtagctgtaatctaatctgatgggggggtatacaactgtccatccatgggaattgtggagcctgagatcttactgaatctggcagcccttggtctctagagggaacagggcgcaggcaactgctgcaagaaagagtacaagatcgaagacaaacacagcttctttctgatgacagctctctaacaatcctacagctatgagtggggcaatcatgccacctatccggccaagagaagtcgcgactcccactccggtgtttcgacatgatgaagggtagatctcagggccgtaaatatagagaacagcataacttcctgtgatacaagtccgggcactgaatagaaggacggttgctaaaccttcttctagaggtgcagcaagtggtgcgacggaaagaagcacagaaaagcaaacgctcccattgacagtttgcgaccaactttatcaaccaatagagccgccaa

SEQ ID NO: 55884 - DNA, 542 bp, Triticum aestivum
  unsure (1)..(542): unsure at all n locations
  Clone ID: PAT_TA_55884
ttttattaatacatacaattctctcatttttagcaaaatctactcatcaataggatgtacctgctaacactcgcaaaggaccaccttccatccttcaaaggctgacagactcagtcaggactaccttagcaagctggatgtactacaggtcattaccttccaccgcaagcacgctcactagcttacgaagctcgtcacacgcttctaacaccggtaccgtaattgctttgcccacctcattcatctagggctggtctagggcaacgacaccatattgtgatgcaacaatcccaccaaaagattgccctctgacctgtcatatgccaaacatgaataccanctgtgcttaccggcttaacatctccacaggatacaccaacttgacagaaaaagatccagctgctccagcatcacaaataaaatcatgggccagtaaatcaacaaaacctaagaccattttgatggcccctaataacatacctactactggacccatatgcatatgatctacgcccatcatacgcaatgctttacctaataca

SEQ ID NO: 55885 - DNA, 524 bp, Triticum aestivum
  Clone ID: PAT_TA_55885
gttacacatttttttgcttggtaaatttaattgctcttttgatgggggcaaacaacgcaagagctagttataaccgtcggcctgggcggtcttggtgcactacgccacctgggaagcccgtgtgccaggggttgcaaacgtggcgagagcggggccaagatggacaccctccatttcttgcaggatgaagcgcactgctcgacctcgaacacccaactgtacatcgcccgttatgacctggtgcacagagccatgtcacagggctcccaccggttaattctcgtactggcgcctgcggtgcgacggcgtttccctttttggagccggatacagggttggaggaacacttgggcccggggtccccacgcggaaattgatctgcgaattccagtccggcacctgaaggcgtcccaactttacatataaagagtgggttgccacatggggaaccaaggccataaatggggtctgtgtgaaatggcattctctaacaaggaaacacaacataccagccggaataataa

SEQ ID NO: 55886 - DNA, 508 bp, Triticum aestivum
  Clone ID: PAT_TA_55886
agggtaaaccacgggagattttatttagggggcggtttacatgcatgggagggcacctgctttgctcatgctggcaggggcttacatacaaacaaaaaccctcgatcagggagcgttacatgggactagaaggatggggggatccatcataaatatgatgcatgcccccggggcatgcatgaaccatgaacaaagatctaacagctgcagcaggagcaaccccaactggggccccacttgcactgggggcaaccgaaaccgccattctccgccgccattttcatcccgccggaactccccttttgggtggcgggggcggcaacaaagaggggggccccggcggcctcaaccttggggtacatgttgaaacccccgaaaccgttgccacacttgcaggcgctgcccaaaccccaatttcctccgcaaaaaaacattttcaaggttgcttgggattggaaggaggccctgattggggttggctttttttgggcggacccctgggtccacc

SEQ ID NO: 55887 - DNA, 587 bp, Triticum aestivum
  Clone ID: PAT_TA_55887
agaaaaattgactagataaagcaaatggtgacaaagttacaaaggtatagacctcaaagcaactcagcttttcgccaatgacttttcggacaaccatccccatgattaaactcacgcaaatgatcgcccaagggtctagttttcatcatgtcttttgaaaagaactcgaattcttctctctggcaatgacaccagcctagaaggaaccatatgaaattctgaaaagatgacacgataatttggacacgttctatctgaaattctaaagcagagcaagatgacaggtccaatcaagttcaggtttcctaatcttgcatacacctgaatatatcactcaaagcggccattacgccaggagagtgatccagtttataagggaaaccggatcgaaaacctatgtattgtgatcttcaagagctgttggaggcctggaaggtgccgggcttgtgtttctccatcagaccggtaaaagcggcatcaaactccttctcgagctccacctcctttgccgcgtactctttcttgagctgcaccttcttttcctcatgtgcttttatcagttggtctgcttcagcctcgaactcctg

SEQ ID NO: 55888 - DNA, 475 bp, Triticum aestivum
  Clone ID: PAT_TA_55888
aacgggcggcggtgggtgtgtgtggtttttttttaaataaagagtttgcatacatttacacgctccacagagccgcatggatacatgcaggccggaatgtgtgcttatttacgtacgtacgtaacatttgtagacgtataaatattcaaaccacacaaacatgggggggggcgacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcc

SEQ ID NO: 55889 - DNA, 581 bp, Triticum aestivum
  Clone ID: PAT_TA_55889
atgcatagatatgttattaactctctctccttatatcacatctacgacagatccaacacaactcgccccttaagttctcccttatgcatctcctcaaaaaactcgtcaacttctccatcttctccgtcctaaaatgcgtcttgataatccccctcttcgcaaagtccatcgtctcaatcgcttctcgtcgatcacccaccgccgaccctacaatctgcagcgacttcaacaccatcaagcccggactcgcacatttcatgggcacgacatcgccctcggggatgcccacgcataccactctgcccccaaatctcaacaaatctagcgaattgccataggcggcgttgttggctgtgcacacgacaactgcgtgtgcgccgagtccttcggtgaggccctgcacagcagcgaccatgtcctccgtgccgtcaacggggatgaagtgctccgcgccactctccataacgaggtcttttttgctgctgtggtcgattccaatgacgcggtggccgattcccttggacgagagttgcacggcgagatggcccaggccgccgcccgcgccgctgatgatgacccat

SEQ ID NO: 55890 - DNA, 593 bp, Triticum aestivum
  Clone ID: PAT_TA_55890
ttttggataaagtacaacttatttattttgcattcttctgcaagctgttcgaaccaacgggcaccctacacaatctacgggataatcacaaatgtttgaatgataggtgtggccatagcaggggaatgcacaggaccgcagtctatgacccaccaaaacctattgaataaattaaaccgaaaaagaagctaaataaaaactaatatacacactgatggcaacaggccaaggagcatgtccccattttttccttctgacggcgcttattcggatatacatatatatatatatagcttccgcgagtactgcttctctaatgaaactcagatgatgcgaaagctaagtgcgggtacccatatcagctgaacgtttcaccttgctatgtttcttcattgtcctcgtccctaatgtcttctatttcttctcggcagtataatgcattaagttcttgctgcaactgaacatgtttttgcttggctgaaatcagttcgtcagtcaaagtaatcattctagactgcagctctgaaattttaacaagtaatgaccgttctttctcagtattagatgtttcaaccactgtctcactttgcata

SEQ ID NO: 55891 - DNA, 524 bp, Triticum aestivum
  unsure (1)..(524): unsure at all n locations
  Clone ID: PAT_TA_55891
atgaatcttacaanaacacaaccgcacctgctcttggactggtggtcgatcagcgaatatcctcggcgacgggcaactctgtatccctggacggacaattcacaacgaggccacccctatattctaaccgtgacaagcacgacgaccaaactttgatacttaccagaatatgaaaatctacgcctaccgtgccgacttaccgacggattcttactagccacgctgaggcctccatcctagaggatacaggcataccatctccttcatgctcagggattgagaatggaaaatggatatccatatgaagttattaaggctggtttcactatactggaagggaaaaaacagtcttttgcatacttgaatgccgccaatggagctaaattttaaaggcatgattacttatagaaaagcatctgctcacggaaatggccttccatctgcaaacaaccttctattgacacaaacatccaaaagctctatttaacattatccaagccacggaagacagtgacaccttactg

SEQ ID NO: 55892 - DNA, 588 bp, Triticum aestivum
  unsure (1)..(588): unsure at all n locations
  Clone ID: PAT_TA_55892
cgctgggtttgctccgtatgagaagcgtatcactgagcttctcaggttggcaaggacaagcgtgccctgaagtggcgaagcgaagttgggtacccacaagaggcgaagaagaagagagaggagatgtccagtgtcctcaggaagatgagatctgctggaactggaaccgagaagaagaaatagagcatcccaggctcatgaagttgatggaaaatcttctgttctggtgtccggtttttactgcatgtagaacctgctagacttgaaactgttatccgccagctaaacattatgctatgttgaacctcctgtcttgtgagatttttgagctaacttgcaatgcatcgtttgccaccctatttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggcccttttaaaagaacaaaattttacnntccccggaatgtgaaaagtaaaattttttttttggggccccaaaattaaaattaatg

SEQ ID NO: 55893 - DNA, 542 bp, Triticum aestivum
  Clone ID: PAT_TA_55893
cgtccgcgtgttcacgcggttccggcctgaccacgcactacagaaagctgcctgctgccgtcgtaggcctggggaggcgaccttacagcgcagcctctggtgagcatcaagatcaagccttgacgcccatggaatggtacgtggcgcggagcgcctgacccttgaatcaggatctatgattgtggcagtcttaagattggggatgacaaatactctcaatgtgatcactcttggctatgcgtagactgataagtgatcatagaggctcgtttacgatgtcacatttgatagtaacaagtacatagactaatcgtgcctgaaaggatgccttgcacctcaagtacactagtgacccattccatgtgctcggtatgatcaagatgctctatcgtgccggggctgataggctccggactgcgatgtggggggctctaggtaacccacacggagtttgtacccgtgttgtcattgatcaggtcctcctttctgtgtcggcgcaagcccaacaatgccatgcatgctactgaggccctttgtcgtgc

SEQ ID NO: 55894 - DNA, 511 bp, Triticum aestivum
  Clone ID: PAT_TA_55894
tttttgagtctcactaactcgcattttgcttgatcacaaggagggtggattctgtttaccacacgcactctgcacagggacaaactataaccctacgactcagaacgaaccacggacgacgccggtacgtagcaacggctccgctttgatccactagggcgagtggcaccaagcacaggaggaagggactatctagtcattgcaggccaaatggcagcgcccagttgcttcgaacttatgttcctatctcggtccatacaaatatctatccaattggaaccgtcctcgaggataggtttgcccgattgctcggtcgcacgctctataggcatcacactccattgccatcaccaccttgaaccgtgcaccagtgaaaggcggactactgtagctgatgcgtccatgcacttgctggccaattcattgaactagcgcattggcttacacgatcggacgcccgacggctggacggcggagcctatgtgaccagttgctgtgctcgcggcaccat

SEQ ID NO: 55895 - DNA, 536 bp, Triticum aestivum
  Clone ID: PAT_TA_55895
ccatcccatccccaggtcataaacccaagtcggactcgccttcctcctcgccaactactcctctcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgatcttggcaagggtggacatgagctgagcaagagcactggaaacgctggtgcacg

SEQ ID NO: 55896 - DNA, 653 bp, Triticum aestivum
  unsure (1)..(653): unsure at all n locations
  Clone ID: PAT_TA_55896
caaaaaaaaaaacttacctcatcctcgtccccttctctggtccttcacaggcggcgacccatctcgttcgccggcggtgacccatctcctttgccgccgccgggaaataagctgcaccatctgagcttatttcctcctccacgctagacctctcccgccatgtagcagctgccttctcctagtgcagatcactagaccgcagccctgcctgcagtggcagtaagttgacataaagacatggaccttcacaaggaagtcactgctgctaggttaaccgatgatctagtggtcgatatcctctcgcggctgacgtacaagtctttctgccgctgcaaatgtgcctataaggcctggtccgccttctccgctgatccagactactgcaagaagctgcccaaaaaagtaaccactggccttttgtaccaaggccacaataagtctgcaatcccgcttgttagcctgtcccaagatgatggagaaatcgatggaattctttctgacatgccacagtatgagcatttggaatttcttgactgctgcaatggtcttgtcctcntgaagtacaggagcagctatacctctccaggcatttgtcgctttgttgtgtgcaacccagcaacacgagagtggaggatacttcctgacactcatgc

SEQ ID NO: 55897 - DNA, 548 bp, Triticum aestivum
  Clone ID: PAT_TA_55897
gggacaggcgatcctgccgcgaagctgcattgcgcgcttcctttctcacaaccaccgacacggcgagcggcctatcccctgggactaccgccatgacgtggggccatgtctgcctctgccctcgcccccccgggcgggagttgaggcacgcgcgctgctgctgctacttacgtaccgctgccacgacgcgcacgtgctcacatgggacgcgccgaagctgaactacttcgatctgggctacctgctgtctatgctccgcctcgaccgtgtagacctgtcgaacggggccttgctctgggcgaggtcctggacggaactaccgacagggccccgtctccctgctttaccgcgcctgcggcctggtggtgactatgattgccttcaacaacccgcacgactacgtctacacctggcgactcagccgcatgctccatacgtcactctaaaagagcaagttcaacccgacgacctaaatagacactccttatatgacacccgagaaatggtggctgatcgctccatgcttgagtgggtggacactatgtacg

SEQ ID NO: 55898 - DNA, 590 bp, Triticum aestivum
  unsure (1)..(590): unsure at all n locations
  Clone ID: PAT_TA_55898
cagtgcgtgtgnagcacaggcacagagggttgggggcggctatgagctgtttttaggagggcaaccaccaccaccaccactaccaccgattagccgaataaaaaaaagacacaccacaccatagcgcagtggtactacaacaccaggcggaaagcccccccagcccttccccaattcattccatttgttccccattcccctccaccaatacccctcccgccagctcgccgcgccgcgccccgacctgctctgtctcggcgcgggcatcgggatacgtgggatctgttgcggctctgagggatggaggccatcgccgggctggttgcggtctcgcacaaccgcaacgagctcgtagtcatccgccgcgaagggagccaggggcgaggacggtcaaacagcacaaccgcggggcgtgccaaatttgaatagacgacctcgtgctacgccccggcggcgaccccttcgtcatctgcaacgagtgcaccttacccgtatgcacggactgctacaagtacaagcgccgcgagggcacgcaaagctgaccaaagtgcaagacctgctacaaacgccttatgttgtgcccgctcgtg

SEQ ID NO: 55899 - DNA, 513 bp, Triticum aestivum
  Clone ID: PAT_TA_55899
gaccgtacctggctagcgcggggctcaggcgcttcatcgatgcctctagactcttcggctttaacgactcggctaggatgacacgagatatcccaagagaactatattacacttggcgggacatacaagaacacgagtcaaacatcgtggcgtaagtgttacacatggaacgagactacacgtgaatgatggcactaagaagtaacaactatcaaaaaacatgtgatgtgtattcgcccatgcaagatcactgtccagtctactccttacgagatacactagaggctgctgttgagattattaactatgaagtaccatgtgacagactgatgaacgaaacccgtacaaacgaggtatagcgagccataacaataaaattcacaaaagtgtctatgtcttatcatacgactgctctgttagtcagaacaggcatgctctgctacaaacactacaaagacctgagcaaacttacagaactaactggtcaggtgaacattttttgctgggccacat

SEQ ID NO: 55900 - DNA, 613 bp, Triticum aestivum
  unsure (1)..(613): unsure at all n locations
  Clone ID: PAT_TA_55900
cattgatattgctctgtgngaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcagaacgtgtacaagattggcggcattggaactgtgnccagtgggccgtgttgagactggagtcatcaagccaggcatggttgtcacctttggtcctactggcctgaccactg

SEQ ID NO: 55901 - DNA, 617 bp, Triticum aestivum
  unsure (1)..(617): unsure at all n locations
  Clone ID: PAT_TA_55901
cnganatctagcagctatatagatatctggcctggcggcaaccgcggtacccgccagttttaagagaatacaaccagctccgtccggcgaccgactgccagatcgatggccgaaccatccgtgaagggcctcggcaaatcctcccccgacgtggtggagggcaatgaagttgataggctcagcaagttgcctgatgacgttttgctcaacattgtagagcgacttgatattgctgatgcagcacgaaccaccatcctctccagacgttggaagcagatccctgctatactctcaaagcttatcataatggttggttcttttcaccccaatcatgaaagtaggaagttaacctcggatgatatagttcgggccaataccatcgtgctggaagcaaccaggagcatactggaaaggagggctggaagtccatacaccattcacctgttgcgcatgcaattctacttgggagatgagtccattttcattggccagactgttgccaacaccatagcaacacaaaaggttgcttcagttgagtttacaatcatgacgaaggtgcgcaaaaagattaccaataatgggctgctcacttatgggaggcagttcatgtcattttt

SEQ ID NO: 55902 - DNA, 568 bp, Triticum aestivum
  Clone ID: PAT_TA_55902
ggcaataaataactatatgggagagttggtggctgtcatggagaagagtaagacagatgatcataagggttgatgacaagggatgcactggatgcgataatactagacctggtcatgggaggcgtccattaaaggttgggagagaaaaaaaaagcttggaaacggctcctgcaaagacccttgcaacacgaaaacaatgaaattcactctaccgtaaaagttgggctggaataccctaacaaattactcgagcaagctctccgaccaggggacaaattttaattgtgtaccagaaggcgactttttaaacttagacaatgaaaatggtgttcaaaatggtcaacacgtttcaattattgatgatagaaaacctctgattgatagataaccttaagacttcgaataacacaattgcacacttacacatgatcgcttagtaacagaagagactgacgcccatccaacatactcaatctcactgagtctcaactttgaccacatttaagaagaacctttatatctctataaccacattgagcaaatcagctcacactgtgttactaaaccc

SEQ ID NO: 55903 - DNA, 569 bp, Triticum aestivum
  unsure (1)..(569): unsure at all n locations
  Clone ID: PAT_TA_55903
cgtcagtaaacanagctccctccaccaccgtcgttggtgcggccgacggtgcatgagctggcggcggccgtggaggagccgccgtgtacatacttggtggcgcacgagcaacatcaagtcctgctggccggtggatgagatgccggagcccatccctcttatacatcttagccggtttactacggccgccgacgacccaaaggccgctaggttccggcgggtcttacagacctgggggctctttaggggaccaaccattgaatctatggagtttctcattgatgccatgattagcgcgttatagggaattatttcggctaccgttcgaagagaagcaaaaatgccgcaacttgttttgacagtggcggcaagcactctgaggtggaaggctatgggaatgaccaggtggttaaccaggccgagggcctctactggaacacaccggctgctatctgtgggtggagcccgaatatgagaggaatttctccaagtggaccgctctaccccaatctttcatggatgtgctttttgagtacgcatcacgaaccaagagaatatnagacctcttc

SEQ ID NO: 55904 - DNA, 560 bp, Triticum aestivum
  Clone ID: PAT_TA_55904
aaagcatatgtttcagatctacaacaagttcacgatcaacatatctatgaacattctttacatgcctcaaaggcttactacacacctaatgaggggtcttctcatttccaatcaggcatgtctaagagccacaaggatctaaggctggggaccttgccgcataacaaaaactgatccagtaccaaatacctggataacagggaggccctttatacacgaaaagcaaggacatccagccccggatgtgtgatatgaaagggagtctgggcgaaaacctaacatattcatatgccaacgcccgtgctgcattggtgtcaaagtaataaaaactcacaattgtcgattatacaagtaatcttgatcggtgaccttgcagcgggcaagaacaaacacggggatggctggccccatagggactggcacttagtgttcgacttccatcatcaaaagcagtctgcggcattcatatgtgcaacaagtacatctggtatgccagcaggtgtgttctttaaacctcctcgaagaatgcattctgaaactgcttgagagaaaaaagtgat

SEQ ID NO: 55905 - DNA, 458 bp, Triticum aestivum
  Clone ID: PAT_TA_55905
tttttagtaccatcagcacaaaaaatattatccccttcacaagatggtacacctacacattcaggacaaaatacaatcccaccacgggacactcaaaagctaccttatcacaagtccaagtaagctcggttgcaacgacctaacttattgcgctaaattatagcacaacacaggaaagcttgatcaacggcacgggttgcacggcaggcctgggataccatcacatcaactactgatcaatcacgcaaaaatcagccctacattattataacttggggacaggatcgatgctgaacttattcaagccccactttacattcttaatgatctctaaaacaccagctaacttgtactttaggactaggaaggcctgactatcatagctggcatttgtggccttccaccaaacacaaaggaggacctgcccaatggccacacttgcacatactgactgcggt

SEQ ID NO: 55906 - DNA, 580 bp, Triticum aestivum
  Clone ID: PAT_TA_55906
ttttgagaaaacaaattccatttcactccatctctcaaaccaaacaccaatatgtaatcatttcactccttggacttgcttctaccgaacaaaaggatggaacggacccattctggtggaatggaaccatgatatttcgttccacttcgttcttaaaccaaacacactcctaatgtctacatagtacgggacatgcttctccatgggccaggcgatctctgccccacctaatgacactctccaagccgtcggtcgcctcgcccactcgagcccgccggcgatgcctgtcggccaccgttcaccgtaacacttgagacatgacggaacggatacagctcttagctcgcctcgccggccttccattgtactccgtcgtacgtacgcggcgcgggagagactcggtcacgagagcgtccacatgaaaaacgcggaccacatggtgacggccaccgaggcgagcgcgtacacccacacgaagatcaccgagcactcgctctcccccacgccgaacagctgcgtgatcgtcccgatgttcatggcgggcgggacggcgtactgcagcaggaggacgaactggtac

SEQ ID NO: 55907 - DNA, 591 bp, Triticum aestivum
  Clone ID: PAT_TA_55907
ttttgaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacgttgttgtcccatgccacggggccgacgccgt

SEQ ID NO: 55908 - DNA, 584 bp, Triticum aestivum
  Clone ID: PAT_TA_55908
ggagcataaagagacatgtaatcttacatatactgaacttaaacaaggtagtaagctgggaacattttaggttagtagaaaaacctggaatccaaacaaaataaaaaggggaaggttcttggcctggacacacattataacaccgattagcataatttacaaggtggttcagcacataaagcagggaacggtcccactggcatacagagaagaagacggcattcactacacagaagattcttgagctggaagttttgagtagcatggtacatagacatggtattgaaaccgctcaaagtggtctcgtatctccttgagttccccagtgctgatgttgtaggaaagaactttatttgtcttctggtcagagaggaaaacaaggtctctctccaaatcgagagcaagaatccagtaatcacagttccaaaaccagtggctgtcaccaccatcaccaccattgtcatagtaaacaaagtcatcccttccaaatgcatctgccatactaatatgacacttcacataccaagtccctggaacatgagcatattcatctagagtccaaatcacgattgagtgaacactca

SEQ ID NO: 55909 - DNA, 571 bp, Triticum aestivum
  Clone ID: PAT_TA_55909
ttttaaagcaaaaccagcgatgtttattgaagggtgatgaccacacatctttctagcgacggattgcacggattacagttacgccttacagtgggtttacaggccacaagggcggtgaactgccgtacatcaagacaagcaaggaaaataggaggctttaggttcatcacagctgaaatggtaggcaccttacagcggctggcgatgggggatgcttatacttgctgagaaggaacagacacatactgctacagggggtggtgggggtgtatgattcaggcgggctcaggcgatggctccggcttggcgacgacgaatgggaagttcaggacaaccaccttatagatcactgccatgaaagagggggataatgcaaagagcttatactggaccatgtacgccagcatgtactgtgaactgtcgaagctcatagaaaagacctaagtgaaatcctgtgtgaggggctcattgttcagtacgtcactttgcaaacaagaatttgacaggttctaactccaatggagcttggcgagctactgaatgatgtcctatcaccaccacaccctgcttg

SEQ ID NO: 55910 - DNA, 543 bp, Triticum aestivum
  Clone ID: PAT_TA_55910
tttttgccgaaaactcccgtctgcccaaaattatgcatatatgaggcccagttacccaccatggaacaaaccaataacttaccacttgttgcctgtgggctttctatctacacaagggctggaggaaaggaggaaaagaaaaactggccacctgaacacccttcataccactccacatgaagaccgaagatgatccatactctcctaagcgtagcacacgccagacacgctctccttcagaatagggccggatttcttggcacactaatgtttcaaactccccaccaccttcacattaacatataatcgacccgttggcctagataacaacaaacataagccgaccatttcctccttacaactatatcccttatgaacctatcaagaccgactataagatcgaagaacaccattagcttcaataattagcttccaaatatgacaaaaaatccggtcttgacatgcttcagagcgaggctacccaccctgtgaaggtaaatgcatacacggtgccactgcacatgactgcgttccgcctactga

SEQ ID NO: 55911 - DNA, 484 bp, Triticum aestivum
  Clone ID: PAT_TA_55911
ttttttttttttttttttttttttttttttttttttttttttttttttttttttttttttttttttttttttttttttttttttttttttttttttttttttttttttttttttttttttgttttttattttttatgtttgggttggtaaaaaaaaggggaggggttagagttgaaattagaaaggggggggaaaaaaaaaaggggggggggggaaaaagaaaaagtgagaagggggagggggaaaaaaagtgcattgacaaaagaaaagggctagtgcaatgcgcgagtggcaaaagcggaataagacccaaaacttgggggagggcggggatttttgatcccgggtgggggtgtggggttcgcggtggaaaagcaaaaattaacccccggggttgagtgtggaacaggcggggggaatggataggtaaggggggacgaaggggggggagtaaaatcattattagaaaaaaaaaacggggagg

SEQ ID NO: 55912 - DNA, 587 bp, Triticum aestivum
  Clone ID: PAT_TA_55912
tttttaaagccaaacaaatgtccctgactatccattaatctatgttatctcatatttcctatctcataaatgtccgccactatcttttacagccacactgtgaaagtaaaaaggaaaaggaatcctttcttgtgctgctgtcaccgccctgtttctaccgagcaggacattgagtcatggcacccaacatgtggagtgcagggcaagggttgccgatcggcatcatgtggccagccccgagtatccaactgaatataaggttcttgcacgacttgaggaatgcctgagtgccacctgattcaccttcaccttcaccttaaccccccttgcataagagcggatttctgggcaaccctgtgaaatcctttaagccttcccacttgaacttttaaacccatttcaccgcatccttccttgcacagatcatatcaaactgaccgctgaacatgatcaccttcacgccacgtatggaggagtacatcaacccttgtgattctcggcttcatgaaacctgctgcaaaggcttataacacgtggtaccactgctctacccaaccgaagtttttggggatgatgcccagctcggc

SEQ ID NO: 55913 - DNA, 469 bp, Triticum aestivum
  Clone ID: PAT_TA_55913
gggttcaagcatataaaccgcgcaccacagggtgatacaggacgcaaaacataccgatacataacctagacatcaaggcatacactgccagaggtgaaagacatgctggccataaccagatgtatcacaggatccaaacactttgcagatatttttagcaacatacgaccagattagggatagcaagaccccaaactgagagctatacctttataaaacatccaggagagatgtgcatattctaggccctgattattgaacatatgccttacgagcgaaagcgactagttgtcagggcacgaaggaatgtaaactggactgcctactagtcaaacacacactggctgaaagccctgtacggagtgctggatcctacaggtgcttgagaaccgaatagataaaatgacggagcatgaactcctttattttgtagagcagcctaccttgactgcatgtctatgcaaacatt

SEQ ID NO: 55914 - DNA, 581 bp, Triticum aestivum
  Clone ID: PAT_TA_55914
caaaatacacataattgaaaggttcgctagtgacaattaatcgatgcatacaatgatacaacagttcctatcaactgctgcagcttgcagcttaagagcagtattttgaccacgtacgaaatttccctaaactggggaactgaatctggacgttcgaagacagcatccccatgttgagtttgtggctaagcgacgacttctccatcaatgtccactcctgaagcatgtgcttgcagttctcacacactggactcttaaaaagttttatgtcctccagattcactgctgcttccatgacattcctgacaaagcgcacgatgttgtcttgtgctcgaaacctcccatacattctgagctcggcaaggttgtggtgcttgaaatcaggtgcaggttcccactctagtccattgtccttctcctcgctaaacacaaattttttcctctgctcccccgaaatcatttcacataaatgatcccgcaccaagatgcgtagttccttaagggtgggtgcaccttggagtatgaacattatccaagtcaaatcacattcttcagaaatgttaagcaaattcacaagcgtt

SEQ ID NO: 55915 - DNA, 520 bp, Triticum aestivum
  unsure (1)..(520): unsure at all n locations
  Clone ID: PAT_TA_55915
cgtactaacttggacctctanacggccggccgggggttgggttttttttttttttttttttttttttttttttttttttttttttttttttttttttttttaaaaggaaggcttttattattattactcggatctcaggggatcatgcctccatggcaaaaaaacattctacgggggcgcagggggggtcaacgtacaggccccccccacccccccatttattcaattattctcccctgacatctcctccggcccttccctcgccttcctttcgcacgaacccgggatcggaactcctcacccatgcccccatgggggccctggccccacaattgggtaggtcccccatttgctccccacggggagggcgacccccgcttcccgggagcaacgtaccaacttttcggggctgataatcccctcgtcggcgggggggaacaccccgcaaatgcagggcatgtccaccttcctcccctcaaggcggcagggcatgtctggggtcaagtaggggctccccttc

SEQ ID NO: 55916 - DNA, 503 bp, Triticum aestivum
  Clone ID: PAT_TA_55916
ttttacccattaaaaaccgccctctgcatccttaaatcatcaaataatttgttgagtttaaccttcaattccatgcccactgtttatgagcagtccacattgcctggtgcaagttcattctgactttattatgctcccaatgcgtgctagagcataaatacggcaaaggggctctaaagcgacctggttcttttacctacggaataccacatccgcccactatggaggcatcaccatacgttgcttgttcccatgcaacctacttgaaaaataaccttgaggctcacttgacacatctagctgtagcacaccgtgctgaaaggggcgattctaatgcctgatcgtgcttgagcttgaccttgtggccccatgtctggatggacctgaacaacgccactaacgttcatacagagcgcctttccctttgcttcaaatgcattgcatgccctctccttagaataatcttacccactggggcttaatgacaccctgcgtagcccttg

SEQ ID NO: 55917 - DNA, 329 bp, Triticum aestivum
  Clone ID: PAT_TA_55917
cttggcttgaaatgttatgttcagaacgaaagaaagaaccgggatccttggccttgaatttcccatatattgccggtcgctcattatccaggaaaccaggcgctggctacagaaccgattcttcatacacagcataaaacacggccagctgaaagcctatttctttcatgtgttggctccaccctcgagagcaggcgttcttaacagctcaggccctatatctggcttaccacctgccaatttgcatacccttacacctgataggcttgaacactgcccatattaagatgtctgcataacctgctaatcttcgaacggttgcccgaaaa

SEQ ID NO: 55918 - DNA, 601 bp, Triticum aestivum
  Clone ID: PAT_TA_55918
ggggagagcatttaaccgagtagttttaagagcggctacttatggcggtcacaccacgagtgagctaacgcatgtgtggggtctaaggccaccggttacctgcatcactggactagctaccttccaatgaacatatctcatggtacagtgtatctagaagagcatttcctgaggcatgatcgtgcatacctagggcctctatcttgccgtgcgtaactcgagcagcgtggtagcaggacatgccttatatctatatgactcgactacaatgtacctttcatgtggcgccactcgtgaggactttacgcatgattgcgagtccattcagaaggtacgaatgcatactacatcggagcatgatggtggcaacaacagaataaaagtctgttctaacagcttatatcattataatctatgcagaagagggatgaaagcctaacatgattcactgacgtatggacgaacgacagttattcgcatagccctcatggctgtcagttacctagcactacaaatcttcactacactttctactgcatccagacagacgagctaacagcatcaatcctgacagcgacagatatcacgacaaccatcttac

SEQ ID NO: 55919 - DNA, 488 bp, Triticum aestivum
  Clone ID: PAT_TA_55919
ggcagccgggcggacagggcgctgggctcggtaccggcatgaaccgcatcgtgggcgcggatcggcaccatgaccttggtctcgctctacaggggccgtccaccgtgggcccagcatatcgtacctgtcattgcgcgcctgtgagtggctgccttaatctgcgatcatatacacctggcctcccggtgaccatgggccggaagcatgaggacatggagcaaggaattacgacaaagtgaccaacacagctaccacatctctcatcattgttggattctcgtaaggtatacatgcaatgggaaacaaacagaaggaggacggcccacaggtaaagtggaatgggtggggggctacaatggattaagaaatctctcaatatggatcggaaattgcgtgatcaaacacattcgacatgtgcaaaatgatgctctctatgcctagttttaatggtgatttgggggcacagtcctaacgatacatgcttacgt

SEQ ID NO: 55920 - DNA, 427 bp, Triticum aestivum
  unsure (1)..(427): unsure at all n locations
  Clone ID: PAT_TA_55920
ccttcactgccgctgtgccgccttagcgtcaccgccggcgcctcgnatccgccccccnntcctcccgcctcccggnngaaccgcgcttttggnccgnnncggnncaacccgggncccaacccgggggncccaaaacccgggccggttcccccccctttttttttttccccccgggcccaaccgggggggagggaaatcccctgggggcccatttggggggggccttccccctttttccccttttcccccctttccggncgggggggggggggggggggttgttttttttctcccccccccaaaaaaaaaaaaggggggggggggttgtttntctccccaccccaaaaaaaaagaaggggggttttttttttttggtgggggggggggggggggngnggnccccccccccccccccccccccaacccc

SEQ ID NO: 55921 - DNA, 623 bp, Triticum aestivum
  unsure (1)..(623): unsure at all n locations
  Clone ID: PAT_TA_55921
gcggcgagccgcctctctctgagcatcattcaccctcgccccccaatcccgccgcgcggtcgcctgggccccctcccccatcgtcgccctcgccacctccccctgcgcctcccaggtcgccgccgcgcgggaggacggctccctcgagctctggctcgtctcccccggctcggtcgggtggcacaaccagctcactatacagggaggcgcggagtcgagggtcacatcgcttgtgtgggtgccaaatggcgcagggggccgtctgctctcttccagcgttgatgggtcggtggctgaatgggatctcttccacctgcagcaaaagactgtcctagatactgttggggtaccggtctggcagatggccatggagcctacggatgatcaattgatttctggaaataaaagctcaggatgtgctgtgaatggccatgcaaatcataatggatccaccgactctgaattaagttatgttgatgatggtcagagctccgatgatgaagatgattctgccaagacaagctcttcgtatcgtgtgaatgaattnccgcgtttggctctggcatgtgacgatgggntctgtacgcttgtataatgtgcctgaatctggcccgctgacctac

SEQ ID NO: 55922 - DNA, 444 bp, Triticum aestivum
  unsure (1)..(444): unsure at all n locations
  Clone ID: PAT_TA_55922
ctctgtcctcatggatatcaacccatgggacgatcagactgacctgaataatgggggggaagctgaccgcacagtccaacacggaggggctcacccggggtgcatctaaacttatgcccacagggtcacggctatcaagaacctccagatcatactaaccatcattgacacacctcgagtctggagacactcttatcgaggaagtgctatgccagacgcccataaaccaatatgaacaatcaggagcacatacgatggctacaacaagaactacaatctttgctaactcactcgatgctgctgcattttcgcntctgtaatctctagaactagaaaacattattcgatgaccatttagataccactattacaaaaatgataatgggtctgatgatgagcgaagccctaatcttgaatgtctcctacctccaaatagtgagcact

SEQ ID NO: 55923 - DNA, 636 bp, Triticum aestivum
  Clone ID: PAT_TA_55923
aagagtcctgggttcgaaccagcctctctgcattgcactttgcaggggtaagactaggttcctataatccctccccagaccccaccttgtgtgggagcttctatgcactgggtctgtccttataatcttcctgcagtgctcctttgttggattccgaaagtatgttaatgaaaattgcgagttgggatgttagtgttgcataaaaagaatagtgattattttcagtctgggttgcttgcttttgcctgtatttgcaacacaagttatagatgtgacacacttcatctataagaaattgcgctccatgtctagataatgccctttagtggccaaaagtgagctagcgtccattgctggagtagcataaccaggttgaaatataaacaaggcttgttgtctgaaaaaacactctcatgctaacctgcaaggcgcaaccaccaagcaatcacactatatttttatgttcaacaccatataccgtgcaaaatagtcacctcaaattagctgaaaatgacctccatgatcagtgaggcctcctcaaagtttcctacatgagaaattagctttccttttattgacctggtggtgtatgcatatctttctttagttacgcaactagcacatgcaaggtttgcc

SEQ ID NO: 55924 - DNA, 560 bp, Triticum aestivum
  Clone ID: PAT_TA_55924
gccatgaacctgtagcacagcgggaatggcctggacggatgcggggggcgcacttctggctgccgccgttgatggcgtcacgtggcactaccatcgcccatcactcctagatggtactgcctgtgtaggcagcaacatggtgcgcagagagagttcattaccacccagagcaacgccgactaggttggagggcttcgcctgtgtacgtgaaagacgccgacctggaggctcaggtaccggagctgcacttgcaggcagagatactcgacctacccaacctatgtgagaaccatctactgatccaatcaaagaatttgctatagacttatgaagacagaccaccgcttagagccgctatggatgaacctgcttgaacaacatggcttggctcctagcttcatcatatctgacatggcacactggtggacaggcaacatcacatgggagctcggtgtccctaggctaaactttagtgggttttgtgcgtcttcttcccttgtaaggtacatcacttatcacaacaatgtatttgaaaatgtctatagacgagaaatgaactc

SEQ ID NO: 55925 - DNA, 535 bp, Triticum aestivum
  Clone ID: PAT_TA_55925
cggacgcgtgggcgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggatgcggcggggggtttagctgcggaggtggaggaagcggataccgcggccagcgatccaaatgatgaggcggctgatgctacacgaggggcggctgtggctcggacgtggccgctgcgggggctggggaggttactgtagatgcgagggcggttgcggctaccgctgctgcggctgtgcatgaagctaccgctgcagccgcggatgctcttgtagcggtacctgatgggagtgattggtgtgatcgctagctgaacacctatcctagctaccgatactttgtttacctgtctacctatagtggtatcactagcctaccgagttcgatagatatcagttcatcgcgtagctccgacatgttgtagctaccgttagatacagacat

SEQ ID NO: 55926 - DNA, 622 bp, Triticum aestivum
  unsure (1)..(622): unsure at all n locations
  Clone ID: PAT_TA_55926
cggccggtgtnatatctggacgcccaagccccgcatcctcctcgcgttgacgcacgcagccgcggctaccccaggcaggaaccactactgaagaagaccatattcctcaacgacaaacctttcgtcatcgccacagcatcttctagatcattgcatgagatcgactccaattcaaagcctattaacgggcttcaaattttttcattggaggttattgctaacctgagtgccagcaaggtggaaactggacagcagatggaaggcggcactcataacattaccaacgtgactgagaatgcgacatctgggtggagcattgtgaaggaggagctgacgttttcagctggaagtgcacctttcagtagctgccatgcttccaccattgtagagattgggaaagacaactttttggtggcttattttggtggatccaaggaaggtgctccggatgtcaaaatctggttgcagagatacagtgatggtcactggcatcctccagaagttgctgatgagcaagatggggtgcccatgtggaatcctgtactatttcagctcccctctcatgagctgctgctcttctacaaaattggtcaggaagttcagaaggggagtggtgccatga

SEQ ID NO: 55927 - DNA, 468 bp, Triticum aestivum
  Clone ID: PAT_TA_55927
caacctaaattttgaactggcgcacctagtgaggcacataatgttgggaccaagcctgctactccaccttggggatgaactagatgactccattcccagtcaccaagcaaacgttgacaggcacaacagttggaggaagaaaacagagggttagctcagccgacactcagaaaaagtaagtttggagctacgagacaatgcggatggcattggtttccatgatgtaacatataagatgtatggcgtctaaaggcatgactactgtgccacattttcatgaacatagtacagatgtgagcctgagcaaacaggatattgatgcaggtaagaatttatgaaaaatgagatgggcatgactcaaagcttttcaaagaatgccagtgggcaatgggctacaagacagtcaaacagggtactctactcattatagtgttgatcaaaaggtgaagaagaaagctggtgatgcta

SEQ ID NO: 55928 - DNA, 469 bp, Triticum aestivum
  Clone ID: PAT_TA_55928
ttttataatggaacatttatacttatatcctgcatttacttaatctttactaataatacctgaggcctaaggttggccggccaaaacaagcatcggagcgtgtccattacctgacaggctccacataacaacaacgtctgcagggggccgctgttcaaagcatatgcttacctaatggagcatatatcctccctcgttctatagcgttccaaccggctcgctatatccgttcttagctgatattcccatgcatccgcccaagctgttctctagcggccttccccagttgcagttcataaacgagggaatagcattttgtccataaatgcggtatcctaaacacagaataccagctcaagttaccgttatatcaccttcctacatgcccctagaatcggttgagcaagaacctttagccctactttacttaacaaagcacaacggctttaaagaaacagaacctaaatga

SEQ ID NO: 55929 - DNA, 557 bp, Triticum aestivum
  Clone ID: PAT_TA_55929
ttttgtatggataggaaataaactctaggcgatgtcagctatcgctggaacactaaccaaacgcgtgcatgtcctacaaagtctacaacacagattgctccaccaaaatctggaactctgcactgtgggcaatgtctgttaaccctatccttataacaagtgggcattacgggttttacttcttaatgcgaggtgcggttgcagaagggcatactacatacggaagatctggtgattgtaccatacgcatccgtgcataactactacatgggaagatatcatgacaatggtagcgaggcaacagtgatggccaaatactagggcagtgctccccacattgcaagggaccagaagaatgagttaaatgaattgctactatcacctctttgactctgcctattattgggtaccctctcaagaacatgcttggcctcacatgatggcgaaattggtcaacatcataaatctgtgacagctatatcgatgagtcactattcatggatatacggagactgtgtcagatgaaattcctggtgggcaaaacatattcattgtga

SEQ ID NO: 55930 - DNA, 594 bp, Triticum aestivum
  unsure (1)..(594): unsure at all n locations
  Clone ID: PAT_TA_55930
ttttaaatgcaaatggtaaattcaattgaaacataacaatccgcctcacaaaaatgatgtcaacagacacaaattttcacccaaatattagtcttcaacaaaatggtccatgtccaatagtaaagtcacattacacagttcgcgattacatgaaacggcacataaataaggatttcctgagttggaaactctttggctaacaacaacaaccatccaaagaaagttagcttcaaacgcacatttcggaacaccacattcaaacattttggcaatttccttggctccttcaaaaaatctcttctaccaagacatgttgtgcttttgcactccacaaatcttgcaaaagcagacctcttcaaatgttgctcgtaaggcggtttatcctaatccttatggtccaaccgctggtggcctctgagcaaacgtcaaagccgacatctccgcacagctgtgtgctctcgccgcggcggcccaactggcaatcggcaatgatgatggaatcccgcgactacatgggngaagacatcagaaatcggctttgccatcccaacacggatccgacggatacaatgaagaagagatttcccttggcca

SEQ ID NO: 55931 - DNA, 596 bp, Triticum aestivum
  Clone ID: PAT_TA_55931
ttttccgcccttgtgtcttagtgcgaaaggcagggctttacacaatccgaataggcaaatagcattccattggtagagacagcacttgctattatttttctagaccccttgcttttaagatgaacaacttgtcgtatcgtagcatctcctccggatgatgtacttggagtcagtttgttcttaactgatacaagtagaacgtccaagcagttgacagactggacaagcatcacagaatctccgttaactgtgcaatctcttgctaaatttatcaatggacgttgaggtgcagggcagaagttatgaggtgcatatagagtaaactcccgtgcagaataagcaaacagcttggtgtcatccccaccagaaatgagcatcggtacacccagatgtgcccacttgcggtaactgaattcatccttgcggcgaacctttaccaccttttcctctggtacagcatcttctttgcatattggtacggccatagtcaatgcccttacatcatgagagtgggccctaacatatcccacatagacccacttgtgcatttgctcttcagccaccttctcattatgagcactgaactcattttttga

SEQ ID NO: 55932 - DNA, 587 bp, Triticum aestivum
  Clone ID: PAT_TA_55932
tttttatatagaaggatccattaattcatggccacggcaacaggaacaaaccaccgtccttcatcaatcatcatcggctagtctagtagtcgtcgtcgccgccgtagtcgtcgtacccaccgccgcggtacatgtcctcctccacgcgctccgtcacgcggtcctcgatcttgttctccacgtagctcgccccgcccgccagcgccagcccgcccagcacgcccgccgccgcgcccaccgccagcccgcccgccatccccatccccttcttcttcgtcttcccgccgctctggtccaggcccacccccgtcgtgccaccgtaccctgccccctgacccgcgccgtaagcagaagcagaggagccgtacccgcccgctccctgagtctgctgcgcggcggcgccgtatgccggctgaacagaggagccgtacccgcctgctccctgggtcggcggtgctgcgccgtatggaggtggagcagagccgtacggtgctgctgcatggggaggcggcgcggcggagccgtagcccgggtaccccgacggaggcgctgccgcagcgtacgctccgtagcctccagcccccgcc

SEQ ID NO: 55933 - DNA, 591 bp, Triticum aestivum
  Clone ID: PAT_TA_55933
ttttgttttgactagttagaatcaagataacaatgcatgaatggagtggtgcccctgcacattacattttgcatccttcaatgagcgaaaaatgaacatgacctcttccaatccagaagaagccattgcacatgaggactcaggtgagcaagagtctcctccgggctctccgcaaaccagacgagcggtatctagacccttttccacacctaccgatcctaatcttcccgtccgtgcaaatccatgtatatgggctaaactaaatacgtacatacactgatgattcggtctaaaatacaactcattttctgtaacttctgacagtttgtgcgtcacggttactgtgactttcacctgttgccagaatcctgtatggaccatgctccacgacataccttggcagttcagccacacataacctccacaacagcccttttcattgtcccagggcaaggatctccaccaaatacctctggaaccacgcttaccgcacagtgctcttggttaatgcagttcttccgaaacatgtcatacgacttgtgtgcatggcatccgccttctgagtagctcccgcaggacccctgcggtgtg

SEQ ID NO: 55934 - DNA, 464 bp, Triticum aestivum
  Clone ID: PAT_TA_55934
tttttattagacaaagaatcctttctaatgataacataccctataagctcttttactcaatgttcacaccaaacaaaaagcgtaatcaccatttgtattaaccacctgctccatacgctttcatcttactttccatagattgactgattacccttatgtttccataccaaaaacctccattaccgaaagccctcattgctttaacggctcgaccctttagttctcaccctcataccattcagcaaaccatgcgtaagccatcaccccccaaacatttcatctttacctcatccaagtgctacacatcaacctcatgattatgactactcccactgctgaactgctttcacttcaacatctattctaattttcatcacatgctccagcaggtgattaattaaaaactgctccccaaggacggccatgtgaccatgtgaacacctgcacagatgccctctattgtt

SEQ ID NO: 55935 - DNA, 602 bp, Triticum aestivum
  unsure (1)..(602): unsure at all n locations
  Clone ID: PAT_TA_55935
ttttcgaagcaaatgaatctcgctcccatattaaacacacaattaatacattcggctctaagtaatcgaacgacacgcaacaatggcagatcaaaacaaatgatgctcaactcaacagactcctcaaccattaacattccgatggattagaactagacttgtgtctcgaaagctacctgtattataatctcagcaccaccccatcgagtggccaagctaactatgaacagttgatgataggatatccatatcatacccccaagcatcgatcgagcttgcactgcatcttgttctcctgcatcaaccaatgcaataaccaaacaaatcagctgttgagcacggcgcagtcgcggcggatgttgccgagcgcggggtccgtcttgacgccgacgcggccgaggttggtcatggcggcgacgaaggcggcctcgaagtcggagctgttggccgcccaggcgtcgacggtggggcgcgaccggaggtcggcgtagaggacctggtcggaggtgagcaggcccatccccttctgcaggttgatgaagtactggttgtcgaaggcgtgcggcgtcaccgggntcgatctccagcgccactttcgggtc

SEQ ID NO: 55936 - DNA, 593 bp, Triticum aestivum
  Clone ID: PAT_TA_55936
tttttgtctgcactaaaaggttggtgttcagaatcacaatacaatttttagtttccatcagggaatacaagtcaagcaccatgtactcgcagcgcaaataataaatcacaggcaacacgaactagcggcaacgtctgcaagaacaaagatatcacagcttccccaggcgcggcttcggtgccctcgtcttactgtcacccgaccagacgatctcgtctcagcactctatcgagaccgtccacgagtagagctcccgctccggcacgccgacctggaacatggccaggccggagccgtcgtcgtaggagaaaccaaccgcctccgaatccacggccacgcgcttcggcctcgccgaggagtaggctccaaccgtgcccgcgccccgcaccttcacctccacgccggcgccgccggcgcacctcacctccgtcaccgccccgccggagttgaacatcccgatcaggccgatcggcgcgaaggaggcgccgttcggcagccgcttcagcggcaccacggtgaacacctcgtactctcgcggcttcagcgtcaccggcagcgccgcgtccttgggcaggacggtcacatctcctgcg

SEQ ID NO: 55937 - DNA, 487 bp, Triticum aestivum
  Clone ID: PAT_TA_55937
ttttggaacacataatgcaatctgactacgccatatacaaagaccaagcatgtgaaacattgtgagcacaacctaagactcgaaccgtacccagaaaaaggggctaagcctggctgcacacatgacatggtcacaacatataacaaacctcaacattgggacacgcagcaattctttatactaagagtgtggtacccgtgctctttttctactggagcttgctcatgtaaaactccaactgcttgacctccatgaatgtacacgactattatgccgcactgcctcatggcgagcactcaaacgacacgtacagcatgcttagcaccactacaactgatcatcaaagctggaccccagaggacctccatgcttgttcttcataaacttgctatggacagtcaacttctaacattatccctgtgtggccatacatagcaaccttaatctcctagcccctcagccatgccctatttggaaccttcagcac

SEQ ID NO: 55938 - DNA, 584 bp, Triticum aestivum
  Clone ID: PAT_TA_55938
aaatgcctcaagccaccataaaatacccattagctactctgaattttcgtacagacatactgctcaaatgcatacatctcgattctactacttgctacgatgctacacgtaccatatataaacatggcagttctcacttgacgaccacggttaattagctctagcacaagcagcagctaaagaaacaacaaaatcgctgcacatccttctctgcatagacgaagctcgacggcagtttcttcagaaccaattcgagtagtcaaaatctctgagcttccggaaatgcttctccacgtcctgtctcgatttcgtccactcttctctttggatgatggtggtggcgtcgtctctttgggacttgtcagttattctgaaagattcgccaccgtcccgtatgagtagcaggtcatttctcctatctctccttttgccttcagggacgttcaccactacttttgcccttgtgattgaccttgtttttgagtcgatgacataaatctcctcaaaatcaaggaaaaaatctgtatcgctgaaccgcctgtttctgtagtgttttgttaagaaaaccttcataatctccctct

SEQ ID NO: 55939 - DNA, 536 bp, Triticum aestivum
  Clone ID: PAT_TA_55939
catatttgtaatgactgaaattcggggctttgttacttcagaaaatatttattactgtagttctacatagatcatgtttctgttacatagtacaaatgaaaaggatgctccagttttgtgctggtgaggtcggtctcggccgcgactttatccgtgctgtgcacaaatctctctctctctctctctctctccaccacccaaaggacaagccgtcgtccgctcgtcctccaggtcccacaggggggcgcagaaggcggcttccagtgccactgccatcattcctccgcggctcttcagagtgcgtgcatcatggcgccaggcagagcagcaccgatctgctagccgccttcactctcgctcttgtgttcagtcactgcacggaaggtgtttgacaaaattaatgaccaatagtgagtgacagcgccgaggcagctccaccttcatggtccgaacggctgcatgtgcacatgccgtcgtgctgtgccgatgctgccaaagtagcgccggaggatgagccctgagcctgttacaagaaa

SEQ ID NO: 55940 - DNA, 616 bp, Triticum aestivum
  Clone ID: PAT_TA_55940
ttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggcttcggcggcggcggtggcggctacgggggccagcgccgtgagggcggaggcggcggcggctaccgcggcggcggcggcggctaccgaggtggccgcagcggcggcggcggcggctaccgcagccgtgacggcggcggctactgaggcggcggcggcggcggctaccgcggcagccgcggcggctccggcggcggcaactggagggagtgaatggtggggcccctagctggccagttatcctagttaccgat

SEQ ID NO: 55941 - DNA, 532 bp, Triticum aestivum
  Clone ID: PAT_TA_55941
gtcgcctccgctcgtgcttcgtctccgaccacggcgacttcgtcctccgtctccctcctcttcggatttggaaagatgccgacatctatgagatgcggtgatgatctcacaaggagtacaaatgaggagctaataaccagcaaggctgactcgaagccgagctcaaatgagaacctaagaacttgcaatagtgttggaaagttgattgagtcattgcctccaggttcaggtgctactgatactgccggacttggcagctctagtggttctgctcgagatgtctccgactgttccggtggagctccatccaaaacgacccgtggtgtcgtctggatttacttgtttgatggagacaccattgtgtttttatgctccggccttcctatagaacacaatccgtcttgcacaaaagtgttgacctcaacaaatttggctgcagctatgagggacaaaacaaaatccagctctgccatgaagattcaagtgcgcgatgcatttagtaatgttgcccctgggtgcttggaggaatgtg

SEQ ID NO: 55942 - DNA, 657 bp, Triticum aestivum
  unsure (1)..(657): unsure at all n locations
  Clone ID: PAT_TA_55942
ccccgcgtccgtgactcctcttcttggtcccgaagccatccacgcggaccgcgcctccttcgctcgccatggcgtccagagatctccgacggctgctcgacggcgcagccctcgtcgcccgcgaggccgccaggcgctcttccggccccgacatcctcaggtccgccctcctcgccgccaccgacctcgccggcctcaccaggggcacccctcgccgcccgcagcccgttccccttcctcctgaatcccaccccgagggagcagactcatctcgcccctcttcgtcctccgtcgtgtacttctcccacgacgacgcgtcgcctctcgaaccctcattggagcagcaacccccgccccaagaatccctccaccccgcccatgcgcgggacatcaccggcacccattcaaccgccgcagccgcggctgtggctgaacccgaagccgtggcggtagctagacccaaagacgaggcagttcgccctgaggtttcaccgtcatccacgcccacgcccacgccctcgccctcgtnctcgtccttgcccacgcctgcgcctgcgctggtggagaagaggcgccggccaagggagcggaatgttccctccacaccgttcacccgagccctcgggtttgcaggtctggggtgccgggctggcatgg

SEQ ID NO: 55943 - DNA, 545 bp, Triticum aestivum
  Clone ID: PAT_TA_55943
ctgcagtctcctacctcctttaccccaacccaggccaggaatcgccctactctccgccgcacccctccccccagtaaaccaccatgagggggctcaattcaaggcgccgacatagtcctcgccagtcggcggagaaacagcagggggcaggataagccggccgccaaggggacagagggcaaagatcggcaaggaccccaacaagcccaaaaggcgccatccgcacttctttccatttatgggcgaattccgagaggagttcaaccataataaccccaataacaaacccatcaccgccgacagcaaatcagacggtgagaggtggaagaacttgacctaatcggtaataaggccccactatgatggccaaggctcaacaagctcaagggcgagtacaacaaggccattgctgcctacaacaagggcaagagcgctgctgctgctgccccaaataagctgctgccaatgatgtactaggagaagatgacgactaatctgacaagtccacatcagagatcaatgactactattactatgagggcagc

SEQ ID NO: 55944 - DNA, 530 bp, Triticum aestivum
  Clone ID: PAT_TA_55944
agcgatgacctgagcctagaggtgccctcatgcatacaatggaccaccagctggtcgccctagacatgctggagagatggacccgatgcgtaaacttcatggagagctgctgccgctgaagaacatctgcgaccagcatgcacgccaaaggtgagatcttaacacaacacactgggccatagatacatgatatgtactctgcacacacggcccttacacgcatgaaagaccgtcaggagcttcttgccgctgaatacaactccattttccttaataagctaattacgcttgctatgcacaggaacaacaagaaaaaggagatcggctactgtacttgtttcttgactcagcctatgacgtatgttgaacaagggatatcaccatgggattcatagtgctacagccgttcgcagaagacaccgccctcgacggtggggctgcttctagggaactcgccctcttactgggcatgcgacgatcgatgaattcttgctgccactgaatttgaatgacatgagcagcaagctaca

SEQ ID NO: 55945 - DNA, 633 bp, Triticum aestivum
  Clone ID: PAT_TA_55945
cgctagtactcgaacgctgccgacggcgagcacgttcgcgcatctcctgcggcgcaccgattgtttctctcggactggacctcgtgtggcatgagtgctggctctctcactgctctccagctggcgccctgccaccgactatgggagcatcagcatggacctcgtattctgtgcgaacgagcaaagcgggcagccggacaccttgtagccgacccgaggacgaccggcacccgctcggctctgagagaacctcatactgaatgcgctacaccaacagcgacatgcgtgatagccaccatgactaccgcgtcgaccacaccgtctatgcttgactgagcaacacatactagccgccactttgatcactacatatggggtactctctgtctattgaccgcatcagagctgcgtaccatgatagtgcatacctgtataacgtatattccatgctacgctatgattgttgctacatccgttgatactctgaacagctatactaatgctgaggatagagatgctagtggggagatcactagggcctacagtcatagggcggctaccctgctatactactagtggcattatcactggtgcaggtgatctggacaatatgctacagactatggactgata

SEQ ID NO: 55946 - DNA, 526 bp, Triticum aestivum
  Clone ID: PAT_TA_55946
ccacatctcaacgaccacactatctcgaccggatctccagcacatctgtcggatcctatggggagaacagtcgtctgtgggcccaacgagaacagccaggtgggtgactgaatctgggacaacagggatagccaatatgaatgacctaccctacggcatccaacactggcgaggagcacaaggtgcacgcgccactactctcagcacgagtggcgcaggttgaacaggatttggtacacttgcgttgtttgcatcaacaccctcgacaacctcattaactgacacaacgaccccgccccgattggaaagggacaccaactcatactaactgaaagtgctacccagtacatataggaacacagaagcctcatgccttccgtgcctacaaaaatgctgggattctcaacccggactatgtacacagactaactaaaggccctataataaaatgtaggtcggagctatctactgttgcacataataccctttaaggcaacacgcttctcggtggtgttgcgaataaagc

SEQ ID NO: 55947 - DNA, 634 bp, Triticum aestivum
  unsure (1)..(634): unsure at all n locations
  Clone ID: PAT_TA_55947
cctcttgcctcgtctctcccccgcactccatccatcgcctcgccgccgttgcccgcaaccccctgtcgacccaatctcaatctcgcatcaccttccccgacgggacgggacccggcgcctcgtcctctccacatcttacgcccgcccgcccgagtcttcttcgccgccaaaaggaaaagatgctctacgatatccactgccgtgcccaaatccaagccctgcaggccctcttcgatgagctgggccactccaatgacttaatgcttgtgaatcttgtctctctagagttggtgcgcatagcgtgcgagtcgtatgcactcctccgcccgctgatcaaggagtatgtgttctgggcatgcccgaagctggaaaacctctcggtcgtggcatgcttgtcgctggaaatccaaatgctcgagcatgatgtgttaccccagctcaaggttcaggaagccaagctggaacagggcgccctggaagccctcctactcatgaagaactcagcaattttgctcttagatctgaggaagcgctttatgttagccttgggcgtattgcttgccgagnacgatctggtcttagcccgagtcaaaaagctgagcataatgctaaaggatactgctgatgatgtact

SEQ ID NO: 55948 - DNA, 587 bp, Triticum aestivum
  Clone ID: PAT_TA_55948
ttttgaggagacacgagagcccaaacttgatcatctacagtgtcctcgcttgcttataaatcgcaagcccacacacacacaccgactccggcccaaggcccatgacttacaacgcgacccacttgactcgttcaaatcttcccgcttacgccagggctcttgcgccacttctcgcgccagcccgctcttcctgaacctagtgccatcgcctcttccagatcacaagaaggttctctttctctttactggatcatcatagacatcatgtcggcaccggcacttgcctttttcgctcatagatcgtctatatcgttcctgctgtcgcacgcgtaccctaatccttctcgcaaattccaccaaattttcaaaaattacacttccttgcacataaacatgcctgccatcggaaaaaaagccatgccaacaaagttcccatcaccgtcgaagagtggcttgccatcaccagcgttgcaaagcacagtctcggaaggcgttgaaacttttttactcaggatctcttttacagctgtcgctccaccagagtcattaaagtgtatggctactacgacaatgaggggcggaatttc

SEQ ID NO: 55949 - DNA, 583 bp, Triticum aestivum
  Clone ID: PAT_TA_55949
ttttgccgcgacaacaatccctccacaattcagttttaatttctccatacacaaaaaacagaattcattattgataccacataagaataagattatgttttgtccaccatataaactccggtgtatgttcatttgaaacttcaggcatacataccccagaaaacgttcggcgcaacctgaagcttgttgccctgtaaaacttctctctaaaatgtggtctatctacacatcaaggatcagcttcctgaacttctccatgtgctctgcctgcaatgagatggcgatggacaggctgccgtccttggtcgcgctcgggaggacgaacgccagtccctcgtacgcgatgccgccaggacccatgaacaccggccgcccccagccgaaatcggcgtcgtggatcggcaggcgcacccagctggtgaggccgaggttggggcaccggaaagtgtgcgctccacggaccaatgctgacaggtccggctgcatctccaggtagtccagggctgattggcagtagtcgctggtcatcctgtctagcgctccctggatgaccgctgctccttctgccagcccgctcgtcacc

SEQ ID NO: 55950 - DNA, 429 bp, Triticum aestivum
  Clone ID: PAT_TA_55950
gagcggttataacaatggccccctatgttgaactctatcacgtcataaaccaattcaccaacaccccttgcacactcaggtatgccgtcaccatttcttgtttagttaatacggactccgtatacaaatgaggcatgggggaaaaaacagcatgggagaaccgaaatacacaggagtatctctttaagaccatacgggcgacgcggaaaagctaacgtaacggaggctattgaatgtatgagtccagtgcgtgctatgacatgagctccacataacctggtgaacttatgactctcgttcaggaaccgcatggttaaatttcccatgccttaattgactcagactaaaacggcggcctttggttgatgcataatgaaccattggctagaatttccaaccttaaagaaaatatgctaccttgattctgct

SEQ ID NO: 55951 - DNA, 366 bp, Triticum aestivum
  Clone ID: PAT_TA_55951
ttttacctgaagagaaggctttccgacaagtagaactttcctgtgggggcgcgccccataacacgacacgctcgttcacgtggggtcggaacacagtttgatggggcatgcccggtctaggaaagagaacacggctgactcctgacctacgactaacaaacaggtaccatcgcggtgctaataacttatgcggacggaaggtgaacaatcaccctttgcacacctgcatgctgccactgcaggcccagagcaaacctaactgcctctattacaaagagagttaacctactaggcccaaatctactgcgctacgattaactgatggcgctaagaaggcttcagatgataccaacagtttcactgccc

SEQ ID NO: 55952 - DNA, 513 bp, Triticum aestivum
  Clone ID: PAT_TA_55952
aaagcccacgcaggacacaacaaaggttgactccggactacctacttattaaagccccacttgctccgcacagtatataagagcgggcctaaacccttgggccgatcctgccatgcggggggcgagggaccacggaaccatatttactgcgaaggaagcgcaggaagtactgcttcggggcaagaacataaactggcggggtctccaatgcccgaggtgaatacccaaaccttgttgaggctcacaactcgaggccatccgaagaaagtccaagcgcgccaaacaaccttcgtggaatgcaaacccacctttcgctaaggaacatattcccgcccggaagtgtcgtccatattttcagcgaccagggttgcctggaatcggatcgtatcccagtctgcctggggggggccccccttgaaaactccacgtggcatcgcccgggtggccaaccaactacgcgttgatacagtgttgggcggaattgaagagagagaccgaggtcgaccccccaat

SEQ ID NO: 55953 - DNA, 556 bp, Triticum aestivum
  Clone ID: PAT_TA_55953
ggcaaccatggcccttccatttctagggagaaacgtcaaaacgacgtaaatgccgcactaaaaaaaacatgttatgcaaattaagctggggcacatgagccaaacacacttaactccggcagaagaaaacacatactcgatcatgctgcagcaatctgtatatgctgagctaaacacatactcgatcatgcgcaaatcacaaccttattcactactagtgcagataaacttaataacctgataaattggcctccttgttcttgttcagtacatcgggaagaaaaaccccggcatggaagcccaggatgctcaccaaggccatggctatcattgcccatgccgggatgcaggagtgcagccagtcgagatagccgccggacggcttgcacgcagcagcccgctcttcgccgacatccagcttctgtcgcaggtggctcggcagcagcacggcgtcgatgacgtacacggcgaggggggcctcttcggacaccgtcttggtcaccctgaccccagcgccgctcgcgcacgacggccacagccgcaccgtgtccccgtc

SEQ ID NO: 55954 - DNA, 587 bp, Triticum aestivum
  Clone ID: PAT_TA_55954
ggctaggtccaagttttgaacaacaaaacaaaagtaaagatgtttgcatacatttacacgctccacagagccgcatggatacatgcaggccggaatgtgtgcttatttacgtacgtacgtaacattggggggggtgtaaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacgttgttgtcccatgc

SEQ ID NO: 55955 - DNA, 589 bp, Triticum aestivum
  Clone ID: PAT_TA_55955
ttttgcgttgcaaatgttatcaaattagcattcggggtaacaggatatacagcctagcaaccagtaccaggtctataacaatgggttcccagattggcactccaccgactgttcgtccctatgccgctgctgtgtactgtgcaattgtgtattcgaatgcacgcgatcgatgtggaccccgtgtgcttccgttgtcaagaaccaaaccgaacaactgttctggctcagggaaaaagaaaactgaatccccgtcatgtccaggtaactgaatcacggtggcacgggcgcacaccgtacatgagatttctattctattcatctcgtcctgatctactccggaaacacatagtcacataccactaaattactaatacactggagagcaaggcactaaattactaatacactggacagcaaggccgacgggggaggcctagcttgtgagcgtctccgccgccgcaagctcaaacaccgccctcagtgacttcttcacctcatcgtcggcgaacacgaactccacagcgccctgggctagccgaaacagctcggtcttgctaagaccaaaggtagacgcgaccaggtaatactc

SEQ ID NO: 55956 - DNA, 519 bp, Triticum aestivum
  Clone ID: PAT_TA_55956
acggcaaagaacttggcctcaattcgctgaaaaatttttaatcacaaggcatgcccttccagttggaagttgcttatgacgggccacaggggaacataacagggggctagacagcccattggtgccttccgacccaaaataaacccgccctcaaatagacatcaactccagggagcccatcagtagaagaaaaacggggaaaacctcctaaatcaaccggaaataagctctcctgcgcgagggggatccggatctaggggcccccgggcttttcgaggggctcgaggggggggcgctcctggggcaggcccaccaggtaggcaaaggccatgccccccaagcaaacggggaaaagcgggtcaaccgagctgggctcgatgtacttctcgatggagcggcccaccgcctgggcggggctctttttcacgttctcccaggggaggcgcggtttgagggaccccggcacattgcgcaccttaatcgggcggatctcgttgtacagcgcgcgcattgccatgg

SEQ ID NO: 55957 - DNA, 453 bp, Triticum aestivum
  unsure (1)..(453): unsure at all n locations
  Clone ID: PAT_TA_55957
ttttgatgaaccatggctgaggtaatattattgaagaaagttggcagacttgggacaatagtggatagcagagagtggctaaaatgagaagctcctattcttgacccaaaaaacacaccattaataaaggtacacaacaggctaaccattcgcaatgactgagaggactgagttcttgcagagtgacacnagcagtgtgcatgacgagcccatgacaatttaggaaatgcggcagtcaacaagaagggaggtgcaaggatggcaattggaacagcaaacacaggagatgaaccttcacacattgcaaccatagcttccctgcaagacacataaatgttgtcgagcttatctgccttcaacagaccgttggacttagcgatagcatacctaggatgcctacgagagtccaactggcagtaatgcttgagggaatacttatacactgaacaggac

SEQ ID NO: 55958 - DNA, 653 bp, Triticum aestivum
  Clone ID: PAT_TA_55958
cctcatcctccttacacctcgcagacacgtcgcagccccctcgtctctacctaaccctcctaatctcaacacctaatcagtcaacatggaagaggaagtcgcagccctcgtcatcgacaatggttcgggtatgtgcaaggccggtttcgccggtgacgatgcgccccgtgcagtcttcccctccattgtcggccgaccgcgccatcacggtatcatgattggtatgggccagaaggactcctatgttggtgacgaggcacagtcgaagcgtggtatcctgactttgcgataccccatcgagcacggtgtcgttaccaactgggacgacatggagaagatttggcaccacaccttctacaacgagctgcgtgtggcccccgaggagcaccccgtcctgctcaccgaggctcccatcaaccccaagtccaaccgtgagaagatgacccagatcgtcttcgagaccttcaacgcccctgcgttctacgtctccatccaggccgtcctgtccctgtacgcctccggtcgtaccaccggtatcgtgctcgactccggtgacggtgtcactcacgttgtccccatctacgagggtttcgctcttccccacgccatttctcgtgttgacatggctggtcgcgatctgactgactacctca

SEQ ID NO: 55959 - DNA, 392 bp, Triticum aestivum
  Clone ID: PAT_TA_55959
ggacgagtgcagacacatcaataggagccatagctagatgcatcaatactgtcttggcattcgacctgaccctggcggtgtatccggaatgcagctactgcacggacataactatgccacttttcaaacattctgttgacaaaatgcatgctcacctgcatcatgacccattgttgatccatggcagcctttggaaagatcaaagcctgaaatgccaattgaaatgatcctggaaagctgcgcactcaaaactggaatcattcccctctacataagaataccgacctcgcatgtaaagatcacactgattatggtgatgaagtgctcattgcctactggtgaaaatctttctctatcttcataaaatgacgggcattactgatgcagtctac

SEQ ID NO: 55960 - DNA, 456 bp, Triticum aestivum
  Clone ID: PAT_TA_55960
cacacgcaaggtacgtaggaggcaagggaacctgccgccgtcgccgccgccgtcgcttcccggcctgtccctagctcggctggcaggggccacgaggtcgaacacgtcaacctgctcctgttgcgacctgctgggtggtctgggctaatgctatgacagccaatccgcgctacaaagcgactgagcagcctggtgaagcttgcttggccgaggagggcttcagctgtcgaacctgaggtgcttcactacgaagacgctggttgcatggtggggggccacgtccaaagggaagatggggacctcagcaggggaggagcaccagttctaggctacggactacacctacatcttgaactcggcggagacggccgcgggggagctgccctcactggtgcacgtcggcggcatgctcgacctgaccgggcaatatctatgctgctacatgagaccagtggg

SEQ ID NO: 55961 - DNA, 588 bp, Triticum aestivum
  Clone ID: PAT_TA_55961
actggccaagcgtacctactcaagcaccacaggcaaatgcctgacgtgctattcacatggggtctatttgagccacgtcatgcttgttgctgctgttctacgttggagacgcactgacgaacaccctgcagccaatgagaggaagacctgaagccggtgtgcactcacgtttgattaggtggcggccaacaacgacacctacgcggaggcggaggctatgcaccaggaggaggaggttaacacgagctacgcggatatgtagcagcgtggaggttacctacacgccggctaccatttgccgagaggataccgacgggcggagctccaaccatgagcagaagtggtgagaatcacaggtccaggcggataccctggccacggagctgaacgagaaggacgcttcgggcatgttggacgctaccctctacaagcactggaaggacaagtacggtaccgtgggcaccttgattaccctgtactacaagagcaaggaggggcacgtgaccgagaaggaggttcaccaggccgaggacgacgttctggaggccgtctacgccgacaaggcctaaaaggcttgtctcgctactg

SEQ ID NO: 55962 - DNA, 622 bp, Triticum aestivum
  Clone ID: PAT_TA_55962
aacccgccaagcacgcacgcgcacgcgcacgctcatgagaagcttgccgctgatcgactagctagagcaggtgccgggcatggaggacacgacggcgacgctggcgacggagctggacgggctgctggccatggcgagggagctggaggagagggtggacggcgaccagggcgcgccgggcgccgccagggagctctgcgccgagctggccgcgtccgtcgaccgtgccgtgcgcctcgctgggagcggcccgcgcggaggcaatgccggcggcagggcgagagtgaacggccagcacaggggcggcaggaaggcgggggcggtcagggcgcaggtgcgggtggcgtcgatgcaggacctggggtcgctcgacgacgggctcagctggcggaagtacggccagaaggacatcctcggcgcaccgtacccgcgggcctacttccggtgcacgcaccggcactcgcagggctgccaggccaccaagcaggtgcagcgcgccgccgccgacccgctgctcttcgacgtcgtctaccacggcgcgcacacctgcgcccaggccaccgctgtcctcgtcggcacagatcagcagccgcctgcttccttgggccaggaacagcagcag

SEQ ID NO: 55963 - DNA, 413 bp, Triticum aestivum
  Clone ID: PAT_TA_55963
gccttcaccatggcggaaggcttccatgaaagccttgaatgattctacctgctctgtgggcagataggcaccttgccgtacaatatgacagtaaattgctgtggacttgaggatgcttggtgcaaagaaagtgggttctgaaatgcttgaatctactatggcggacaagctcccaaacgattggtgaggaatggagtcctgaatgcaaaaggcatatgctctatattgaccagcatctataaatatgtggatgatgggggggaagctcgggtggcaccgtgcaacaagataagcaggtttattgctgacaccagatcctccatgccaaagatgactacagcatctttagacacgctcttgactgacaagatttaagacaatactgcgctggtatacctgtgaagcatcacact

SEQ ID NO: 55964 - DNA, 386 bp, Triticum aestivum
  unsure (1)..(386): unsure at all n locations
  Clone ID: PAT_TA_55964
gtcgaccagcgtccgggtgtttgtttcggtcagacttttggctcttaggtcgtgaggtgtcgagtcaggtgagggcgcctttcgcagtgtttgccgtgcaattctaccacgggggcaccgggcgcgtgtggaacgtttccaagtgggccatcggcgttgggattaatgagccggttgggaagtggtgatgtgttagggaggaagggatggtatgtttcaggcatggagtattgtgtcagtntcatccagggtggtgtgtgtaggtagttctcgcgctgtaggaaagtgaagaacgatcagcttaaggcggtaatcaaggcgcgcggtgaggtcatgagcaccaagagagccgtcgccctaagactggttatggttaggtaccacaa

SEQ ID NO: 55965 - DNA, 637 bp, Triticum aestivum
  Clone ID: PAT_TA_55965
gatgctagctaaccttggtattttccagtatattcttgcactgtttgcactggccataggcatgggcggggtggatgacagttttggcgcaaaacacagcgcatgacttcgttatctgcgacaaccgcgcccgcgccgagtgctgtacaggtcgcgatggaatgggacaacacttagtgacaggtcttgcgcaagacgtgggcggcgcgatgcgccggcaattgccagctggatgactacgtttggccgctcggtgagaacatgcttactggggcttactaccagaagttgactgacgcactctccgctaagctcagtgtggaccagaagaatgaactaccatgttgacagtatcacctgagtacgccggcaaggtgtgcgagtcactactacacaggtggtgtggcaacaagtcgacctgcatcttgtgtgctcgcatggactatacggagaacatgcgacgtctttatcatctggcactacaatctcaagtgcaactacaacagagagcgccctgtcgcatacatcacccttgacgattaatcctattacgtgcaagtgagcttgatcatacatgcatacatacgtgcaactgtcaatgtttagcctagctagaatatttatacgtgtaccaatg

SEQ ID NO: 55966 - DNA, 478 bp, Triticum aestivum
  Clone ID: PAT_TA_55966
ggcacagaacatcaatacatgggaaataggagctaagactaagctgtagcactctccctgtgtactagtatgtgtaatttcagcgctggccttaagcttgcttattagccgctaaagactgcgtcagcagtatgcggcacgaagaacatagaagcagactagggcgggctcgctcctgggccctggcgtgtacacctcgagttgggtaacctcctaccagatcgacgacgacaggctgctggtggtccgttcaaactctgaccgtgaagcacagcgtccggatatgtgcctacggctgcgcaagccaacacgatcatcatctcgaacctgaccaaggcgcaggaagtgtttctaggagaacgacctcaacttagggtcaagggcgagcctgctgctgatctacgtgatgctccactgtaacctcgacattgtgatcgcgcctgactgcacgtactggcggactctgtatcacagctgt

SEQ ID NO: 55967 - DNA, 382 bp, Triticum aestivum
  unsure (1)..(382): unsure at all n locations
  Clone ID: PAT_TA_55967
cgtcaactccttgacttcacgggnaatatcacaggatctagggtgacgttttgacaattgttcaagtgactggcggttgcgtggcttcttttccgctgctatggagagcccgcttggaatatcgttttccctccttaaaacattggctggttagaaaacgtcgggtaggcttgtaagaggtggttggttcattgtattaggcctgtaatgtttcctgtatcctcgtttaggctcgtaatcagcctatttatggtacacagctaggatatcagttgtggctgctgttacacacctgtgaactaaatgcagttgtataaagttacaccagttccaaaaaaaaaaaaaaaaaaaaaaaaaaaaaaaaaaaaaaaaaaaaanaaaa

SEQ ID NO: 55968 - DNA, 267 bp, Triticum aestivum
  unsure (1)..(267): unsure at all n locations
  Clone ID: PAT_TA_55968
ggggggggttttttttttttttttgtgggggtttttttttttttttttgggtaaaccaccggagattttatttaggggggggtttacatgcctgggagtgcacctgctcttctcatgctggcgggggcttacatacattcaggggtcccgccaccgggggnnccttacccatgggcnntatatggacccctccatcatagattttatgccccccccccggaggtgcctcccttggccatgatccttgatccctgatctacccgctcc

SEQ ID NO: 55969 - DNA, 447 bp, Triticum aestivum
  unsure (1)..(447): unsure at all n locations
  Clone ID: PAT_TA_55969
ctgcatctacacaggccccaaaatactttttttaaaatggaaacatattcctcatgcatttatttatgagctacaaatctttttcactcaccacaggtaaaacaaggtgggttagttgcggggaaatttatatctatcccatccaaccntccattccaataatccttttttttaacatacttctctcaaaatggaaacatatttttgtggcccatttcaatgatcctttggcttgtccttgggaacctctgtttccagcttcctgggaggcggaactgctttttttgcaaactttgatgcggcggaggcggtgtcctcctccagccattttccgatttggcgggcgttgccgcggaaaaaccgcccgactttcggaccttcgtagtgaagaaaaacagngccccccccaccactcgccttgtcaccattaagttggggagcgccatt

SEQ ID NO: 55970 - DNA, 319 bp, Triticum aestivum
  unsure (1)..(319): unsure at all n locations
  Clone ID: PAT_TA_55970
ttactaaaataatattccagggagggcatcatcacttaccacagcacaatctaccacttacatctaccgttattcatatgcctaaagaacatccaccactactaccaatcaccaataacttaacacaaactaactgtgggggggggggaggacctaattaaacnacaaacacaacaaacaaatctanttctccaaacctacttacactcaacctataacacccacacaaccatccatgcgccctacgagtttcactacccaaccatcaaccatcccccccgtgagtgcttgccacacaccatcggctctatctatcaac

SEQ ID NO: 55971 - DNA, 623 bp, Triticum aestivum
  Clone ID: PAT_TA_55971
gccgcgtcttaagctggtcctctagacggcgccttttttttttttttatgtgaaagagcttaaaggacctgcaaaatcctcttctgaatccattagttttcagtcatattttttggcaacacagatttaacaagtgtcacatgtcctccgttttgttcctgtcccctgaatggggcgatgtgcttgtccaccccatcaaagaagaaatcacaggggggattcctccaatatccagagggcaaaccttgagaaaatcatggatgcacatgtaagagatcctctcctgtcaatcttgtctacctccctgtgaacagttccctctcctacttcacagagtcagcaagatgaagatgcactccttcatgtaagatgaagccaaaatgaccaacttaattctcttgctatttgaccccagtaaactaaataaatacagaaatcaacatatctggagagattactgtgatattttgacacattacaacttggttgtaaattactctgaccttgcttgtaactacacgttaattacactaaacccactgacaatatcagtgcaacttgatttacactgtaaatccaattggaattacagctaaaaagtggaattatagcggaaacccact

SEQ ID NO: 55972 - DNA, 593 bp, Triticum aestivum
  Clone ID: PAT_TA_55972
ttttagggatgatgaaggtccaaatttctaggctacaatcttatgatcctactacagctccctcataacccgagcttctccataactaatcacccaaccgctagctcgcttttgtgaacaaccgttatttgtgaaaccctgggctaacagagcgccaatacattgacacctccactatcaggcttgccatgatttcgataatcgcacacaggaacacgcttagaagcacttgcggtggacaatggaaggaccgctctcgtcgtattcctgctttgagatccacatctgctggaaggtggagagcgaagcgagaatggatccaccgatccagacggagtacttgcgctccgggggtgcgatgatcttgaccttcatggacgacggggcgagggcagtgatctccttctgcatgcggtcggagataccggggtacatggtggttccaccggacatgacaatgttgccgtacaggtctttcctgacgtcaacatcgcacttcatgatggagttgaaagtggtgacgtggatgccaccgctctcaagaccaaggacggagggctggaaaagcgcctcgggggcacggaagcgctcgt

SEQ ID NO: 55973 - DNA, 455 bp, Triticum aestivum
  Clone ID: PAT_TA_55973
ctagggtaggtttaattaaaaaaggaacctgcggggggaggcccaaaaggggtgggccatcaatactcaaaaagggggggggggccaaggttccatttggggggcgggggggaaaatatgattgccttgaggagcaaaaaggaccccttgattacgagcttgtccaagggctttaaaagccccttcattaagtggggcccccgggggttttcccaaagggggggctaagggtcccccaccaaatggaaaaaaaaaatcggccaaaaaaaattggggaagggcgggattattccaaaaagaaaacccccggagagcttccgggaaaaccccggggagggatccccaggccgaggaaaaaaaaaaccgggggcccgatttttttaaaaaaaaggatggcgcaaaaaaacaaaaaaactaagggtttttgggggtcccctttaaactaacctcccccg

SEQ ID NO: 55974 - DNA, 408 bp, Triticum aestivum
  Clone ID: PAT_TA_55974
tttttgttgataacacatactaatttgctccaatacattacacaacagaaacagggagggatcacccaaagatcgctaacaaccaagggcacaggctgacgagcaggggataaacaaccctaaagggggggggggcgagagatcaagggtctacctaacacaggcgggggagccagacgtgatacccctaagacagggtgccctccttgtgggcgtgggtgacacagtacccttggggtaggctacgcacggttatacatacgcctctctcatgactggcttcttgcaggaactaacctgccgagtggaccacatgtccttgctggatattgccctcacaggtgaagaaagccaccccaccgtactagtaaggaagatgaacacctggaccatgctgccagttcacaa

SEQ ID NO: 55975 - DNA, 591 bp, Triticum aestivum
  Clone ID: PAT_TA_55975
ggcgtcacgcacagcttcgagttccatgaggccaccgtggacgccatccagctcggcttccgcaacggcagcctcacctcggccgccctcgtccggttctacctggaccagatccgccgcatgaacccgctgctgcacgccgtcatcgaggggaacccggacgcgctccggcaggcagcacgcgctgacgccgaacgccgtcgcggcatggccacgggcgcgctgcatggggtccccgtcctgctcaaggacaacatcgccacctgtgacgctctcaacaccacggctgggtcgctggcgctcctcggctctgtggtgaagcgcgacgccggcgtggcggccaggctgcggcgcgctggcgccgtggtgctcggcaaggccagcctctccgagtgggccaacttccgaaacgtccacaacgggtggagcgcgcgcggtggccagacgcgcaacccgtatgtgttgtcgtccgacccgtgtgggtcgagctccgggtcgggcgtggccgcggcggcaaacatggcggccgtgacactgggtaccgagaccgacggctccatactctgcccgtcgtcgttcaactccgtggtc

SEQ ID NO: 55976 - DNA, 482 bp, Triticum aestivum
  Clone ID: PAT_TA_55976
aaaaaggcaacggggaccctttcccgggggtttggcatcagttccataccccacccccggggggccggggatgacccccggggaaaaacaatcccttgtccccggggctcatacttaaaccctgcagcgcttgggacccggcccccggctcgaggcattttctctcccccctcttaccccaaaaaacaggggccccttgggtccctaaacctataaccatttttcgggtaacctagccccctccggccctccctcccaacaaggggtagcccaggaatattgccccgttggccatcgactacccctttcggcccgatcttaggccccgaccccccccccggggaccaaccttgcgggggaaaccctgggttttcggggccttggattcccaccaatgttttcgttacccaagcccacattttcccttcccctttggccaccccccctttcccggtggctcccctctaagggggaaccccccc

SEQ ID NO: 55977 - DNA, 464 bp, Triticum aestivum
  unsure (1)..(464): unsure at all n locations
  Clone ID: PAT_TA_55977
gggggggggttttttaaaaaatttttttgtgggtttttttttttttttttttttttttttttttttttttccacctccaggaaggcaatagattcattataccccatatcccccccaacattataaaacacttaatcaacccccccagggggggggcgggaaacaacaaaaccccccacattaaatcccctaatccccccaaaacccctngcaaaccccccccaaatcatctccccatgacccccttccaaatcaaccccaaaactgacatcccaaacaagccccatctgcccaggtggatctgaggaaaaaccaccccttcccccctggagaaaagtttttccaacacccccccccctggcaaaatctccccggatctttgtccccccaatccataacaccctacccttggtatcaggcaaaaacctttgactggaaacatcacctccataactccgataatg

SEQ ID NO: 55978 - DNA, 502 bp, Triticum aestivum
  Clone ID: PAT_TA_55978
tttttaatacaaaccgtaagcattagaatgaaaccaacatgaggcaaaacatgcctcatcgcattgtgtactgcccacacaagagtatgcgagctccaggccaaaggtccaacacagcctcccgacctggtgctattagtggggcccagtactcaaacaaatggcgcataggggatttccgcactctatcaaatagaataacttagtggaccttctccatcttcgggggagcaccactgttgggagcccccgcgcgcttgggcatgcctgggggtatgtgaccgccgcctccctgggacctatttgccactatggggaggcagatgacctccaggtcctttatttggtactgaagctccctgacctaaccaagctggctggcgcaaagccactgaatctgcgagccgacagcatacacaatatagtccgtggcgcctagagggggagctaacgcacttttattgcgctgggaggagtgcctcatgtccaaggcgtaaatctg

SEQ ID NO: 55979 - DNA, 503 bp, Triticum aestivum
  Clone ID: PAT_TA_55979
aagcgcttaaatccaatgaatgtagatgggatgcacgattacacattacaggaggcatttaatacatgatatgcattcatacacttgccagaacacaggggccacacatgtgtcatatacaaggtaaccgcgcagggtgagagagcggaatgacgtgcgcacacaatcactagctacggcctcctttggtgaccgcgggctataggatggcagtctaggacttctgtacttacttctatgcattgaggccttcatagctattgtatgcacactctaattaaagtgacgacggcactggacttgactggctaccgctcgtacggacacatgcataacatgctccagaattccttgtgggttaagttcgggacctcctactgcggctggtacatggggttctgaatcaccactggtgcagcacagtagaccgagtcatggcgatggaagtactcctgcccgaagaagccccaggacattagtacaccgccgaatccttgaacatc

SEQ ID NO: 55980 - DNA, 388 bp, Triticum aestivum
  unsure (1)..(388): unsure at all n locations
  Clone ID: PAT_TA_55980
gctgggggggggggggttttttttatttttttattttgggggggggtttttttgataattcatagcgggagttcattctcacttcacaacacgtaagtatatgccagcaggacaccaaggagagagtaaccactggcgccgccgggacacaatatccaaccggccacaaaaagtgcgggcgggggggggggggaaaccaaccaccgaaatctcatccnaccggcaagggggaaaacaccacaccacacaccactcttttatttaaatcgacgacccgggacacggggcgaccaccacaggcgaccggggggcggaccgatctaaagctggccccactctgggatgacgacttgcttggaacangtgcccctccgggagcccaccttct

SEQ ID NO: 55981 - DNA, 482 bp, Triticum aestivum
  unsure (1)..(482): unsure at all n locations
  Clone ID: PAT_TA_55981
ggggggggggggggtggaaaaacaaaacaaggggggtcaactgttnaatgtacatatcaatagtaccatggggagccacatgggttgggcaaactacaagaatgtgtgcatatatgcccatggcattgnttttaaacatccaagggggggggggggagtttttaatnnaccatncatccaccatntncaatcaaacaatatcctccanaaacctanattacaccaaccnncttnattattantatcctctntaaatcctccatannacctcntntttatancaaccttntttaaacattcancccccnatcgggctttancctnaaccaccttttcctttcancacctcntncaccacanaaaaatccanntcnccaantcccaancttcttnctttcttnaatncctcattnnaancanctaccactnncatnnacactncattttcatctcccaacnacananccaacctcatatccttc

SEQ ID NO: 55982 - DNA, 461 bp, Triticum aestivum
  Clone ID: PAT_TA_55982
cccgggaaatggcgaacctggggggaaactatcactgtcccaaagggggggggggtcgcacccgataactccatgcaggccgggccaaagtctgttccccagtcctgaaccgaaaataagtttcccagtttgtttttgctggggaagtttcgcgggttaaaaaagcaggggccccccagggcctgaccaaaaaaaaagggtcccccagctttgattgggggggggaagaagttaaacttttttgaggggggcccccctccagttttttccccagctgcggggaaaaaaggtaattaacgtgggggaaatcccaaaaatccccccattgggggacagtttgggggccattttccttggaaccccattttggggggatttaaaacccctaaaactcggcggcccccccgggggggcccatttgggggggctcccccttcgggtcccccggggctgcccccccc

SEQ ID NO: 55983 - DNA, 577 bp, Triticum aestivum
  Clone ID: PAT_TA_55983
gtctgaaggggtaactttacatttatttataccccatggtaattaatacagtataacacttgatacaaggcacactgcaaggttttcactcaaacgatatacacatacgtatagctagtactcctaccagctaacaaagggctccctgcttttattgcaaccacacactaaaacagtactagtatagtagtactagcacagagacatgatgaagcgatcatgcagcaaagcccgcatagatgccaaaggagtcaatgtaagtcgtccccgcagctccaaagaagccgatgatccgggcggaaactagcgggacgttgaaagaacccccaaagccggcagtgccgccacggatagtccgacccttgttggtaaccaattcaagagatgttacatatgattcagggggtgatccatacgttcctgaaatttccaacacatattctaattcctgaaggagcaactgctcaaatttctccgcctcgcagcctccccattcctcctcatgcagattcccactggtatccacgtaagtaaacctgacaccgttgattgcgtccccgctacgaactgccacacc

SEQ ID NO: 55984 - DNA, 532 bp, Triticum aestivum
  unsure (1)..(532): unsure at all n locations
  Clone ID: PAT_TA_55984
cttggacctctanacggccgcgggggggggggggggtgtttacaacacgacaaagggggcattcatattattactaacagaacttggggccaaacaaattacgtggtgcaaaattagtgatagcgagcgtgcgcacaggggacaccttgatagcaactattactactactgggggggggggggggtccatccctnacaantancntaatacatacataantantggttcttggctcnacaacaatgaggcggcaaactacgtgagggggacaactaaggagacatcaactaccctccttcgtcttttcaggcaattgagcttttactctgctgggcgggggggtgggtgttaagtggcgncagcgtcggccaggtcaatgtgctcttgaacaaacttctccaagggtttcctgggggccttgaaggcgatgatgtgtggctccctgatcggcgtagtgccagccccgaagacaggcttctcaaagaggtggatgaaaaagtcgagcttggcatgcacgatgaggcgctgtgc

SEQ ID NO: 55985 - DNA, 522 bp, Triticum aestivum
  unsure (1)..(522): unsure at all n locations
  Clone ID: PAT_TA_55985
gggggggggggggggaaacaaaaagagtggggtgctttctttcaacttgtgtaaatatgcaggcttacagtgacctaaaacgtcttatatttgtgtacagaggaggtgctttctttcaacttttanaaatatncannctcacagtgggggggggggggggggagcaaatcanngccaaaaggagtataccatatcatacaaaaaaaggaatggggaaaagggactaaaatgcaaaatctagtataattacccttccctttgcatgtgatttcaggggggtgctgtggacataatctcgagctcagcccaccacagcggggtgttcctcggggtcgtctgctcctgcgacaggctgacggcgcctttcatcagccccgcgacctcgcccatgcacggcctcttcgccgcgctcgcgggttatgcacaggctcactacatcacacagcgccgccaggtcctcttcgggcacaggcgacgacgccctgagcaccgggtcggccatcgatccgatcgggcgcttgc

SEQ ID NO: 55986 - DNA, 494 bp, Triticum aestivum
  Clone ID: PAT_TA_55986
aagccaaaccacgggcagattttatttaggggtttacatgcatggaatgggacccgctctgttcatgcgggcaggggcgtacatactacatacatacaaaggccctggatcagggggcattacatggtactagatggatacctcaatcatagatatgatgcacccggcgcatgcatgatcaatgatctagcagcttccacaggagccgccggaactggtgcctcacttgcactgggtgcaaccgcagcccccgttctcgggccccatttacattccgccggaactccccttgtgagtggcaacggcagaaactaagaggggggcgcctggggcctcaacctatgggtacatgttgcagcccccgcagcccttgccctactttcaggcggtgccgcatcctcagtttcctccaaagcaaaacatattcaaggttacttgggataggaaggaggcctttaatggtgttggctaagagcttcctgtacgcttcttgc

SEQ ID NO: 55987 - DNA, 495 bp, Triticum aestivum
  Clone ID: PAT_TA_55987
ttttggaacaacaaaataaaataaagatttggcgtattttacacacgtccacagaccctatggatccatggaggccggaatgagtgcttatttacttgcgtgcgtaacattggaagacgtatcaatatgcaaaccacacatacataatcacacgcacgtacgtctgcatggctgaacacacttgctcgcacgtgctaagattttcgtgtaaagggagaggaacgccaacgggcccttgccgaggaacttggccggtggatcgtagttcctggcgacaaagaacgaccggttcccaatgcagactaccctcgcccaagcgataaggttgcacaggccccacaccacctgaagagagtgaccactcaccttagcggccaggtaagcattgctctcaagacagaaggccttattgagcttcacccacagatgctgcgcataagccgcagtccacaaatgaagcgtgaccccatgcttgttataggactacggaccctc

SEQ ID NO: 55988 - DNA, 551 bp, Triticum aestivum
  Clone ID: PAT_TA_55988
ctccttaataggcgcgcaaagtttctatttaacccacagtttaataccttaaagggtggatgcacatcccaccacccaaggaccatggacattacatgcactactggtggcacacctgattccttttcatcggaacggcctaatgtgccagagtgacccatcagctaaaatagcactcttggcccttatgggatcgcccaccctattaattagtccatcaacccgggccagacatgaaatgcccatgacccagatgcccacaactggctcaatcgtgcaccacaaacatgtgacttatctttgcaacgaaacctgcttatgcggtaatgccactacttgcaactggctgtttttgcttatccttatgcccatccgcatgtgcatctcaagttcagggccaccggatgcgaggctcctatcaaagaggacgagaaggcctgccatgattagcttcagcaccgccaacccaagagtacttccggggcacattctgagcccacctcctaatgtaatgtagtctaacctgggtgctttgtgatcaggcatgctga

SEQ ID NO: 55989 - DNA, 331 bp, Triticum aestivum
  unsure (1)..(331): unsure at all n locations
  Clone ID: PAT_TA_55989
ggggggggggggggntacaaataatccactgagcggcccctctctcataaagcgtacaccagtgctccagagccctatggggttatggggcataaggggggggtatgaggggttaagggggtcacaccacataacttttnttccnggcgtgggggggggggggttnntnnggattatatccgcatnacaccctgaacagagcatcaaatgacaagggaaaaagggggagtgaggactctgagactctctancacttgagggcccaccaaaccattagcgcgaggggtgggagcaaaaacgggatgccaccaccgagcatcagcttaaacct

SEQ ID NO: 55990 - DNA, 511 bp, Triticum aestivum
  unsure (1)..(511): unsure at all n locations
  Clone ID: PAT_TA_55990
ggggggggggggggggataaaaaaacatggggggggtgaccatcatnctcctccagcttttattgctaanttcaatttacctaatgcgtgcgcaaaatcaattgaccggggatctcttccacacacacacctaaaacanatattgtgggtgctgccggggggttnctcaanctnnaacttcntccnaacaangggatatctacaaaacctaaaccctgtcccccaccttaaccatcctccctttgccctttgctgacaccgactccttgcggaccaggttttgcccaaagtataccttctgtgtattcttggggggggggcgggtcacttcacctgacctgaatgtgancatgggttctgtggggtccctgccaggtattccggtctcttnattaatggggggcaccttgcaacgggcgcataacttcaccccgtcaaatgtgagcttgtgtatcttcatggttttccacagatcctctgcgtgcgggggggatccctgcactaaaatatt

SEQ ID NO: 55991 - DNA, 408 bp, Triticum aestivum
  unsure (1)..(408): unsure at all n locations
  Clone ID: PAT_TA_55991
gggggggggggggggggaaaaaaaaaaaaaagagcgggttttctactacattaattgtgacatccaactgaagacgggcgggcttgaatcccctgcgagagtttcaacagctagagatacagattatcacatacacaacccaacattttggggggggggggggggnanactancacaccccccttcttnccttatattacaccaccaccacaccaactggcgttcctnctttccccaacgaccgggagccgggaatctcctactgaagtgccccgacaacggtgaacccttccaccatgaagggggcaccacaggtgggctgctcatctgcgggcacagctgtcaccttgttcttcggattctcntaccacttgaggcctccaagagcgttccattataagcaacctt

SEQ ID NO: 55992 - DNA, 589 bp, Triticum aestivum
  Clone ID: PAT_TA_55992
accatataagtcttatttataacaaccacttaaccttttggtgcttcacacaggactagtcacccaaacaacacttttggtgcttcacacaggactagtcacccaaacaacacggttcgctgtcaggggactgggtgaaacgaagatgaaacacaccacctatttacacaccatcacttattcatctctgacagtcacatgtctcactattcatcactcaaccagaacaggcaccaacttattcatcggtgacggtcatatgtctcactattcatcactcaaccagaacaggcaccatactatagaaccctaaggttggtaaggaaggccgcgcaaaaatccaggaagaggagctgaggtccagtaactctctgcatatctagcaggtacttgtcatccttggtcttgtaaagctggatttcaaacttgatcacggcaggtagcctcccattagcatcgccgttatccatgatggtagagtcatcaacaaagctgtggttggcatctaacatatcactgacctgaggaaacccagggcaccacctgcatttcatgttgtagtgtccattcttcttccagcagacattta

SEQ ID NO: 55993 - DNA, 515 bp, Triticum aestivum
  Clone ID: PAT_TA_55993
gggggggggggttttttttttttttttttttttttttttttttttttttttttttttttttttttttttacttttttaaatttttaaaaatggaataaaaaaaaaagggaaaaaaaaaaaccacaaaaaaaaaccaaaccaaaaacgggggggggggggggaaaaaaccaaaacaaagaaaccgaaaaaaaaacaggcccaaaacaaagaaccaccccccccccacaaccccacccaacaagggcaaaccaggcaaagagacaaggggggaaaaccaaaccccaagggggcaaaccaaacccggggaaaaaaagccacccgggcgccagacacaaaaccaactggaaaaacccgaccccaaaacccgggaaaagccccccaagccaagggggggacccccaccccaggggccaccccaaaatcccccccccccacccggaggcggaccaaaaaaccccaaagggaggcgcaaaaaaggcccccctaaaaaagggcaaaaccttttcccctgggaa

SEQ ID NO: 55994 - DNA, 566 bp, Triticum aestivum
  Clone ID: PAT_TA_55994
gacaaacccgcagaacaatagatccgtcaaaaccacaccgcccaacggcggcggaggggtagggatggaccctggcttggtcggcgccggaagtaactggctgccgagggccggacccgaccggcaaaagcgtggcgagcgctactactacgactcgggagcgggcaactactactacggacagggccacccgatgaagccgtgaccggttcgcgtgacccactacatgctggcgccacacggactcctcgaccaaatgcaagggctgtgccccaaccccatccgcgaccgctacctctggcgatgacactccgactactacataatacttactacattccgatacgcccgagacgcgaaaggaccagatccggtccatcaagcgcttgaacgaatgagaggactgtccctgatttgaccagctctacagcttatagcacacctacacattggcctccgtctgcggggccgaaaagataaaacacgggcttgacatctacatgaactgagccgagggcctgcaccacgctaagaagtgcgaggcctatagggttatgctacgtcaa

SEQ ID NO: 55995 - DNA, 654 bp, Triticum aestivum
  Clone ID: PAT_TA_55995
cgcgctacggtcgttcgggcttgctcccgttctgctgtccagctccgcctgcgtcgtctcgccgccttccattcgagcgtcctctttttagttcgcattcgcaccccacaaaggtgtgattatttttggctggattggagcgtggaataagatggacgaattcgagctggaggataacctagagttcatcctccagagcatccaggagctcatagaggatcagggggagaacaatcccttcggcgaggtcaaccagaatgagctcctcgccaacctcgtcaactatgaccaggacaacttgatgccggacgtgtccgtggaggacgtagtgaacgggaaggacgtgcaggggattccgtgggaaaagatgctgttcccgagggatcagtaccgggagatgaagatgaagggctacaagaactatcagaacctcagttatgcccgggaggatgctttgcaggattgcaaacaagttgagagggacggcccttactacgattttcagtacaacacgaggcgtgcgcgactgtcaattgtgcattttcagttgaggaatctggtctgggcaacaaccaagcatgatgtttatacagtgcacaatcaatcaatgacacactggtcatcactaaaccagataagcactgagctaatcaa

SEQ ID NO: 55996 - DNA, 444 bp, Triticum aestivum
  Clone ID: PAT_TA_55996
ggcatgactaacctacaagggagacctgcttctaggctgcaagccaatgcacaccaaagaggccctagctactgaaatccggtatggccttttgggagatcatgaaaattgcataatacaatgcctaggtcgttccaatatttctgccacgaccttcttctaggcgagccttgaaacctcatgccagtgtctagttgtgccacgaataacctgactaccaaagttattacttgcagaaaaatgcttacggagaaactaaagcatcacaagaggggctaataacatagatacccatgctaacaatataaagaatatggcttggcgcgttcatcaagaacgccaaggctaggcctattaaccatgataccttccaactgtacgtgcacatggttcttgtgggaatccaattatgcatacttgcttatcaatcgttataaagccaaa

SEQ ID NO: 55997 - DNA, 639 bp, Triticum aestivum
  unsure (1)..(639): unsure at all n locations
  Clone ID: PAT_TA_55997
ccctccgctccgcccctcgnaaacccctccccgccgcgttccatggccgcgcgccccgcctcctccgcccacacactctggtgaccggcgccgcaaggaccgcgacacccgccgccggcctctctggtcttaaaagcaatcagagatgggcgtagtcagcacggtgcttggtctctttggatttggatttggattctcttctggtattgctattgggtactacttcttcatctacttccagccaacgaatgtcaaggatgtcgaagttcgcccacttgtggaatatgactcaaattctttggatggaatccttcctgaaattcctatgtgggtcaagaatcccgactatgatagaattgattggctcaacaggtttctggaattgatgtggcccaatcttaataaggctatctgcagaatggcgcaggatattgcaaagccaatcattgctgagaactgtgagaagtacaagatagattcggttgagttcgaaacacttactctgggtaccttaccacccacctttcaaggaatgaaagtctatgtcaccgatgagaaagagttgataatggaaccatctctaaagtgggctgcaaatcccaatattactgttgttgcaaaggcgtacgggttgaaagc

SEQ ID NO: 55998 - DNA, 525 bp, Triticum aestivum
  unsure (1)..(525): unsure at all n locations
  Clone ID: PAT_TA_55998
ggcggcggggccggagctgccggcgtacgtgttcgacgcgctggagcagcacgaggtggtgggcggcaacacgtaacgggagcatgccggcagggggacgtgcgcgctattgcttcggcgctgaagcggcggaccacctgcaacctgctggtgtttgggctgaggggcgagacaccattgtggcgagcgctcaaccacggaaggcgcaccgtgttgctggacgagaaccaggggtacgtgtcccaccttaaggggcggcactctgcgctgaaggcctacgatatgtcctacaccagcaccgtgcggaagatcgctgacatactggaggccgtccgcgccgaccgcgccanctgagtgccgaaccgtgcagaacctgctattctactgactgccgggcttgcatgaacgagctccgcaaccagctctacgacgtggtctgggacgacatcctcaagtacggccagcgcgggtacaccagagtccgctcgcagactatatcgaggatattcacggntaccttgctga

SEQ ID NO: 55999 - DNA, 622 bp, Triticum aestivum
  Clone ID: PAT_TA_55999
gcaactccacctggaccggagccaactatactagctgcatgaagggagggcgacggagtcacgaaccatgatcgaggagtgctggctgggctcgagcacacgaggggccttacacgctgctgaccatcaagctccggcgagggcgcgggcggtgggagcggctgacactcctgtgcgaagggcccaccaagcgctgcccagacctgacttaataatttcgtacacaccgctatatggcatataggctgtggtacggtcactgtagtagggactgagactataccactgagcgcgcggcttgctgttcccgcagagccaacggctgcagatgtacgctagcctgaggaacctccgacgactgaggacactgcatcggcggacgggtcaagaccgggtggagcaaggctgccggacgcaggcttctttcggaactcctacgacgacgcctgtgttatgtagggcggcgcgcattgctgtcctgcgggcaccatggacagcctcggcgcgctcggcaaccaacgtggaggcggcagcatggtgagaaccagtagctgagcatgctgttgtaccagctcatgcggtggctgcaaaggaagttcatgatctactactactgaaccga

SEQ ID NO: 56000 - DNA, 629 bp, Triticum aestivum
  unsure (1)..(629): unsure at all n locations
  Clone ID: PAT_TA_56000
ngacacccanaatctcacatcagnattacttgatgggcatcgcaaacttttggcgctggttacatctggcaacgccaatgcgcaaaatacaaatgttctgcagcccaacaatggtcctatcactggcccaccagaggtcgaggcaccattagacccgatgaaggagctgggaagactgctagctgaacacaaatttgacgaggcttttacagtagcacttcaaagaagtgacgtgtcaattgtgtcttggttatgctctcaggttgatttgcgtggattatgtacaatggccccagtccctctgaaccagggagtcctcctagccctactccagcagctagcagttgatattggcaccgagacatcccggaaaattcagtggatgacagatgttgccatggcgatcaatccgacagaccaagtcatcgccatacatgtgaggcccatcttcgagcaagtctacgccaaattggctcaccaccggtcgctccccaccaccagtccattggataacagcaatctccgcttgctcatgcatgtcatcaactcagttctgcttagctacaagtgattctagctggctgcagaaacagtggggtggtatgatggtctattctttctttgtatag

SEQ ID NO: 56001 - DNA, 644 bp, Triticum aestivum
  unsure (1)..(644): unsure at all n locations
  Clone ID: PAT_TA_56001
gcaccgcgccgcgcactcgcaccgagccgaccgccgcgcgccgcaggcggggagagggaggggatcgatggggagcagcgggggcagcagcgactacttcctgcgccagctgagctccagcgacggcggcagcgcgccggcgccggcgccgcgccagccggaggaatgggagtgcggcggcggcaccggcaggcgcgggtcgaggaggtggtcgaggaagaaggcgagggcgagaggccaccggcggggcgggggcggcgggttctgcggcgccccggaggaggccgcggcggcggggaggaagcgggtgatggtggtggtggaccagagctccggggccaagcacgccatgatgtgggcgctcacccacgtcgccaaccggggggacttcctcacgctgctccacatcctgcctcgcggcggcggcgcccgcggcgaggacgccgccgcgcttgccaactccctcggctccctctgcaaggcctgcaagcccgaggtggaggtggaggcgcttgtgatccaggggcccatgctggccaccgtcctcagccaggtgaagaagctgnaggcgtccgtgctcgtgctcagccaaagcaagccgtcccctttctgctgcttcctgcggagccgcggcgaggtgctgg

SEQ ID NO: 56002 - DNA, 632 bp, Triticum aestivum
  Clone ID: PAT_TA_56002
cacgacccgccccacccactcctctctgccccgtgctcctccacccaggcgccgccgcctccctccccgcgcccccgctgcagcgccaccgcctccctcccggcgcccccgctgcagcgccaccgcctccctcccggcgcccccgctgcagcgccgctgcctccctcgccgcgcccccactgcagcaccgacgccgccctcgcgcacccgcgtagccgtctccccagcgccctcgtgacccgcgcgcctccgcgccgctcgggccatggatccggccatgccgcggcggtcaggcgacggatccagccccgctgcaccgcccaggcgccggggtcgagcgccgccgttccccagcgctgtcccggcgactgcccccaaccccctccaactcccctcgtccttgccccccgagcagcaacatggatccggcgggcggcgcacacccttacctccaccagcccgagcgccccgctggcgtgcctccagcactggctctgcgcggcgcagcagtccactcctcccacgccgcccacaccctcccatctaccggatcaggtcgcggctcccctcgtggtcgtatcttcctcccctgcggcagctccaccccggccccagcggaaccactcctctgg

SEQ ID NO: 56003 - DNA, 634 bp, Triticum aestivum
  unsure (1)..(634): unsure at all n locations
  Clone ID: PAT_TA_56003
ngacaggttacattctgttgtttgcgttaggaaaagtggcatagccatgctcataatcatccatggagaagaggcagtcgctggtcttgtacttgtaccagcattatcaccctgtgcaactactcttccagtgtttcttgctgttggcaactcatcctcgatgatgattcttgcgatcattgtacttctcttcagtaccatcacggtgatgacgtccctggtggctctctcattttatggtgctagccagatcaagtttcactgggtggaacgctatgacaaggtcctagttggctcagtgctgtgccttgttggggttctgacgtatgtgttccatcaccatgatggtgacgagcattctctccatgcacacgtgcacaggaaacttgtgggtccttagaggaatctacatagttactcccaaagttcactgtgaaacaaattctgttgtcctctaacctttgtacgttatgctgtataagatctgattatcaatttatctgttgggaatctacccgcctatgggtttcctaggaatacagacagaccaggtgaacacctactgggaaattgtttgtaccatgggatctttgtttgcgctcatgcagtttaacgggaatagtgggctttcaac

SEQ ID NO: 56004 - DNA, 619 bp, Triticum aestivum
  unsure (1)..(619): unsure at all n locations
  Clone ID: PAT_TA_56004
ncacctcacttccgttcccggnagcctcctcccatgtttttgtcgcctccgctccggccgcccatcgccagcagcaccatccgccctctccctcccattgggccacctaccagcgcctccggcatggagctccgcctctgcctccacctccaactccacctccactcccacgcgcggcccccttccgccccgacgccgcctccatgccccgcggccgtactgcttcccgtccgccgcctgcggattggtgggagctgcggggttgctcggcggcggagtacgaggcgttcgcaatcagccatctgcgctgccgaaccggacggcgcgcagggctgggaggctgtcaaggagaggagcgtctcggtggtcctcttgtccggagggcaagggaagagaatgggggccaatatgcccaagcagtatctaccattactgggagtaccaattgcactgcacagtttaaggacattctgtggaatgaaggaagtgaaagaagtcgtagtggtgtgcgatccgtcctacaaaaatgtatttgaaggttttgttgaaaacttgcaaatacctatgaaatttacaaccccgggaaaagagagacagactctgtttttaatggacttca

SEQ ID NO: 56005 - DNA, 624 bp, Triticum aestivum
  Clone ID: PAT_TA_56005
atccatttctctcctcctcctcctgccaccgatcccgaaccagggaggaacccggcgcgaggagggcaaaggaagagaagaggagatcaccgagcccagcgcgcgcacaggacagcaggcgccgcgatctcggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacct

SEQ ID NO: 56006 - DNA, 639 bp, Triticum aestivum
  Clone ID: PAT_TA_56006
ctcgagcacggccccaagcccccaaccctagcccgccgccactcctccccatcgccgggaaagcccgcgcggctgcccgtcaaggtggcggcgatgccctccctggcgcatctcccgcttagggtttcggacacgcgggcggctcgccggcggcccccgtggcggcggcaaggtaggtgttcctgccgagtttcggtcgtcgatggctgggcggcgtacctcgcctgggacggtggaggatgtttggtgtgtggtgatgatgttggcatcctgctgatgtgcggccgtgtctgtgtgttgctgtttctactcttctgcttgctactgttatatgctcaagtagtctgctggatagtattatttcggtcttcctgtaatgaatttttagtgattgcggtggctgggcgctggagacacgaccctgagatcatgagctcagcctagccggtgtgtgggtggcgtgtgtttgtatctaagagacaaatgccgcctcttcgatcatgtcatgctcgcggatcaaacaacttaggactgccatatttgaaaatctctacatttacttgtgtttctctttgtgttgttcctcttagcacggatgttctatgtctttcaacacaaatgttagtctaatgtcattct

SEQ ID NO: 56007 - DNA, 556 bp, Triticum aestivum
  Clone ID: PAT_TA_56007
cttatacctccccactcaatcgctcggttcccggtccggctcccgttccgttcgtttgggtttagttttagtgggtaagaggaaggaatggcggccgtacagtaccgctgcttcgttggtgggcttgcctgtgccaccgacgaccagggccttcagaacgccttctacaagtcacggggagcgtgagtcgactccaaggatcatgactgactggatagtacgggccgatcccgcgggttctgttttgtcaccttgtcgtcggacgaggccatgcgccaggcaatcgaggccatgaacggccagaacctgtacaggccgaacatcaccgccaacgagacgcactcctgtccctctggccgatgaggctgcagccgtttcgggcccggaagtagatgcctacgcgggcacagcttccaagggaggggctgcagcggctactgcgcgtgcacgggagctgtccgatgtggccgcagagctccccaaggcggatacggcggccgagacgcaggcgaataccgacgccgagaggcgcgggcctacgggcgcagccctggtc

SEQ ID NO: 56008 - DNA, 573 bp, Triticum aestivum
  unsure (1)..(573): unsure at all n locations
  Clone ID: PAT_TA_56008
ananagcatcccngacccctttccccttcgtcgtcacccacacctccggcggacaccgggcgctcccgcggtagacgttgcacttcccggcaagcaggcgcaaccagggcggaggcggtggacggctggggctcgtcgggttcgatttttcgccgtcggcagcgggagcgagcgagatctcaagtgagtaccaggccgcttcgccctcctggtggccggcgagatggcctcaacagcgtacctcgagacggacgaaaacctggaggccctcattagccgcatcgagcagaagtcccgcaagatcgagacccttcttaagcagtccaagccggtggaggccctcaagacggcgctcgaggggtcgcccctcaagacccgcgacaagcgatgcaagtcggcgaactggatcgtggtgcaccgcgccatgatggcgatcaaggacatagacggcatgttcaactcactggacaccgagtactacgacatcctcatgaagtacctgtacagaggtttgtccactggcgaccggccgacgtgcgaccagtgcctcaaaatccatgagaagctgacgga

SEQ ID NO: 56009 - DNA, 565 bp, Triticum aestivum
  Clone ID: PAT_TA_56009
tttgactccaaaaatcatttttcctaatattatttattttagggactacggttttgagaacatatatatgctgaattatgtgtctattggccaggtggtggcggaatacttgcctgctgaagagctggggcaatcacggaactgttccacatgctggcactaacagggtgggcacctgacattgaggagctcaggaaggtctacaaatgatagggaacaatgtccatgatacagagtggatatgctcatggaagccggagatcctgcacattcacttttaccaaaatatttctaaagcatcttcgaatgcagacattggggagctgtctttttctatcttggtgtttcagaattctgacatgtgacccctaccagtcattgaactattaaacaataaccaccagttgctccatgattcatagagcttacaatttggtaaactaaacttcaaagattaactattttgagtttttaatctttaggcggacttagatggaaatggcaccttggactgcaaggagtttgtcacggtctccattcacctgaagaaaaccgcagcgaggaa

SEQ ID NO: 56010 - DNA, 516 bp, Triticum aestivum
  unsure (1)..(516): unsure at all n locations
  Clone ID: PAT_TA_56010
ctaaaaaagaaaacggggggccttnatgcatgcctcaaccacaaccagatgattatcgtctcaaacagaaggggactggcactcacaagacaggagctaccagagatananagagttacanctancaatgggggccatgaaaggggatctcccacccacccacctaattaangatggaagcgctgcatgcaggcgtggcaggtgatctccagcgcggcggcggacgccgcggagcccagccccctggcggcgatctgcttcatccgctccacccgctccacctcctcgcgggcgcgctcccagatcatcctggcgcgcgcgaactccctctcggcgagctccagctcccgcttcnccagatcccggacccgctcccggtangcgcgctccnccgacnccatcccggcttgctcccccgtctgctgcttcacggagcggacctccaccctcacctgctgctgcagctgcctcnccctggcagcgctggcgggcacagtgcccccccctctcttgctc

SEQ ID NO: 56011 - DNA, 414 bp, Triticum aestivum
  Clone ID: PAT_TA_56011
tttcccttcaatatcctataccaaaaggacctagcctcctccgtgaccggtgacacattgaaccatcatgcatactccaattcctctagctactgcgctgccgtttagggaacgactgagcatccttgctggtagcaggagcgtccgcatcaattggaggcgtgctgcttgtaccctaatgcggcttaaaaggctgactacttcgaaacctgctgtgaatcactggcaacacttattggatgcagtatctggagcagaggcagcacatcgaccttgacgaactcggtgatgaagaagacttccaagattacctcgcttggcgggtgccaacagcaggaataatctatctccatgccgccaatagcgggaacaggaacagatcacaggaggatgacgctagccaccgcaagtaac

SEQ ID NO: 56012 - DNA, 518 bp, Triticum aestivum
  unsure (1)..(518): unsure at all n locations
  Clone ID: PAT_TA_56012
gggggggggggcataaacaccaaaattttggggcgagtcaaaaaaatttctgacattcttccattaaacatgcgcacaacaagataaaacaacacaactacaggaacaccaccggaccactactaaaaacactaccacatnaaacgcgtggggggggcggggntnttcttcttnggggacttgggccctttcttgggagacttgggctccttgccctccttctccgcgggcctcttggggaggagcaccgggttgatcttcgggatcaccccaccgtgcgcgatggtgacccccgccancanctttccgagcgcctcgtcnttcctgacggcgagcatcangtggcgcgggatgatgcggctcttcttgtggtccttggcggcgttcccggcgagctccancagctcngcggcgaggtactcaaggacggcggcaaggtaaacgggggcgcccgtgccaactcgctgggcgtancggcccttcttgaggtancgccccatgcggcccacggggaactg

SEQ ID NO: 56013 - DNA, 519 bp, Triticum aestivum
  Clone ID: PAT_TA_56013
gtggtgagaatgggcgagcgaccgctgctgtcgcggcaccggttcttctcgaacaggaactctgggcacgccgtccaccttcgtcgcgccggcccaccactgctcgccgcccctctcttccggcccggccggactccacaggaatatcgcgaattcgccccggcacaatccggtacccgcccggccgtgtagaggcatgactgccagggagtcgtaaggctgtttggggaggcctttgatggcacaagcggcagccgagaaaaggaggctttggaaagagcggcactcggcggcgctggcggtgctggcggtctagatgaggtaccgcaactcggggacgggggaggcgtaggccacgtaatatgcctccagcccagagtgccgcccctacatgtgggacacggtaccactggttatcgttcaggaacacagtgcgcccatgcaggatagatcgcgcgccacagaggcgtatatcctcctcacctgaacacaagctgggggtacgggggccgtcgatgc

SEQ ID NO: 56014 - DNA, 564 bp, Triticum aestivum
  Clone ID: PAT_TA_56014
cgtaagacctttttttgacactagcggtcttacattataggacgaagggggtatcatttttttcaagggttcacaatttgtttggctaggtccaagttttgaacaacaaaacaaaagtaaagatgttggcatacatttacacgctccacagagccgcatggatacatgcaggccggaatgtgtgcttatttacgtacgtacgtaacatttgtagacgtataaatattcaaaccacacaaacataaacacacccacgtacgtatgcatgtatgatcacactcactcgcacgtactaggcttcggcgtcaagggtgaggaacgcgaacgggcgctcgccgttgaagttgcccgggggattgtagttgcaggtgatgaaaacgccccggttccccgtgcaaaccacgcgcgcgcagccgatgcgggtcgacttgcgccacaccacctgcgtgtagtgcccgcacaccttgccggcgtcgcaggtgttgctgtcaaaatggtagttctgcttctcgtccacccacagcttcaccgcgtcggcggccgtccacgactgcccggaacccc

SEQ ID NO: 56015 - DNA, 464 bp, Triticum aestivum
  Clone ID: PAT_TA_56015
aaacggcacatgataattctagaaggtgcttaatttcatgcaaagaccgcgggcgtcagcaacaacacaagcaggaatgcgagatgcctcctacggacctactttgacaccatcccacatagctcagatgcgcgcgcactgaccgttgcttcctttgttaaacagtcacgggctcgtaaaacggaacctgacacatttgagtgggacgcaagccacctggggtgtcgaacacaggaactgatgacgctgggaagatatcaccagtactggcactagggaagccacgccttgttcccacggtttgtatatggcgcaccccttatggatcatgaactgaacttgtacccaccggatactcccggacccgatgcctctcacctgcaatttccaacaggtgcctgtaggcgtaccagccgtccctctagggcttcatgattaccacctgggcgaaatcttggcgctag

SEQ ID NO: 56016 - DNA, 550 bp, Triticum aestivum
  unsure (1)..(550): unsure at all n locations
  Clone ID: PAT_TA_56016
ggggggggggtgggtgtttaaaaaaaccaacgggggcagattatggataattcatagcggggttcatctcattcaaacagtgagatagcagcagacacaggaggagaaccatgggcgcgggacacagatccagcggccaaaaaagtgcggggggggggggggggaaaccaaccaccnaaatctcatccnaccgacaagggggaaaacaccacaccacacaccactctcttatttanatcgacgacacggggacacggggcgacgaccacaggcgaccggggggcggacggatctagagctggccgcagtcggcgatgacgacttgcttggagcaggtgccgctgcgggagcccaccttctcgatgttcttgacgacgtgcatgccctcgacgacctcgccgaagaccacgtgcttgccgtcgagccaattgcaggggacggggcanatgaaaaactgggagccgttggtgttggggcccgcgttggccatggagaggatcccgggcttggggtgcttgtggacgaacttctcgtcggcgaacttctcgcc

SEQ ID NO: 56017 - DNA, 565 bp, Triticum aestivum
  unsure (1)..(565): unsure at all n locations
  Clone ID: PAT_TA_56017
ggggggggggggggcaaaacaagattttttgctatgatgaaccanagattacttgtgttttattaagaggggggaagccctatgggttccatttatagacaccaaaacagtcactacactctacaggggcgttctcccagctacacggaggggggggggctgcanactacacaanattaattgacagcgcgtaaatgcgaaaaggagttggttactcactgtgaagggggggatctaagacggggatcaccttaccaaagcgcttcnaggggcgctgtgcccattcacagacccttgggaaaattctttcaaggggtatattccactgggaagacttatcaccccatattgcttctgtgagccttgggtcnattgtgaggtgctcaagtacaaaagcatttcccaagatagagcacgccanctcaatctgagacttgtgacactgaaacccacccatgaagaccgtcttaagatgatcatggggacacatacagggaccttccgcccccgccacctnnggactgaagaaagcaccgggactcanatagtgcatatgcaagtgcaa

SEQ ID NO: 56018 - DNA, 560 bp, Triticum aestivum
  Clone ID: PAT_TA_56018
ggattaaccacgacttcattattattcccatgcactcaatattctggtgcatatatgtacaaaactggggaaatgagtttaaaaaaagtcaactgtgaacacattcctccagttatgctgcttgcaacaccgctatccagcaaggtgcttattaaccagccaaccatacaacaatgacacatttcgacgaaagccccttccacgcattgacgaggaacatgacggatgattgacacgctcccgacacttatttcttgtctgggatcttctccaggagctcctcgaggacctggaacagatcgccaacgatcccgtaatctgcgacctgaaagattggggcgtccgcgtctttgttgaccgccacgatgtacttggaatctctcatccccgccaagtgttgtatcgcccctgaaaccccgaaagcaatgtagacctcaggcgcaacgatcttcccggtctgcccaacttgtagttcatttggcacatatcctgcatcgacggcagctctggtcgcacccactgcggcgccaagtttctctgccagctgctccaacaatttg

SEQ ID NO: 56019 - DNA, 592 bp, Triticum aestivum
  Clone ID: PAT_TA_56019
ttttcagaagctcaaaaacaaatcatatattttttacacagccatacaagtatatactgtaccagagcaccccaagcagagaaactcatgttgcactgcacaatataatctgaaatggcacaaggtcaaactccaacgggacatccaaccgaaatgcaccactttctttcctgcaaaaaaaagtaaaggaagaaggggttacagtactgggcgatatggggtgcagctatgtgtccacccgagaggagacacaaaactgcatcacacacgccactatgcgacctaaaactacaacacaggttcagcgacgaactacaccagtatgcgacctgtactacacgcatggccgacggactacatgcacatgtgctccacaccgcatgggcgcatcgcctgaaactgcacgtggacaggaaccaagatcgccctcctcttctcgcttggagaagagtgtctgctcagctgactgcacctgtcgcgtcaccaagctgcacaacaaaagcaccgaggtgatgaagctcgtgctcagattaaccacaagcagaggaaaagcaaacctcacctggccagccactgagctgtaccacaacgg

SEQ ID NO: 56020 - DNA, 583 bp, Triticum aestivum
  Clone ID: PAT_TA_56020
gaacatgcaagggtgcctttcatcgggaagaaccaaatccaatgtacagacatgccgagcctcagcacaccaactcaatcaccagcacgccctcaggaaccacaccacatgggactcaaaagaatggcacgaatcatggacactatggataagaagacggatcatcagatcaaggttcagaactcctcgacggaggcggcttcgcggggcacctcgtaggcgtccttctgcctcagcttcttcacgccggcgatgaagcacaccttgtcggaccggaagctctccaggttcacggtggtcaccttcacccacaccaccaccttggtcttcatgccctcgatcgccgagagcttgccccgggacagggtcgccttcacgcgggtggcgtaccgtatcatggaggagtccttgaagctcacctcgcagggcttggccaggtgcaccacgagcctcgagctcgtctggtcgtactcgtagcagatgatgttccgagggaagaggcccggagggaggttgtactcgcgcagcaggtcagagagggacttgtttggtttgcctttgagcttctcgaagacccatttcg

SEQ ID NO: 56021 - DNA, 227 bp, Triticum aestivum
  unsure (1)..(227): unsure at all n locations
  Clone ID: PAT_TA_56021
ggggggggggggggggtgaaaaaccccacattttgatcgacagctccccgaaaaggggggtcatttctgaattacaagtcattataagaagtggcagcagctaaaatgggggcaaccaatcgggggggtttcctaaacaantgttgggggggggggggggccantnctnctaactcancacccccttattncacaagtntanaccaanacccccgcgcgcgggcccc

SEQ ID NO: 56022 - DNA, 539 bp, Triticum aestivum
  unsure (1)..(539): unsure at all n locations
  Clone ID: PAT_TA_56022
ggggggggggaaaaaaaaaaacgtggtgggttgccaaaagcccaaattaacaccacagtgctcaaatgacacatcaacagggggcgtatcacacggggctaacagtggcaaaacttaatangcactaaactactacagaggggggggggggggggnatattnattcanntaaacccctcatttcttcttaatggcaaccttnntcaccttnncccccnttnngtccttcttctccacacccttnatnacaccaacanccacantttncctcatntccccnacancaaaactaccaanangaggggggggagcaaaggtctccacaaccatgggcttggggggaatcatcttcactatgccagcatcaccattcttgaggaacttgggcagggcctccagctccttaccagatcggctggcgatcttgggcaccagctcagcaaacttnacagcaatgtgcgaggtgtggcantccancactggggcatanccgttgccaatctgaccagggtggttcatgatgatgacctgggaggtga

SEQ ID NO: 56023 - DNA, 532 bp, Triticum aestivum
  unsure (1)..(532): unsure at all n locations
  Clone ID: PAT_TA_56023
gggggggggggggggttaaaaaaatattcaaatacggggagtgccattataattaaatatgaggtgagtttattgtgactcctgtgctccagtgtaactgaagctgggcatgctaaatccccgacatttattttnngatggagggggtggggggggggggggggnaatacangagccacccaaccagtggggagaccccattancatcctaacattgaggggggcacgggcaacatgaggggagggcagactggctgacttcttgcgttcctctggggcctgtgttttcctgtgtggcaaggccccataacgtgggggggttgaactaaacaaggacggagttggcatgccaccaaaatgggacgatatgggggtgtccacagaaccaggtaaggtaggagaggacccaccagaagacctccaatcatcttcctcttcaagaattgtgttgggccacatatcatcataaccaactgaggacctagaactcatgtgttcctcatcatccacatcaggagcatcaattccagca

SEQ ID NO: 56024 - DNA, 373 bp, Triticum aestivum
  unsure (1)..(373): unsure at all n locations
  Clone ID: PAT_TA_56024
ggggggggggggggggtaaaaaacaaaaatgcgctgcaagatgtgtcaaantacacctgtgagtgctgggtaactgagatagagagggggctcacttttactgggcacttnagaaaagggggttacaggggattnagtacactttagggggggggggggggggggnaaacanatanctcatcancaaactnaaaagcgtaataactgcgtatgcgtctaccggttcctaaccagaaaatatatccttgagctagagcgtgagcaatcaatacaggttcatgggcgatcaatatactagagacttnagcgagaggggggaggaacgcgcggtctgtgcttttctgtgttgcgtggcaatctctcangctttttt

SEQ ID NO: 56025 - DNA, 399 bp, Triticum aestivum
  unsure (1)..(399): unsure at all n locations
  Clone ID: PAT_TA_56025
gggggggggggggggggggggtgaacatacatcaattgcttgcttatttgccatcacatgaaggggcaaattaacacgaaccattggtcactgggcgatggggccctccgccttgcgcacctccacccttancacccggtcctctccggggggggggggggggggctggaanaaccacatntcncccacctggaggcccttgtcgacccggaaccgggtccacccgtacctcagcggcgtgcggggcctggcgtgtcccttcctcctggtgctgtgcttgagggggaccctccactggtgcccacccatccgcaggagcgccctgcccttctccgtgaacccttgcgagtgggtgaactccacaggcgcgttcaggtgctccttcttctcggggcccag

SEQ ID NO: 56026 - DNA, 656 bp, Triticum aestivum
  unsure (1)..(656): unsure at all n locations
  Clone ID: PAT_TA_56026
gcacanacaagccctagggttttagcactgctcgagcgcgcgcccggcgacgcaaacccgcagacaaactttccggccatgtcggcggcggcagcagctgcggacacgtactccccggccgcggaggctgggagcaagcgccgggagaggagggaggagctgcggcgccacctcgccgaggatgccgattggccccgggccgacggccgctccttgcacgactgccgccccgcatttatgcaaacagggccaactactgctgcatcagggtctgcttatgcagaatttgggaagacaaaggtcattgtgtcagtgtttggcccaagggagagcaagaaagcaatgctgtacagtgacactggtaggctcaattgcagtgtgagctatacaacattcgccactggtatacgtggacaggggctggaaaacaaggagtactctggaatgcttcacaaagccctggaaggcgcagtaatgctacatacttttccgaagacaactgttgatgtttttgcgttggttcttgagtctggtggcagcgatcttcccattataatatcttgcgctagtcttgcactggcagatgctgggattatgatgtatgaccttgttacatcagtatcccgtgtcctgtttagggaaagaacgttatcatc

SEQ ID NO: 56027 - DNA, 549 bp, Triticum aestivum
  Clone ID: PAT_TA_56027
gggagtcggacccagacttttcaagaggctcctcccaacaggccgacagggagcccacacttttcacaccaaagccagcgccggggccaggatgcaggccaccgacacccaccccggggtacacgcaccccacgcccgagcctggacgcaagccgccggctccgtggtgcacacggcccgacaccgaggtaccagcctcccgatggccataggatggggccagacccgctgactgaccctgcaatcttaaagaagctagtgccggtcatcaagaaggaacccattcttcaagaagttgccctctgccgaggaggatacttagccatataggataggagcagacctgaagagctttgcctatttcatgatccactgccgggtagatacatgcagggcatcctatctttagagggaaatgctgatacctggtaagctacactttgttctatggatgaggcgctggaatatagaacttgttacaaataaaaccttgactgaatgatattatagatctatatcgctcgagctggcacttgacaactacctctg

SEQ ID NO: 56028 - DNA, 538 bp, Triticum aestivum
  Clone ID: PAT_TA_56028
cccagcgtcggctcacgctttgcctctttctgtcgctctgtccgctgctacgtctccttctccatcagcgtcaccactagtgctacttctcctccatcgcctccactagtgctgtctttcgtacggttcctactgcggactcgaccgcgtgcgttcactcgtgcgttaacagataggtgacaagaagggagacaagatgcacggtaaaatcccgaggaaaatcggcttgaacacggggttgatcacgggaatgctggacggaagggcgcgcgcatgcacaacaggcgtcacaacacgtgacctgtgcccagaccggagccacaaccgaagacacgacctaggacaggacctagaaagggacttggataaggaaaatgataaccaaaataaaatacgagcgaagacaagggctttagcgatgggtggagctatacgggaccctatacgtaaacatgaccgggtaggagaccggggcaggagaactggcatgaagaataacatacattgctgcagacgcaagagtttgtgcaagaattgg

SEQ ID NO: 56029 - DNA, 592 bp, Triticum aestivum
  unsure (1)..(592): unsure at all n locations
  Clone ID: PAT_TA_56029
cttacacttgactgaacctaagctagcatctgtcaaacatcatggctgcagttactggttacgaacacgccgacgcgtgggagcaggactggctcaaggtcgacgatacgcatgaggtgtactacgagcaatacggcaagaaagagggaaaccagtcattttcctccacggcggccccggcgngaaaaacctccaaagcaaacacccaattcttcaacccagccatctaccgcgtcatcctcctcgaccagcgcggcgccggcaaatcccgcccccacgcttcaataaaagacaacacaacctggcacctcgtcgccgacatcgagctcctgcgccgccacctcaacatccccaaatggcacctcgtcttcggcggctcctggggctccacgctcgccctggcctacgcgcaaacccacccatccagcaccggcagcctcgtcctgcgcggcatcttcgccgtgcgcgccaaagagctcaactggacgaaccagcccggcggcgcgcccttcctgttccccgacgcgcacgaagaaatggtcaatttcctgccggaaaacgagcgcgcggatcacatgaatgcgtaccatga

SEQ ID NO: 56030 - DNA, 527 bp, Triticum aestivum
  unsure (1)..(527): unsure at all n locations
  Clone ID: PAT_TA_56030
agtcatacattcttttctttaggctattcactcccgaccagttcggcttacattctttacaatcattctttattcttgtattattttcaaaatggtttctcttgttctcctcattgcgtccctcgcatcagcaggcctcatcgagggagccgccgtagatgtatccagcaaggttaacatagtagctaggcagcagcgcggaggtcaaggaggtcagcaaggagggcaacagaatggaaaacaaaatggccagaacggtggtggccagaacggtggtcagaacgctggccagacttgcttgaacaacaacctcattcagtccgctagcggtctcacgggccaagaaacaggaactgagggcatcaagcctgnacaagcaccttcggctgtcgacaaagcaaacttcatcaatttctgccagggctcagaactcaccaatggcatgcagatcaagaccgggtcctgcaatggcatacctatgggcaagatccccgcgcagaccaacatggtcacggccgtcatcactg

SEQ ID NO: 56031 - DNA, 529 bp, Triticum aestivum
  unsure (1)..(529): unsure at all n locations
  Clone ID: PAT_TA_56031
tttgtgttgcaacacgatagaaaaaaaaatttattaccagcagcagcagccatggagcgacgtggatcgncgcacatctacacacacattccagtacactccaatacaatgacacacactgacacagcgtgagccagcgtgagccattggggaacatggggaagaagcggtgctggcgctggctctgctggtgctggtggtgctcgcggcggggccgcacccgggcgcacacggggtgccaggcgtgacagtgcgctggtgtgcgctctggcgatgccgacccgagccaagactgccggcgagagctgcgggcacctgagggcgcactatgccagctcgtgacagaccgcacatgaccccagctaatggcaggacatcaggagcgcgaaagcgcgcaatactgtggagctctgcggcctcactgttcggcactggtaggcgcctggaggccactggagcactatggtaagtctaggtgcctgagagaccatgacagcgtctagacctatctagcccatacgagtgccta

SEQ ID NO: 56032 - DNA, 651 bp, Triticum aestivum
  unsure (1)..(651): unsure at all n locations
  Clone ID: PAT_TA_56032
cagacgagtacacgcctgcgagnccggaaagtggccgtctgtttgaccgggacatgctaatataccgtgagaggcactgcccgggcaaggacgagcagacccgatgcctcattccagcgccaccaaagtacaagaatcccttcaggtggccggagagcagggacgttgcttggtttgacaacatccctcacaaggagctcagcattgagaaggccgtgcagaactggatccgagtggaggggaacaagttccggttccccggtggtggcactatgtttccccatggtgctgacgcgtacattgatgaaatcagtaagctcatctcgttgtcggatgggaggatcaggacggcgatcgacacgggctgcggggttgctagctttggggcttacttgttgaagaggaacatcattaccgtgtcgtttgcgccgagggacacacacgaagctcaggtgcaatttgcactggaacgtggtgtgcctgccatcctcggggtgatgggatcaatacggttgccttatccatctagggcatttgatctggctcattgttcacgttgtctgattccttggggaggacatgatggactgtaccttgccgagatcgatagaattctaaggccagggggctactggattcactcgggccctc

SEQ ID NO: 56033 - DNA, 645 bp, Triticum aestivum
  Clone ID: PAT_TA_56033
cgtccattctcccgaagaaaagagctagccatgggcggcgccaccggcatggtcgtgctcatggtgacaataattccggcggcgttgctgcatatggtatcggccggtggcacgccgcccttctcgtgctggccgggggcgccgtacgtccgcttctgcgaccagcgggtgccggtcgagcagcgcgcggcggacctggtggcgcggctgacgctggcggagaaggtgtcgcagctgggggacgtggcggcggcggtgccgcggctgggcgtgccggcgtacaagtggtggtcggaggggctgcacgggctgtccatgtggggcaagggcatgcacttcaccggcgccgtcaagcaagtgaccagcttcccgcaggtgctgctcaccaccgcctccttcgacgagaagatctggtacttcatcggccaggcgatcggcgtggaggcgcgggcgttgtacaacatcgggcaggcggaggggctcaccatctggtcgccgaacgtgaacatctaccgggacccgcggtgggggcgcggccacgagacccccggcgaggacccgatcacggtgagcaagtacgccgtcgccttcgtgaggggcctgcaggggccctcgccgacgacgctgcagacctcggcgtgctgc

SEQ ID NO: 56034 - DNA, 540 bp, Triticum aestivum
  Clone ID: PAT_TA_56034
catagtgatcctcccgaagccccaaccgacctctctaaccccagctacagagaccggatcggagggtgcgatggcgaacatcttcacggcggctgtgctgacggtcatgctaccgtgaccctggggcgggcgccctgacaccttggaccaaacttgtgtgcacgctcctaccgagctgccgctccttgcccatgctggaaaagtgtgctcctgcgccggtgtgaacgttgagcgcttcagcttctatcacgggacccacaagtaccacagggagaccctatagaccctctgccagggcatgcaccatacctgcatgctgtgagccaggatgctcatacacctacggaccagtgactcttactggattgtttgaaggtatggtaaaacggtcaaactgacctagggctgagaacagactgtgtccagtgactgctgtttcaagcgcgacaggatcgccatttacatgagctactggaaactttcttacgatgtgaagcctgcgcatgcaatactatgggctcatggtaccatctgcttgaa

SEQ ID NO: 56035 - DNA, 637 bp, Triticum aestivum
  unsure (1)..(637): unsure at all n locations
  Clone ID: PAT_TA_56035
ccggccgtcggtgccccgactccatcctgtgatccggctgctgttgctgctactccatcccgtngaagaccaaggccagactccatttaccctcccagctccccctctcctggcggcctcgtcatcagagctgcccgagcgcctcgtcgtgctctatgcatcgcaaactggcaacgccatggatgctgccgaacgtgtagggcgagaggctgagcgtggaggctgcccggctgtcgatgttctctccatggattgcttcgatcccagttgcctgccacgcgaaaggtatgtggtcttcgttgtgtccaccatggggcagggggaccccccagattccatgaaggatttttggacataccttaccagaaagtctctgggtgcgcgatggctggaagggctattttatgccgtgtttgggctcggcgattcaacctatgggaagtacaattatcctgcaaagaagctcgatcgaaggcttttcaatcttggtgcagaaagaatcacagaaaaaggcttggggagatgatcaacattcatctggatacgaaggagctctagatccgtggttgctgattttgtggaaatccctgaatcaaacaaatccgtcgctgttaccaaaaatatctgatgccattca

SEQ ID NO: 56036 - DNA, 575 bp, Triticum aestivum
  Clone ID: PAT_TA_56036
gcctagttctagatcgctagcggccgaccttcttgctgaatactgctgactgctgcgaaccacccaatcatcattggtgctgctgtattatgacaacaagaccacgaggtgctgtgtcatcagcagtagccgccgccaccaagaagaataatgcaacaccaccctgctgcagccgtcatgatctactattgcttgctgctcaacacgccgctcttgttgagctcctccttgctgataataccaccagtggtgagaatgctgagaagcttctccacctggtagcagccgacgatgaccaccacaacctcccagcagatgcatcattggttgaccaccagcaccaccatgacgacgacgcctacaacaccaacgatgttatgccatcatcatcatcaatcaacaaaaaagaacctcttataacaccaccgaatgctccacccagaccaccatacctgctcctactacaggtgatgacaccaatgactactggatcatccgtcctgctttctacgatgccggcgctgctctactgtactacaacagcgtagctgctatgaggagcctcatcatgatgg

SEQ ID NO: 56037 - DNA, 567 bp, Triticum aestivum
  Clone ID: PAT_TA_56037
atttcacgcaccaactttgcgtttggtcgtctgaccgacaaccagagacgaggatcagcgagggcaatttcatcagctagatgaaaaaagacgtggcgtcacggcgatgcacctgcgaccaggagtgcagctgccgctgcaagcttgtgcacacgtagataccaccagcggtgctgccgctgctggaggtggtggcaggcgccagtacaatgcttcaattctacactgataacgctgctgggctgcagaagaccccaaatgctgtcctgatcatgaacatatggctccatttgcccagcggtgccatactccatgttttctgcaagctgtaccgcacccctaattaagttccatatatacaacctgagtttatatgtaatataaatttccacatcagacacttctcataagaaatcactgagcgatctctgaaaagatctaccttctaatactgagatgatgttgagaactttctgaacgtgttagtgttgacattcgtgacttacacttaatgatctaaccttgcggtcgtcttagtatagggacacgtgtgatgctggctaatgt

SEQ ID NO: 56038 - DNA, 410 bp, Triticum aestivum
  Clone ID: PAT_TA_56038
gctcactccaatccctccacacgctacctccttccgctggtgaggcttcgtcgctgcaacgccctggccattcactgtcgccatcccgggccgttcaatgagacagcgccaagtcgttcgacaccgcaactcaggagtctgcctcctttgacagctcctgatctccggaacaactatggctccctgctggcacaacttgctctcgacgacctcctttgacagcttgcctctgaggcctaccagacccacacgacgacgctagccgtccacagccaccaccacaggccgttcaacccaccactcatggccgttctcaaaaccatcccaaagtgtagatcgtacatgaggacagggccgaggcggaggcagcaaagaaagagctaagcgatccagtagagtttattgattga

SEQ ID NO: 56039 - DNA, 657 bp, Triticum aestivum
  unsure (1)..(657): unsure at all n locations
  Clone ID: PAT_TA_56039
agagaccttcagacttgaagcatggccacggtgctgaacattggctcaagtggattaacacgcgacaccggacgacaatctgactctgcgcatggctacatgcacagcacacggaactgtgcaccagaacttgcatatgtggaccagcaacaaggcacgacaaggtacactatctctgaaggcgaccgcactgtaggacgtaaaggtcctgccaaccaagcaccttataaactcataagttacgtgcccaataataacggctcgcaagcagatcattgtatctggcggaactcttagctcgcctctcattttgcagcgctcatgtatacggtgtacccagtagaagctccaaaaggctggcgtcaatccatnttgtgagacactgcctggtgcagtactcaacttccaagaccactacacttacacttcggccgacgtataaaaacgaagccacacgtcgagtctttcgatgactatgcacgtggcgacccggtagtacaggagcgcgtttttaaccaatggaacatcaacggcactgtgccactcgccaccaacggcattgaatccggagacaagatccgccccacggaagaagaactcaagatgatggatagcttgccgagccccgagttccgctaggactgcgacagttacttt

SEQ ID NO: 56040 - DNA, 335 bp, Triticum aestivum
  Clone ID: PAT_TA_56040
tctctaagccgctaagctcaccctggtcgcctctgcctgcgtcttcgccgcaccgagaagccggactggggcggccgaaggaaggcgggacgcttatcacgcagcacgcacaaccagagcacaatgcacttgatgccgaatgcgaccaggctcctgcgaaagaccttccgactattgacggcgcctggcgaattctttctttctaagctacgaactactacaggacagcaacgcggggccggagccgagctcgctgaccacggagagggatacactccagaagaacaagccgccatgctgctacaatacaacttcatgatcggcgacacctacat

SEQ ID NO: 56041 - DNA, 632 bp, Triticum aestivum
  Clone ID: PAT_TA_56041
gcttacaaaatagtactccacgtgtgctcctctctcagtgtgtgttcgtgagctagcttcagtattagtgcagtttatctgcctgcgtcttgtgcactagtgtgtccgtgtgctagtagctagcctacaccaccgtttctctcggggggcatttcatatatacacacgcgattaacacgtacagtacagacatccttcaacgacggtcgatgatggccggcgctcaagagcaagggctgaagctgctggtgccgcggagcggtgtgagcatatacgccatccgcgtccagatggcgcttgccatgaagggtctggcttaggactaccttcccgaggaccccgggtgcaagagcgacctcctcctcgcgtccaaccccgtgcacaagacgctgcccgtcctcatccacggcggcaggcccgtccgcgagtcgctgatcatcatggagtacctcgacgatgcattccccggcaacggcgcctccatactccccgccgacccgtaccgccgcgccgtcgctcgcttctgggccgcctatgtcaacgacaagatgttcccttcgtgcatcggcattctcaatacggcgaagcagcaggagagagccaacaaggtggaggagaccttggcggcgttc

SEQ ID NO: 56042 - DNA, 301 bp, Triticum aestivum
  unsure (1)..(301): unsure at all n locations
  Clone ID: PAT_TA_56042
gggggggggggggtgtttaaactgttagaggggtgggggctccatgggggaccagacaagaggaggggaattatctggggcggtaaatatacacgtggagagggggctgctagtgacaggttncttnggggggtgggggtcctggggggggcagcngtggggcttnagggggtcccccnccttntncangttntcccngacgggcaggggncagagcancgtgaccctggactccgagatctgcggggccttcttcccctnctccggcgggggcatcttccacaggttcacctcccacacc

SEQ ID NO: 56043 - DNA, 579 bp, Triticum aestivum
  Clone ID: PAT_TA_56043
tttttggctaggtccaagttttgaacaacaaaacaaaagtaaagatgtttgcatacatttacacgctccacagagccgcatggatacatgcaggccggaatgtgtgcttatttacgtacgtacgtaacatttgtggaggtgtaagatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacg

SEQ ID NO: 56044 - DNA, 349 bp, Triticum aestivum
  Clone ID: PAT_TA_56044
tttttaaaagaagtaccatattacaacttcatccatatatttatttcttaatcatttccccacaggtcaatttgcatccagttccactatcctaccacccctgcgacaaaaaaagtaaaaactacctaagttcaacattgcggggagaggggaaaaacaactggctggacacacctcggacctgggttctgtaaatggctaaaaacctgaggaggggcccaccctctctggcttaatatccttcttggggggggggaacttgcccaaggatgggtccttattagatcaacggcacgagcttattcaatagctagggtccaggtcctggacttgcaccatcttctgacca

SEQ ID NO: 56045 - DNA, 566 bp, Triticum aestivum
  unsure (1)..(566): unsure at all n locations
  Clone ID: PAT_TA_56045
gcgcgcgggggggggggggtgtttttttttttttttttttttttgagccaaaacatgcgtcattgcgttgtttacggggcacacaagtctcgtgatgctacagaccaaaagtgcaacaaaacttccagccccagtgatatgattggcacccagggggggggggggggggtgtantgtattttctcactatatcaaaaagaataacttagtcgacctcctcgatcttggggccagcaccggcgctggcagccggcgcgtcctcgtccatgcctccgggcatgtgagcaccgggaccctggtacatcttggcgatgatgggggggcaaaggccctccaactccttcatcttgtcctcaaactcgtcaacctcaccaaggtggttggggtcaagccactggatcgcggggtcaacagcatcctcaatcttcttcttgtcgtcagcaggcagcttggaggcaatcttctcgtcctggatggggtgcctcatgtggtgggcgtagttctccagggaggtcttgggatcaaccttcttcttgtgctcctcatcctcagacttgtacttctct

SEQ ID NO: 56046 - DNA, 537 bp, Triticum aestivum
  unsure (1)..(537): unsure at all n locations
  Clone ID: PAT_TA_56046
ggggggggaaaaaaaaatttttttgtgttttttttttttttttttttttttctaaaaaaccctttttttttaaggaaaaaccaatcccacccccaaaaggctctaccctaccccctctttaaattaacaaaacttttttggggggggggggggggcttaaacccaccccccaccctnaaaaaaaaataaaacaaggattcccccctaccggggccctttcaaggggctaaaggaaacccccacccccaccctaaaaaaaaaggctcccccttaaaaatctaagttcttaaggggaatcccccccccggaggaaatctttctccccctcaatccaacaaaattgaaacccacccccaacagacgagggccaactcttaacccacaagcttaagtaatcctcccccccccacaagaaaaaacttctccccaaaacccacccccccataaatttcaggcccccccaaggcaaaggggccccccactccagcaatcacattaaacacaagcctcancccacaatttaaccattttttttat

SEQ ID NO: 56047 - DNA, 579 bp, Triticum aestivum
  unsure (1)..(579): unsure at all n locations
  Clone ID: PAT_TA_56047
gggggggggggggttttataaccaccacatggggcgggcgtggctccaatgcgtcactagcccctccattacccaaagtgatgacaacctccagagtgggggagtggggggggtatacctttacagcaccctanatttacatttctgctggtcagcncgggggnggaantgttnnaaccatntttancaaactagcgtgatctttattttttccctattaaaaacagtgtctatactctcatttcaggggtgacgtggatctgacaatataatgggggcgagtgtcatgaatctgctcttagcgtccgcgcttgggcgaccggcctanagcccgtgaggaagtctcgataccacttccctgacatctttggagtcctctcttgcgtttcaaaatccacgtgataaatcccgaacctcacggtgaaaccgaaaccccattcgaagtgtgtgcatgaggctccacacgaagtagccatgtgcgtttgctcctttcctgactgctgaagagatacatgtgagataaccttgcaggtaggtcactcttccaacgtcattgatcaagtcctccatactgtgatg

SEQ ID NO: 56048 - DNA, 442 bp, Triticum aestivum
  unsure (1)..(442): unsure at all n locations
  Clone ID: PAT_TA_56048
ggggggggggggggggtaaaaaaaacaataaggggggggggtgaaatcaacaatgagccaaaacatgcgtcattgcgttgtgtaccgggcacacaggtgtcctgaggcgacagaccaaaatgcaacaaaacttccancccanntnatgtggggggggggggggggttaaacaaatnnggtatantntgttttctcactatatcaaagaggataacttangccacctcctccatcgtggggggaacgccggccctgggggcgcgggcgtgctcntccatgcgtcccggggtgtgancaccggcgccctnggacatgggggggagnatggggggncaaangccctccagctccttcatcttgtgctcaaactcngcaacctcaccaaggtggggggggtgaagccactggggtcgggggtgnacaggatcctcaatcttcttct

SEQ ID NO: 56049 - DNA, 581 bp, Triticum aestivum
  Clone ID: PAT_TA_56049
ttttgtgcaaaagaatgacatttataacagctcaagaaggtgtgacaattatagtgttctagattacagataccaactaaacacagcacggggagacgaaacatcgtggcgtcgtggattccagttaacaacgagcgacaacgccattccatagtctatacacatcaagggtacaggagttgatgatctgtcaggatcctaggtatgcagaaaggaagcatccattgactgcagaatactggccgtatcgaacctgaagcttctgaagcttttgccagggcggttgtcgacgtgctgcgtgccagatcctgctctactaataacaggattctgcatgtcggatcctgctctagtaataacagggttctcaacaggcacaaagacacccgagggattcttcgctttccacacagtacctctagcagatgtatctggcttctgatatacttgggaccgatgtgtgcctatccatgatttcagacccgtcaaaaatggtgcaaccatataaagcttcatcccattcactccacgagatattgcatcatcactagcaggtagaagatcatcaattctgtgccatg

SEQ ID NO: 56050 - DNA, 601 bp, Triticum aestivum
  Clone ID: PAT_TA_56050
ttttcgccacagcgcttttaattaaagatcccgcttcagccgaaagccaaaagaacttgttcatatgcgcaaaaatgagaacgcaacaaaacaggaactccacctgtaccagcctccacacatgatctctacacacctaaacctccaaccccgcatatccatcacaagcctcgatcaacgccttcttcgtccccggctccgtcgcactatgccccgcatcccgcacccaaaccaacttcgtctcaggccacgccttgtgcaagtcccacgccgtcacaggcggacacacgacatcaaacctaccctgcacaatcgtacacggcacatgtctaatcctctcgatattctccgcccgcagtaactgcccttcctccaaccacgcgcgattcttgaaataatgcgcctccatgcgcgcgtgcggcagaaggtacaccggatcagtgagtttctccaaatccgcgggatccaagcgcagcgtcgacatgttgatttcgtatttattccaggcggtggccgcggggtgcgagacagccggatcatccgacatgaggcggtcatggtacgcattcatgtgatccgcgcgctcgttttccggcaggaa

SEQ ID NO: 56051 - DNA, 594 bp, Triticum aestivum
  Clone ID: PAT_TA_56051
ttttcatagaataagtatcgtattatataccagcctgtttagactcgattatcagtgccttctaatacactcgaaggtggcattcgatgcaggcaacctttcactcatactcatccgtatatacagttttctctccactgacaccatctaggcaagtcatttaccacgaatcctggcttctcgacgctctcctgaacctccttgcgccctcgccaccagcctggccttcaccgccagctttcccctcgccaccagctttaccttcgccgccagccttgccttcacctcctgcttggccttcaccacctactttgccggtactacctgggacaagtccagcattcgcattaccgccgccgttcgcgttgcctgcattggcaccattaccggtgttcgctccagcattggcatcattaccggcattgtcaccagcgttcgcgttgccagcattagcaccagcattcgcgttaccggcattggcaccagcgttcgcgttgccagcattagcaccagcattcgcgttaccggcattggcaccagcatttgcgttgccagcattagcaccagcattcgtgttaccggcattggcaccag

SEQ ID NO: 56052 - DNA, 488 bp, Triticum aestivum
  unsure (1)..(488): unsure at all n locations
  Clone ID: PAT_TA_56052
gggggggggggggcataaaaacctgcttgagttactgtgtgagtgtttcttacatgtgccaatggggggggtgctaagcagaaacaaaattacccttcaaatacttccatgcccaacccccccccttanttccttctccaaagggggggggggggggggccaatcaacccanccttcacccttacactccacatgatcccatactttccactgcttacaagccctctcatgaacgggcaaaaccacagcaccatccagccacatcacactaactctccgactccctggccaccataaaccccccccaccgtgccgacaactgcgccccatgcctctactgcgagggcgacaatnttcatcattgagagcgccttcacctggatgaaaacgggcgcctagtccaaggtgaacatcccantatcgaggctcctcngggccctcgccaccatcggaggacgtgctactctccttgcgggggacctcaaaca

SEQ ID NO: 56053 - DNA, 374 bp, Triticum aestivum
  unsure (1)..(374): unsure at all n locations
  Clone ID: PAT_TA_56053
gggggccacccccaatcactacaggggtgtattcacgggggagattcccggtagcggaacaacaagcaacaccaactttttcttctagaaaaaaaacacaccgaccaagagggggggggggggggtacatatttnttnntcacacacacacccctaagcaccataacccttctcatctcntcccagcttttatttaattttaagcggggcatatcatatgccggcgtgaaccgagcagtacttcttgcaggggccaccccaggtgccctccacggtggggtttatatccccgcagcgccacatttcgggggtcgtggacaccacccgggacccctagcagcccttgggacacttggggtgggcgtcctcccaaa

SEQ ID NO: 56054 - DNA, 578 bp, Triticum aestivum
  unsure (1)..(578): unsure at all n locations
  Clone ID: PAT_TA_56054
ggggggggggggggtaacaaaaaggaggagttgggatccattttcaatctacaagtgccacatgtgacatttatatacaattcccagaggggcttgcgacgtgacagaaaataactgtgcagcgctanaaccctgtatatacaaanaggggggggggggggnggattttttctncaaatataacatcataatctcacccgaacgaaaaggtcttcaacccgtttnacacctcctggggaaaaagggggggagggggggagtaatgcggacttccatgcgaaataatcttatcattccaatctcgtgaaatgaggagcccatgagaaaaggtangtcttgaggggcctctgctgtggcccgctcaactgagcactgcgnagatgactcctcaaattagctatntgcctatgggtaccctnctgggtnaatggggaaagcgagaanagtngattcantgggaacgcanttgcttcctgcgatataaatgtgagtgggaggagtgcgtttnagtatagcgctattgagctgctttnggatcccaaaagtgtccttctagcaccacttttcccatatactaa

SEQ ID NO: 56055 - DNA, 553 bp, Triticum aestivum
  Clone ID: PAT_TA_56055
atactgaacctatccaaacaacccaaaaggttcatttattaattgtcaagaacaaatgacaagacatacagcttgcaaaaaatcaccagtataatataagtgttatagggaatatctttttaagacgccgacagtcatttcctatgcaaagtctaccactaggctgttgcatatacacataaactcatgttgtgtatttggaacctaattacgggtgcggaacatcttgcccaaaacatggattccggtaacgacggtaataaaccctatgctcatgatcagaacataatttggggacatattgcgcccatgagtctcatcagagtactaactgaagcattgaactggcgccatctccatctagcagaagaggagagcaccactggtggttctacgtttgcgcaagcttgcagttgcagatgcactccttcttgcaggtgcattggcattagccaccatattcttttatactacctgatgaactcgagctcattgatcctcctctgctcttgtgcgcctggctaccaaatccaaagctgttgcgtgaaatatt

SEQ ID NO: 56056 - DNA, 559 bp, Triticum aestivum
  Clone ID: PAT_TA_56056
gcgattagaaaccatggattcagaagaacagaggaagcaagacgcttcctcttcgttcacggttacacggcggggcaaagcaaaggacaagcttgagcacactctggaacacaccacagctaacttaacacagagacactaggcacacgggggctgacggagcaccgtccgttgagttcccccagcacaggcgctcggaaccagatctaggccttggtggccttcttgggggacttggtggtcttcttgggcgacttgggggcggcgccggccttctcggccttctcggcggtcttcttggggagcagcaccgggttgatgttggggatcacgccgccgtgggcgatggtgacgccgctcagcagcctcccgagctcctggtcgttgcggatggcgagcaggaggtgcctcggcacgacccgggtcttcttgttgtccttggcggcgttgccggccagctccagcacctcggctgcgaggtactcgaggacggcggcgaggtagacgggggcgccggagccgacgcgctgggcgtagcggcccttcttgaggtagcgcc

SEQ ID NO: 56057 - DNA, 554 bp, Triticum aestivum
  Clone ID: PAT_TA_56057
ggggggaaacaataatacattctgattgaaacaatacactaaacgtgctcaacacaacaatcgcactgagtgactgttcaactaccaacattaacaacctctacaagcccacaatctcccacagaccatggcactctggggggggggggggggcgccctacctttatatcctacatcctttcctgttaagacaaagaacttctcacccatgagcaacgcggacctacacctttttcatcccacattgcctgggcagagggacaacccacctaccttgaggcccttacactcctttaacattcaggcgctattttatgactccctgctttactatggactatccctaccagggagccatggagcacgtgcctatggagtgccaactaatttctacgcggggcttagaccatctaataacgagctagatatcctacttggggtactgaacgtgcaattgaatctcctgctctgtcgagttcaaccatctgggctcaggcgccttgcccttcttcaacgggatcatccagctaccatgctgaatgcccgacatgaca

SEQ ID NO: 56058 - DNA, 495 bp, Triticum aestivum
  unsure (1)..(495): unsure at all n locations
  Clone ID: PAT_TA_56058
gggggggggtgaaataaaaacaccaatagcgtaaacttnaccataatatcaggcgggttgggggacaatgtgtttaaggaaaattgcccgggacgagtcagggacatactccaactcacccttatataaaggttggggggggggacctacaaccttngagtcatcctcacaaaaacatggggaaaatccaccttacataatattggcttcacggtaaaaataaaagttaccaatctnaagggaggatggaacaaactctctttgtcgggtcatttcgtcccctctaggcgccggctgagccgtacttcttgccgaaaaaaaggatctggagctgatcgtagccggagagcacaccancaccagcaatggcacggaggatgttggcaccatcccccttgaagagggacttgggaccctccttcttcaggatctgctggaaagcatccaaggagctcttgtacttgacagcctctccggagggatcatcatccttct

SEQ ID NO: 56059 - DNA, 228 bp, Triticum aestivum
  Clone ID: PAT_TA_56059
ctctactcccacacctcatggagcagacggcggaacgtgctcgtcatgcatgtgaagcagactggctacaggaggggcggctactacatatgctgctagagccggtgggggttgcgctgtacggcgactgtgacatgctaatgggcgtgtagtgaggacaacgcgacattgactgcacgctgcgttcatggagcgctaagctggagaacatgaggcgctgggggaact

SEQ ID NO: 56060 - DNA, 383 bp, Triticum aestivum
  Clone ID: PAT_TA_56060
ggagtgcggcgaggtgatggcggcagtctgcggcgtggtcggcgtcggcgtcggcgtcggaccggcggcgagcgctgacacgccggtgacggtcctcgggcacggccactaccgcagcgccagctcggagagcgaccggaccgtcggatcggcggccaacgtcgccgatgccaagaagcgatgcatgggcccaccttcccagtgggggtaggcggcgtgcggtgcggcaggaccccatggggcgcgacagctggaagagccgggaatttactcttgccctgttgttcttctttccttttttccttttatttcgatttcttttccattttaatcttctcgactcgaggtgaagtaagcagcgatgcagattcgagagaacaaaa

SEQ ID NO: 56061 - DNA, 609 bp, Triticum aestivum
  unsure (1)..(609): unsure at all n locations
  Clone ID: PAT_TA_56061
accatatcgtacaccaatatcctcctctccaaggtgccatcccgtgctgctatcatcactgccactccgtgacggaccagtgagtgtgagcagctagctagctccgtgagatgcaaccagctgcggcgccggcaatgccgtccatcctgctgctgctcgccctgctcgcggccacggccgtgggcgccggagctgggaggacgcccacgctggtgttcatcctggcggggcagtccaacatgggcggccggggcggggcgacgctcaacaaccgctgggacggcgtggtgccgcgggagtgcgccccgtccccgcgcacgctccgcctctcgccggccctgcgctgggaggaggcccgcgagccgttgcactccggcatcgacgtgggcaacgtgctgggcgtcggcccgggcatgccgttcgcgcatgcgctgctgcgcgccccggcgtgccccaagggcgccgtcgtgggcctcgtcccctgcgcgcagggcggcacccccatcgccaactggtcccgcggctccgacctctacgaccggatgctcacccgcgcccgcgccgncgtngcgcagacgaatggcaaagggaagaatcgcggccatgctc

SEQ ID NO: 56062 - DNA, 558 bp, Triticum aestivum
  unsure (1)..(558): unsure at all n locations
  Clone ID: PAT_TA_56062
ggcagacgccctcatacatcaanaccggtctcttcttattgacattctcctgaatcagagcatgttccagctgtacttagctcatatcatacacaggaaggaggcaacgacagacatgggtacccaccctgcggccagggggagataccctacggcagggaacccgccgacacacgcaggctacccggcggagcagggaaggataatctgcacagcatggataacccggctgcgacctgtgaactaacccacctcgcatcctgggtgcataccactgctaaacctgagggcttaccctggctgtacctgtgatcggccaggcacatgattggcgtaaaaggtggctaccttatacaacatcagtgctacctcgaaatccggaatctcatggagggggagccatggtataccacgactaatgaatgatgggatacctagtctggtggctataagactacacctacacaacacgtatacccctgctcaccatggctacaccgcatcagaagatagattaccatgcacaacatcatggctatgcatatggcgtctaccctg

SEQ ID NO: 56063 - DNA, 629 bp, Triticum aestivum
  unsure (1)..(629): unsure at all n locations
  Clone ID: PAT_TA_56063
gttgtagctgatttttattttatatgttgtgtaatcgcctcacaagattagaaggcaatcccatatgctcaaaactcaaagaacatactgctcaaataagaagaacacgatgcatattatgctaaccgcagtgatagttcctgtggtagtggtatccctcctagtagtgatgtgcatactctggaagttatgctggaaaggtaaacaaaattctatgctctaaaatttctttcatcatgcaaggtggtaaacaactagacattatagagcaggttcttacctaaacttccatgngaaaacaaaactttgactctgcagcgaaatcaggagaccatgaggattatgctatgtatgaagaggaaactccactacatattgatatcaggcggttcacatacgcagagctgaagctaataacaagtgacttccaatcaatcattggaaaaggaggtttcggtatagtttatcatggcacactagaaaatggtgatgaagtagctgtgaaggtgcttatggagacatcaatagcagaggcaacagacttcctccctgaggtgcaaaccttgtccaaagtttatcacaagaaccttgtgactttacagggatattgccagaccaagaagtgccta

SEQ ID NO: 56064 - DNA, 616 bp, Triticum aestivum
  unsure (1)..(616): unsure at all n locations
  Clone ID: PAT_TA_56064
gctccctagctaacacagtcccccgtacgtagcagcagcaggatagcttggtccagtacgtcgtctcgggtgagccagagagcagatcgatggcgctctctcgtcgcatggcggcatccgccctcctgctgctagtcctcctcgtcgccacggagatgggggcggcgaggaccaaggtggcggaggcgcgggactgcctgtcgcagagcttcaagttcaagggcgcgtgcctcagcagcagcaactgcgccgccgtctgccgcaccgaggacttccccgacggcgagtgccacgcgcagcactgggaccgcaagtgcttctgcaagaggccctgctagtccgcccgctcgccccggcctgccgtccagagccgagacgtccgatgcatgatcgcccatgccgttagcttatgtctgttctgttcacgttcgtcggtcgtagttcttaactagatcatccgtgccattaacttgttatatgttatgttatgttcgtcgatgtgtccctcttagcataaagtagaaaccaatcggtttcgtgtttgtgtcagatttgtgtgtggtgatgttacagatatggtcattgtttgngcatggatggacatgtgtaatgcaaa

SEQ ID NO: 56065 - DNA, 557 bp, Triticum aestivum
  Clone ID: PAT_TA_56065
cccacgccgtccggaacgccccacgcgtgtctgtctccgccccttcctccatccgtatggcgaggaagaagctcctccacggagaggacgagcaagcgaactcggatccgcgccctggcccaggcacaatgaatgctcattcgaatctagccgcgggcgccgcaggatcgccgtgaaaccctatgcaggaaggcggacaagggtggcgccaacgcgagcctcggctgcccatgccctagccggccgggctgcccgcctcctttgttgccgccggtcgccttggggctcgatgtcggggacggatcccgctgtgcgcacgacgaggaggctcaactgccggccgcaatctgtgccgacggacacgcctgaccctctggcggaggaggctatctacgaggatgatgaccacggctctgctgaatctcaggactacattattgatgatgatgaagactgtgcagatagcccgagtgacagttgcacgcagtatcatgaacgggaaccgatcttgtcgccatgtgatcaacatagatgatgatgatgaccaggaggaggaa

SEQ ID NO: 56066 - DNA, 260 bp, Triticum aestivum
  Clone ID: PAT_TA_56066
cgcgggcttccactccttcacccaccaaccacactcctctcgtctcctctcctccgggaggtccacgcccgcccacaatccccgtccccggtctcccgtacgaccacctcccgcatccaccgccatggtgatggccacccgcaacgccctctgcgatatcggccccgcctcctagttacacctccgtctccagacgcagtccttcctacaactaacccgacctccgcttctatcgatgattcaagcttacacctcccctc

SEQ ID NO: 56067 - DNA, 455 bp, Triticum aestivum
  Clone ID: PAT_TA_56067
gccaaccccatccgtcggcctccttgcggcttttggtgcgcatttaggaggtgcttgcttacctgcacgatgaagctggtcggtggctacctcctgggctagatgggtgggaactctaacgcaagcgcgggtgacgtcaacaacattctggactcagatgaggccgaggctgatgaaaaaaagattgagtaaggtgtggctgaactcaacagcagggacatgacaaaagagagtgcatttggaacggaaaagattggcgatgggccttcaggcggtggagccattggtgaggatagctacaacgtgctgtatatggtgcagccgacgcacctgttgctgatttaaagaaagaggatacaggtgtaaacaagaagaactactaatacagcattcattgtgaggctaaccttagttctacactatctctgtaccctagaatgtaggctgtgactgct

SEQ ID NO: 56068 - DNA, 657 bp, Triticum aestivum
  unsure (1)..(657): unsure at all n locations
  Clone ID: PAT_TA_56068
aaaaaaaggagggcgnaaatccccactctctgtcacgatccccgccgctgcctctcatcctcgccgccacgccgccgatgcccgacgccgatgaggtggagggcgcccgaaagctggcgcgcggggccttcgcgaagctctctcagtacgagcccgcagcgtcctcctcgccgccctccgctcccacggctcaccttcctcagctcctcagctgctgcttccagttgctgcgtcgcctggaccacgccgaccccggcctggctgccagatgcgtcagcctcctccgtgccttcatccacagcatcccctcccgtgaccccgacgcctccttggcccccgccctcgaggtgtgccttcagaattttgtggatataagccaactgaggaattgcaccatgctcaattatgccatacaggaagtgccaaaggaccctaccatggcaatatcattccagtatgagctccgtgtccagctggagctcatgtcccaccatttcatttcatcggtgcaagatgaggcggaatttgagcacttctttagtgcactctcttggtctgagaaggcgacgcagcgcactccagaacttggcttggctggagctatctncctagtccgaaagactactggttttctatgcctgttattgcacaagctca

SEQ ID NO: 56069 - DNA, 270 bp, Triticum aestivum
  unsure (1)..(270): unsure at all n locations
  Clone ID: PAT_TA_56069
gggcggcagccgggcgcggggcgcngagcgacgcggaccggcgcgggcgctccacacgggcgagcgcgacgcagtgactgcatccaacggcgcgggcggacgcagcgcggtggccacgccctgcggcgcagtggccgttctgtcccgtgaaggagcagccaaggcgcatggttggggcaccgctagggatgttgacgaaaaacagcagcagttgccgctcgatccggtgcaagaggaattgaagaacgcatggtacctttttcctttttg

SEQ ID NO: 56070 - DNA, 498 bp, Triticum aestivum
  unsure (1)..(498): unsure at all n locations
  Clone ID: PAT_TA_56070
ttttgccaaacattccaatcaatatatcatatttatctacagatacaggaacttctgctcccaatcttccccaacccaaatagctatctacaagttacctagtacagctacagttacaggatctgcttatagctatgttgaacactccatgtctcttatctagtatgcaattatctaatgtacaaaatttcagctgtatcatgctacatggttttatagtagcagaaggcagcatgaagaatttccagatggtgctcaagatctctcttggaagttcactgagcgcgacagtgcagctgggttccccttcaagaatggcaggctattgttacctctgtggcttgacatctttgcctcatcctttggatcaaaaacccttgcaagcttacaccctttgccatcatccttctccaccttgtcacccttgatcccaataagtgaccagatagaactcctggctacctcatctacgtcatcgatccggatcgtnttgggcac

SEQ ID NO: 56071 - DNA, 472 bp, Triticum aestivum
  unsure (1)..(472): unsure at all n locations
  Clone ID: PAT_TA_56071
gcatgcacgcctacctaagtcgtggacctctagacggccgcgctggggggggggggggccttgactaaattgaggaccaaacttgaatctcaaaatccgtggcggggccacataatctgagacaggggaagacgatagaaatagcgcgtggcaaattcaaccacacaaagggaggagccaactaatacatgggggagtnggtncgcgcggtttcttgcgacacatgagaagagtcactgagtgtgtcttgggggggtatgaaacaaaataacaggttatggggcgttgagaggtacaggctcatagctcantcgcgcgcccgaatggggtggangggcgtggcaatctcctctgggctgagcgagccggagacacgggcttctttcctcacaacaccgacctccagtctgggggcgttgagatcttcctgcggaacagagtgcgatgcggaaactggaatctgagacaggtc

SEQ ID NO: 56072 - DNA, 514 bp, Triticum aestivum
  Clone ID: PAT_TA_56072
tttttagcatatagcaacaatcgactacattgcatgggtggtaggacacaatataccaaaattaccctgacatgtaacagactgggcctgggacacgacattataaagctaactccttaaatccaaacgtaggggattggccaaagcatcaactgatgcaaccacaccggtaagggttttatgcgataaggaagagggatgggagatccatcatgaattccaaggcgcgcgggcacgccgtgcttgtcgctagactactttcgcccaagcttgtgctgcaggctaagctcctatttaattcacttaaaggaacactttgtgaaaaatggacgaaaagtacagggtttgagacattgagaaatccatcatctgacaaagaattgctttagctccggatggaagccgcacacccaaaccttttaacagagcagatgcttcaaataccaaggatatcttgaacatgcggagctttaattgcctaggcgcaaccttctgacttgcgataagctgatgc

SEQ ID NO: 56073 - DNA, 586 bp, Triticum aestivum
  Clone ID: PAT_TA_56073
tttttcctgttccaactcttcccaaatcctaatctccgaactcatttcaatcagttgccacacttggcagtctaaaactcagataatgaacagagcctatcaagatcccggtttctatggccgacaaaaggaaaattatggatctttccaaaaaaaaaagacaaaaggagaaattatgcctgtgggattccggcatatggaacgctccgagtttgctctcagatggtcgcctggccactgtaagacggagaagacatgatggtcagcagctccgtcacatgtgccatggagctcagtgcagctttcagcacatcctgcgagcacccaggcttcacgatgttcttcaccttctccagatactcctgcagctgtttgatcctccccatgtagtcccggtcttccacgcacagcgagatgggctttaagtcggcacccggtccttggaattgcagcggtccagggttcttgtagatgtcttccatcaggaggctggaagagttttgcctcagcagctcgtatgcttttccttttaagtcgacgcttgctatgtggacagcgggcttcccaatttgactggcagtgggac

SEQ ID NO: 56074 - DNA, 605 bp, Triticum aestivum
  Clone ID: PAT_TA_56074
ttttgcaggatttctctccatcctcttgcccgtgccaagaaatcaaaccacacaattaataataaccaataataatggaactacaggactcacgtctcagctaaccatcatttctcccgagcacaaaggaagctcttcagtacagttgaagaaaccactctcagcctacaaagactacacccatccattcacgtaccgctccctaacctcccccactccctaatactaccgcagcaggatgaagccatgatgcgtccctggtcaccggtttcttatttttcatattcgagagactccaccagtacatagacaggcttcccgttgagcttgtaacaatccttaaatttagggagcccaatgagacaagcacactcaacgacatcagctccagcacgttctggaaatcaaacagctcggtaagaaaaagtattcaaaaaacacctatctactttttaccagtgcaagataaaattcatctagaaaggtatccaaaaggcagtatagcgttctagaaacaaggttgtgcaaaatactactccctctgtttgtttttataagacgtttcagacagcttgctttctactgttttaaacagtgtctgaatg

SEQ ID NO: 56075 - DNA, 332 bp, Triticum aestivum
  unsure (1)..(332): unsure at all n locations
  Clone ID: PAT_TA_56075
gggtttaccaaataggggtactcaatatctttttatattaacaaaacatgcccancaatcgcttgggtgcgatgcggggcttaggtgcaaaggataaaacatcanatattagggggggggggggggganntntaaanncanctcccctcctcactcctcccccttnnatccaaattcttnncantctnntccntccatcctncccntacanncaaantaccttnctntncccctttacctcctcctatncancaaaaaatnntnnntntntatnnaaaatnttctaaccntanaannaaccattcttcatcncatcctnnttancatcaccc

SEQ ID NO: 56076 - DNA, 572 bp, Triticum aestivum
  Clone ID: PAT_TA_56076
gggtctccctgttgggccatcgtttttgtcggcgcagacacaaacgtacatagtcgggcgtggcccggttggagttgctcttactggctacaactacaagtttctatctgcgaaaatacatccggcttgccgaaatcgcataggagatacatgctgccacttacgacgtacgtgtactcccacctaaattgctagactgactttacctgccacatcttgcgggcggagagtagggcgagacagtgacccataagcagcatccttgtgcttttagtacactggggacgtcgaaagacaccctaggcatgacggtaagaaggctgtaggcacaatgacgagagcccttccatcagtcagtacctgaagccgctgtcagcaccatatttgcttctcatgttgtagtgatcatacttcggatcgctgtagtctgccgctttcatctttgagggcttaggctctggatgcccagtcccataggtaacctacccactcttcttccgatgacggtggcggagccggtcttttgggacctttgcgcttgcttgaggtgtctcggttgaaccgtagaactc

SEQ ID NO: 56077 - DNA, 523 bp, Triticum aestivum
  unsure (1)..(523): unsure at all n locations
  Clone ID: PAT_TA_56077
ggggggggggtttttttttttttttttttggggtttttttttttttttttttttttgggggcaataatggggtaatcaattgcaacctttgggaattgggagcctgacataatacatgggatactgccccttctgctacaaacggggggaagcatggggaaacctttatcaaccacttaatctgtcacccaccacaactaatcatcaccaatctcttgagcggggcaatgagactactactagtgtggggtaataataggccaactaaacaggccaggggcttatcaagaatcaggcaggcgcaccccctaaccactggattatcaatcaagggagcgtggggacctaagcgtcggggaacattttcccaagcccgaccttcccccgggtggggaggtgcgtaaaatccttggcgaccgggaggcccatggcgtccacttaccttaagttcggggcccccaccgcccgctgngcctttcgaaccaaatccacaaacttgccctgccccctcgcgatcccaacc

SEQ ID NO: 56078 - DNA, 479 bp, Triticum aestivum
  Clone ID: PAT_TA_56078
cccaacaaccaaatggcacgctctcatttatgaggagtatctctctacacccgcacactggcgagccgaatcatatacatggagaagggtgtgcacctccacggggacaacctgtgtccatcagcatcctgcgtgagaacttctgaaaggccgatcctagggaaacccctaactgatgccctacgcaaaaaggcaacggaaaggggacatacatgccagccccacgggcaatccactatatcccgcgcgcattacttgcacccaatggacttaccgacgcccacaaagatggagggttccctatgctttatcccacacgaactacgagtgggcgtgcttgcccggcgctaaaagacactccagaaggtcgcacccgaagtccaactcttcattgccgcccaagatgctttccatcataaagacaccgacaacgtgcgttgcgtccgacatctacaggagctccccatgcggcggaaacc

SEQ ID NO: 56079 - DNA, 457 bp, Triticum aestivum
  Clone ID: PAT_TA_56079
gatggggccgagcccatatataaacttttcttttgcctcactggaatgccccccgggggggcggggaacccggttttacaaagcctatttatttatttatttatttattacggggcaacatcaactatttgggggatcccccaaaggagaaagaaccccccccgttgttgctgggcgtaggccacaaacatgcatgtacaaccccaacgggtctgcgcatttaatcggagccttttttattttatacggactactactttccggccccacatcgatcccactgggggaagagggggaaccaacaattctttttgccccgcggcggccagggaatgtatgggtaggcggagcccccatctccaccccggaatgtcttcacggggcgggtctgccccaccccgcaattgacccaaccctcgcggcacttggggcccacctcttcccaaaactgggcccc

SEQ ID NO: 56080 - DNA, 468 bp, Triticum aestivum
  unsure (1)..(468): unsure at all n locations
  Clone ID: PAT_TA_56080
acccaactaatcccattaaattaaaaattttttttttttaacattcaccccccttttggttttgtttggggggtttttttcccattttccccnntcaccattttaaaaaaaaaccttatttaaacctttaccccaccccccttttaaaacatttcccaaatttcattaaaaaaccntaacccttttacaaaaaaatttcaaatccccacttaaactttttaaagtgttggacactttccaataatttttttacttactggtataaaaaaaccgtttttaacaaaattcccctttttttaaatccctacggggaacggcaagcccaattttatgccggaccttgggttcaccccgaaatttcgaaccctgtcctggaagggttccaatttttcttttaatgagtgcttttaaaaattggggtaaaaataaacataacttttttctttgtaaaaattttatcccctaaaa

SEQ ID NO: 56081 - DNA, 555 bp, Triticum aestivum
  Clone ID: PAT_TA_56081
tttttgctgggaagttactgaatttcgttacaaaactgaaatgatacaagtactgaattccgatttgcgagacagtcaatgacgatgcagtaaagcaaattaccaaacattatctaagcaagtatataaaacaataacacagtaggcgtttccctttcaacgtccagaaaagaggctcatttgtgacatcccattggtatagccagactggaaagagctcccctcgttacgtgctcctgaaatcatcagctggaattgccttggaatttcactatccatggagtacgtacgtcgaggggtcccagaagccgctggcaaccacactttaagccttcaagcaacctcggtcatggtcggcctgtcgatggctgcattccccacgcagttcatggcaaggtccactacactctgcagggaaccggcatcgtacagatccagcagtttcttgtctacaacgtcgtgaatgctgtcgttagctatcttttgccgcacccaatttggtaggtggacagtttgagggtccataaatactgggggttggccggtgatgttctc

SEQ ID NO: 56082 - DNA, 512 bp, Triticum aestivum
  Clone ID: PAT_TA_56082
aaaaccttcttttttttatctttaggtttatctacttaaaaaaaggatctaccgggtgggacgggaatttgaacgccttccaaacttaaaaaggggggggtgggtaagggctccatttgcaaggggggcgggtaaattaaataccttcgggaggaaaaacgggccctttgttacgaggttggacacagggttttaaagccactcgattaggggggggaccaggggcatttccccaaggggggcccaaaggtcccccaccaaaatggaaaaaaaaaacgcccccaaaaatttcgggcaaaggtgggatatgccaaaaaagaaaaccacctgaagctaccgggaaaacacccgggagggaaacccaagcctgagggaaaaaaaaccggggagccccaactttttaaaaaaaaaatcgggcaataaaataacaaaacctaaagggatttgggggtccccttttaacttacctaccactggcccgggaggggtataaactcccccaaaaaacccaa

SEQ ID NO: 56083 - DNA, 519 bp, Triticum aestivum
  Clone ID: PAT_TA_56083
cgttgggggggcccattggaaaatttttcagaccattgttgccccccctaggataaacactggggggcacaagcaaaattcccgttccatgcgttgtccaaactaacaaaacaagattgcttgatacaaaacaaagcagctcgcacatttagaaactttttttcccaaaattccccttcttccaagcttttcttttggctttctggaccttaaagggaagctgacccttttttttgcaaaggggccccattggcttaaaaaaggatgtcaactttttgcttcctccataaacctccatggaaaagccccggttggcggcggcggaaacggcggcggcaaggaactcctctaaccccgggtgcacccgaacgggaagcttgggggcctcaagggcgggggcctgcccggcctgtttggcggcctcctttttgtcgaaaaagggctccccaatctccccccggaaaagtccgaacccctttttcccgcttggaagcgcaaaaacttcgccatctttttttt

SEQ ID NO: 56084 - DNA, 475 bp, Triticum aestivum
  unsure (1)..(475): unsure at all n locations
  Clone ID: PAT_TA_56084
gcgcgcggggggggggggggggagcccaaaaaattatcaagggacttactaacgctacggggcaaaaaacactccatgctaagcgctaaacatatccatggagccactcaaaattcactaactttatgtctctatatattatncacacgctggggggggggggggcacaccacacatactanggtaaacanaggggctggggggggagctgaatcgcttattcgaaccaactgagacccacttgtgaatacctattgttgcttgtgcaaaaccttccactccttgtcatgactcctcagcgaaggctggggcaccaccaggtgcaggagctggagcccccacagcaatgggaccctcaccggggggcgctttagctaactttttccttccacatgcaatcactagtgggatgtgcttgcctccgagcgtcaccagagagagactaatcttttcttcatgcaggctctcaccaact

SEQ ID NO: 56085 - DNA, 269 bp, Triticum aestivum
  Clone ID: PAT_TA_56085
aaaaaaggaaaagggcccatgcgtttttaaattccttttgccccggatcgagcggaaactgctgttgtttttcgggaacgggggggggggggccccaaccatgcccctggggtgctccttaacgggacaaaacggccactgcccccaaggggggggcccccgccctgcgtcccccccccccgttggatgcaatcactgggtccccctcccccgtggggagccccccccccggtcccggtcccgtccccccccccccccggttgcccccc

SEQ ID NO: 56086 - DNA, 581 bp, Triticum aestivum
  Clone ID: PAT_TA_56086
tccgaagcagcgcagacagacagagcttgagtgagcgcgcgcgagttggcagcctccatgatcaccttgccgattgtggcgccgacgagcctgccgtccctctcccgccggggctcctccttcgccgtcgtctgcagcggtggccagaagatcaaggtcgacaagcccctcggactcggaggcggtttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggcttagagagcatctacgtgtaacacagggccgggtctctgcttgcatgcacgtctctgtaatctacgtagctacctcctgtgaatgtttgtcatccacgatgcaaagtaattgattcgaacagatggtttatgtatgtacgtaacgcattttccaa

SEQ ID NO: 56087 - DNA, 655 bp, Triticum aestivum
  unsure (1)..(655): unsure at all n locations
  Clone ID: PAT_TA_56087
cccagcgtccgcntcttgatgatttgaaaagagattcccctgccagatctcgctggtgcagggccgctgttggcccatcctagaagccgggctctaacatgcgcgcctgctgagtccagcattgatgatgcgggggacgcggcagtgaccttacaaatcgagttgcacagcacttgtgatgcggttgccctgtccgcacccgcctccgagcaatctacaggcaaaaacgaccctcaagcccctggctgggccaaaagagtccgtgttggtcgtgcacctgacgaacgccctccatgtgctgcgaggatgagtgcattggaggtagcattatgaagatatgcagaaaacaaaactgaaactgtcatagctcctgttgtgggaagcaacttcgatagattgggagaagcttatgattactacaatctctactcgtgggagattgggtttggagtaagatatggtaaaagccggctaaattgaaaggacaaaatgcttgcaggaaatagtttgtggctgctctatgccccacgatgatacggttgcttcgaacatctgacattggctggtatataaacgagttcagagctgatcacaaccatgctctcaatgaaaaatgtgtcttcagttcatgggagggctgatggcgtatcgatcg

SEQ ID NO: 56088 - DNA, 193 bp, Triticum aestivum
  Clone ID: PAT_TA_56088
ggcgaccgaagtctccggatgctgctgggggacgcctctccgtggagcatcgccggcgccgcggcggccgtggcgctgctgtggttagccgcctggatcctggagtgggcgtggtggacgccccggcggctgggccgggctctgcgggcccagggcctccggggcacccggtaccgccttcttcaccggcgac

SEQ ID NO: 56089 - DNA, 627 bp, Triticum aestivum
  Clone ID: PAT_TA_56089
ccccggtggcaaagaggcgcccatcctctcgttccttgttggctctctcctggcggttcgcgctcttgctgagccatttgagaagctgttcagcaccccggaaggatggaagatgcaaggtcttgctaccaatgagcagatcgtcaagctccagattgctcttcagcaaggcgatgttgcaggtttcgagcaacatgtgattgacatctcaacgcctagccacccgagctatggtgctcactatggctcgcatgaggagatgaagaggatgatccagccaagcagcgagacagtcgcttctgtgtctgcatggctgaaggccgacggtatcaacgacgctgagattgacagcgactgggtcaccttcaagacgaccgttggcgttgccaacaagatgctcgacaccaagttcgcttggtacgtgagcgaagaggccaagccccgcaaggtccttcgcacactcgagtactctgtaccagatgatgctgcagaacacatcaacttgatccagcccactactcggattgctgcgatccgccaaaaccacgacgttgcgcacgagattgttggtcttcagttcgctgctcttgccaacaacaccgttaactgcgatgccaccatcactcc

SEQ ID NO: 56090 - DNA, 410 bp, Triticum aestivum
  Clone ID: PAT_TA_56090
gaccaccacttggcgactcctgtatttgcctcctggcctccgagccatatgggcaggcaggttatgtggttcgtggtcctgctatttccatgggctacctccggctgttcgccggcggggcagcatccattccttcaccccaagtggtctcgtgccctgaggtggggggatcgggccagaatcgaatacagataacaatactcgatggtttgtcatttttgttggagcggagtcctaaatctcaaaatgggctgtcctgggtgcgtaatgtcatctctgtctcgtctgggccttgctgtaataccacagaatgtctcatccagtataagcttccgtccatatgtgcccttcttgtgtccaaaactaatactataaaatagctccttgtcctaaaaaaaaaaaaagctggc

SEQ ID NO: 56091 - DNA, 611 bp, Triticum aestivum
  Clone ID: PAT_TA_56091
gccgctgcctctgtgagttcaagggcgagccgtaggcgcaggcgcgcgccgagaggctggacatcctgaggaccctccatgctgcgctcccaggaccaggccttcttgggacgagcgaaagtcggattcgttcactcccagcttagctccctaaagcggctgtctgcacaagctactagaggtacggtgagttaaggctgacgggaggggggcataagatccactccctgtcctaacgctgcgggtaacgataaagcggctgctaaagcctctactaagggggcaaggcattacgacacaccttgcgctgctaaagaacgaactcggtatgacatgagcacgccatctgacagacggaccgctcatgcaagaaacagtctgcccgccgtgcggggggtagacctcaaagctatcaagaagagagttgagtgcgccacaaagcgtacgtttagcatagcacaatgaccttctatctttttgttggcgatagagtgcttcatgagggcggggtggggggctgctactacaagcaggagcgggtgagccaactgtgctgtgctctgaacactgggctagaagtaggtcaagtgctaatcgcactgtatgctaaa

SEQ ID NO: 56092 - DNA, 680 bp, Triticum aestivum
  Clone ID: PAT_TA_56092
gtctttcacgcccaacaggtcaagtactatccctctctcaacgagcaccatgtcgagttcatcaccgctcagcctctcttcttcgtcgcaagtgctccttgggcaggggaccacatcaatgtctcccctaaggccatctgtctcgcacattttgcgtgctcgggcccaataccgtcgcttacctcgacgcgacaggcagtggctgtgaaaccatttcgcacgtctacgagaacggtcgtgtcaccctcatgttttgctcctttgggccctcaccacaaataatgaggctgttctgtaagggtcgagttgttgagaagttcgaccatcactaccaggagctgagagctaagatggcaaccgagaacggcgatgatatcgacatgattggtgctagggccatcatcgtgctgaagattcagaaggtgcagacgagctgtggattcggggtgccaatcatgggcacgacagccgcaactccaatcgaagccacaggagatgcagtaaccatggtcgagcacgatgaagacacagcggccaacgatggatggaagccgcgcgagaccatggagaaatgggctcgaaagatgctcgagaaacaagagctcatggattaccaaaagagatcgaaccaccagtcacttgatggcttgccaggcatgctgagtgctcggcgtgcactt

SEQ ID NO: 56093 - DNA, 271 bp, Triticum aestivum
  Clone ID: PAT_TA_56093
gtggcttgagcctgggctacttgtttggcggtaaatgatctctgttcttgatgctgatatgaattggcctgtatctttgttatgcatgtggggaaaactggtaagtgtttcgattcagcagtgtaccacctgctgcgatgtactttgtctgaatgggtcattgtgtccaggctgacctactgcttgaaagccatcttgcctaaaacctgtaggtttcaaactaatcgtattaatataaaaaggtggtgtgtttaattcattgcttgccttc

SEQ ID NO: 56094 - DNA, 552 bp, Triticum aestivum
  Clone ID: PAT_TA_56094
ctctccgccttgtgcaaccgaggcactggtgattgaggatgtcacgcagcaggaccgactctgcgcattagggcacttcttattccgctggcaaaagggccagtagatgaaccatcttaatcggggccaaagtcaaaggctcgccgcgagaaacagcggatggctgaactgaatgacaggtgtgttgacatcatgtgcccatatgcatacctgccgatcacagactcctagaagaacaggggggtagcagtcgtgcataagaacgctcagtagcataaaccacgtgtctagtagcgatgcatcacgtatgttcacacaagtcatatgcagaccaatgcgctgactgaatcaaatactaatcttcgatagacaatctaaggccttaaggtgcagaaaaaggatctactaaatgagaaggagatcctgccggcagataaggaacggctggaacacacagctcaaagcatcaagtgctgctactacaagatgagcccctcatatgccttattcagctgcataccaccccgatgcctaccctacgttagcaccacc

SEQ ID NO: 56095 - DNA, 603 bp, Triticum aestivum
  Clone ID: PAT_TA_56095
ggcggcggcgcaccacctgtcgccggtcgagggatggtaccgtctgttctacgacgaggaaccccaactcgtgcagcgggatgtgatcgatggctgctccggccaccggctgtaaaagatagtctgaggcggcctaatattcgcattgcaatagagacctttctgacttgtaggtagaggacagaggattgtaactcttttagatagggaggataaagctctccttgaccaatcctaaccttctttctacgacttcctattaaatgtcttatcatattattgctactattactgtgataaatagatcatgtaattggaatgagagaacctttacatgaattagtatgataaatgagatcttgcaccctactatgaaaaaaataaaaaaagtgagtcgttgtcagagattctaactgacgaacgcaaggatactactgactacctattctctagtgaaacttatacacaatctactgcgcctgtgcaaacatcgatttgactggataaaaccctgcagtcacccaacttaatcaccttgaagtcaataaccatttcgccagctaatagttacaactaaaaggatcgaaccatatgtacttgcta

SEQ ID NO: 56096 - DNA, 461 bp, Triticum aestivum
  Clone ID: PAT_TA_56096
gggaacccggggaacccaaaggggggttaacaaacccaagccccaaatttgggtcctccaaaaaaaaaacaaggaaacagggggcccacgggccccctcgggttctgggttaaaaggcccaactcttcccccaaaccgggggtaaaattttaaacaacccctccacccaaaaggaggtgggccccccagggggggtacacaaggttgggccggcacaaaaaaaacccgggggatgggcacagggaaaaatcccccaaccccagggcaaaaaaaaaaaaataccctggggaggggctggcaaacagctaccttggggggttcaggggcgggaacaaaaaaacttccttgaggttcggggaaactggcaacatcattggagggggaaaaattcccaaaccccaaccaccggggggggggagcccaaacccgaggggagggcaaaatggttcgcccaaagccaa

SEQ ID NO: 56097 - DNA, 596 bp, Triticum aestivum
  unsure (1)..(596): unsure at all n locations
  Clone ID: PAT_TA_56097
gaggcaccaaattgcacaattttaacccaacttaacattaaactacatctgcacaacagttttcccaaccacagcttctgtctctagacccacgattcactcacgtaggacgccattcggaacatggaagctcgatatgaatttggtaaggggaaatatcagggatttacaaagtggtcaaaaacaacaaaatcttgttctgctggagagctcttcgtcctaggaatctcttcctctctgttgagatcgagtaggtacaggtcataaaatggtctcgtgaaaattggccgtgtgcggttccggcgtggaaaccctgatgatcagctcaccctgtttgtgcacatcaaaattgcctctttcaacccttctttgtctaacgacgtctccaccatcacctcttgcacattgtttccataccgcgcaaggacattatacttttggccaaccaaagatgccatatatacctnggaatgttggagctaatcctgggctccggaagaaccttcctttataaacatctttaacttgctctatgtttttcagctcctcaataaggaatccacctcaggccactcaaaatctgcttgtgcaggttc

SEQ ID NO: 56098 - DNA, 591 bp, Triticum aestivum
  Clone ID: PAT_TA_56098
ttttagaagtgcacaagatgatctgccgcctaggtcaacattgattgttcccgtgtactatatttatatacaaggatttagaagtgcacaagatgatctgccgcctaggtcaacattgattagcttcacgccctgtaccggctaggcaccgcagccttaagaagcttggggaagttcggcgttccaagaccagtcactggatcccacccagcagtcgcgttccatcccgcatatgggattactgggctgccatttggcggcccgttaaagcgagcatgaccatcgcatcccttgcttccaccgagaacaatgtcatttagcgcgtctgagttagagtaaagcagtgggtttaggaatcccaaggtaggcttcttcgccttcaatcgcgcgtcgttgaggagaccaatcacaccggcgaatgcaggcgcggaggcagaagtaccttggagacccttgagcttgccctggtcgtagacgcggaagccatatccctgggttgcaacgtctgggaatcacggccgtggcggttgaagtatggcttgaatttctaccgtagtggtggaaatacgccttaacagcatcgtcctggta

SEQ ID NO: 56099 - DNA, 508 bp, Triticum aestivum
  Clone ID: PAT_TA_56099
ttttgataccaatttttcatgctttaatacatgatttttgtaacacaataagggatccctaaggacccaatactactgctagatcaacctgcattatattgactaaaagcccccacaaaagaaagaaaaacaacaacccatgccgaacctttaggggattggaccgccaacaacatatatagtgtgccattgcaccccttttcgccagaataactttctggaccgatccgaccaccttcggcgtcaaatccacatttgagagaatgatatgtcttttacacaggccagaaataaccggaggaataccatttaaataccatgacatataccagcataactgtcttctatatgtctaactgatcaccaaggaaatacaggaccctgacaagttgcgtccgtctcgtgagtatgaccttgaatatacataccgttcctgcaggctataccaactctgccttatagtgattcgtgataaagctaggcgtatttatgtccataattgatactc

SEQ ID NO: 56100 - DNA, 435 bp, Triticum aestivum
  Clone ID: PAT_TA_56100
ttttatttaaacaaaaggagatattttttagtttaatccaaaacagaaccgcgacaatgtgaagaggcaggacgcataacaaagcgcagcccacaccgataacaaagtttgaaagatagtcacaaacagacattaacatgaccgaacatagagaaagcaccctgacacccttacttgacaccacaactactgaaaacagcatacattctggcctacagagcgaatagcaatagaactattgaaatccttgttcaaagcgcacgaataggtgggtcaccaaaatccttcttggattaagcgaacactaccctcccatacagcatgcctgctgtcgcctacaatagaactgaacgtccttgagcttgctaacaaaatacttggcggactacttaacattcttgtcgaaaaagtctaagacattcccttgaagacttg

SEQ ID NO: 56101 - DNA, 565 bp, Triticum aestivum
  Clone ID: PAT_TA_56101
cgcagctatcacttgcattttcttcatccatttaaactgagttcaaacataggattccaacatcacatcccaatccatgacagaagggattgctgcatcaccgacgaacacgaccgaccgaccgactgaaagaaacacatgttgtttcttcctcgcgtaaccagctctaattaaccccggacagagcgacactcgagctcgcgatcaaaaacaccacaggaccgaacgacacacacgactcaagactgactgacacaggaacacgacgacgacgacactgaagataacttgatgacgaagacgacgagatggtagatagatcgataactggagggccccgccgctcagttcctccactggccgccggagtcgccgccgcgctggccgccgtagccaccgccgccgccgccgtagccgccgccaccacgctggccgccgtagccaccgccgccctggccgtagccgccaccgccgccctggccgtagccgccgccgccctggccgccgtagccgccaccgccgccgccgtagcctccgtcaccgccgcgctggccgtcgtagccgc

SEQ ID NO: 56102 - DNA, 201 bp, Triticum aestivum
  Clone ID: PAT_TA_56102
ggggaaaagcaaaccagcccccaaaccaaggaaaaatattccaaaacacaacccggggggatcccggccctgggaaccaccctcaaaaggggtcacaaagggtgggccagccggatttaaaccacagaaaaaaggccaaaaattttgactcaacccaaccaaaagctacaaaccggtctaaccaaaaggcagaaagggtat

SEQ ID NO: 56103 - DNA, 587 bp, Triticum aestivum
  Clone ID: PAT_TA_56103
actagtctctttaatctagctataaatgttttctataagatctttagctttaaaagaacatttatatgctctttactatactatatatcttgctagattaaaactctaataactatcaattctagcagcagtaacctctacttttatagatcattgtcttctaggcaacattcctaatgcaggacgtatcaacctagaagtagctgaggccgtcttttgcagcttgaacaccgcaaaatgcgagtttgttatactccgcttcatgatggccagcgtcatttgttatatcttagaatatgacttcctcatgattacgtcggtaggtatgcgacagaatggcgtaggtcttgaccagtaaactcaacaaggctggaacggccatcgccatcaattcgcagcagccgcatgagaagcagtagagaataggccaacaagcttatcggaagataacgtgctccaactgagtgtataaagaacacaagtgctgggactttggtaacattggtagtatttgagagggaagacgagcgtggtaggagagcctggaaaggctaataagcacgtggtcacgtgcgcaagaatttttt

SEQ ID NO: 56104 - DNA, 123 bp, Triticum aestivum
  Clone ID: PAT_TA_56104
ttttggaatggaaggtatttctcagttttcttgttatctcaattcacgttgcgccttcctgttgttctctgaggctgtcttggaagtcctcacaaactccgtgtcaattacagtggccgtcac

SEQ ID NO: 56105 - DNA, 443 bp, Triticum aestivum
  unsure (1)..(443): unsure at all n locations
  Clone ID: PAT_TA_56105
ccatacataacactcatacatgtagtataggtttactcgcaatgtattttgcaagcaagagggntcaaaatccagattaatctcaggacttacctgcctttgggacaggtgaccccatgccacaggctatgcacattaactgcactcaggagcttgctttcttctgagggcactctgtccaacgttataaattgccaatgggctaatggcaccgcaagtaagctttctgtagaaggcccgcctaagcattcggcggacacacagctttggatcttgagtcgggtccatggcagttggggacaaccagaaccacattgccattgcaagaaaggcaggggttacctgatctccttagttgtctgccactggatactggagcacaaattgtatgtataacagcgcttttgtgaatgcatttgtataaggcttatgagggacaaatc

SEQ ID NO: 56106 - DNA, 600 bp, Triticum aestivum
  Clone ID: PAT_TA_56106
ttttaaagaatgaaaaacaccataacattataaggtgaacgaccaaacatatgacagcatagcacagagcatacgattactaacccattcgttgttctggtaacacaggcaaatagcaaatagttcaacagatatgcgtcgacataaaggttctaagcacgagcttcaaggagtctccatacaaaggtagcaaaatctgatggctcagacaaatactatcaaggtgtgcatagggcagtttaacggtagcggcggagggagacggtctggttgcgcttccaggtggctctccttgagggcctgttcttgtggtggcggtggcccttgccacgcagaccacggaacttctttccggccgacgttaggccacgaagctcacggtgcttgtgcacgggcttgcagagccagttgatccttgggtcattgcggacagcactgtgagcaacatcaacaaggatgacctcaaagtacttgtaggtagagtcctcattcacccagtaggagttgagcacacgaagaccacccagcctgcgcccagctctttcttcagcaacagacctcttgttcctctggaacttgagctgggtaataccctggtgc

SEQ ID NO: 56107 - DNA, 584 bp, Triticum aestivum
  Clone ID: PAT_TA_56107
gtcttgcatactgtcgatatggacgcacaacggttttaaacagtgggaaatggttacatcatactgttgtttccaaccccatatacccatcacagtgatcagggggctgattcaacaagacaacaacgttttcagctttgaggaccatcggtccctccaagcaagaatgcgacgaggcggtcgatgccaagggtcgaagtcccgccgtcctctgccgccgccgcggccttctccttccacatcgtcgccttcgctctcatgtccttgcctctctcgccgtccgtggcctccagcacgagccttgccacctcctcccgcttgacatcgctatcgatctccagcccgatgccccactcggcgcaggcgtaccggcagttggtcgtctgctccgcgaagaagggccagcagaccatcggcacgcccgcgcagatgctctccagcgtcgagttccacccggagtgcgtcaggaacagcccggtcgccggatgccccagcacctcttcctgcgggcaccagctcaggaagatccctcggcccttcgtctcggcgagaaaatcctccggcagcacggccttgtcgccggc

SEQ ID NO: 56108 - DNA, 525 bp, Triticum aestivum
  Clone ID: PAT_TA_56108
aaaagggccaagccgggtcatccaagacgcctttgggcggggagcccccccgggccccatcaaccccaggggggagaacaacttgggcggggggggggcatgggcatcaccgcaacccggggaaactggggaagccgccaacaaggcaaaggaaaggctggccggcgccctcggggggccagcctggggggcctcaagggggggggccccgccccggaggggggggaacacccggggccggttgcgccggggaaaccccaacggcccccggcttttaggggttgggcacgggggcgcggggaggggcgggcgcgtttgggggcccgggggggctttctttttgccgggggggggggcgccggtgggtgggcctttcccccccgggcccgcggggggggtggttgggggtccccccccggttggcccccccggggaacagcccccggggggggggtacggggggggttttcacgggggggccgggggggcggggggttgggcccgcccgggggtgtcccggccccg

SEQ ID NO: 56109 - DNA, 528 bp, Triticum aestivum
  Clone ID: PAT_TA_56109
ttttactagtagggtgtgaaaactcattgatgctactactacatgaaagaggtactatgcttacaattacctgctatctgtaaaacagttatggtagccctcctaaaacaagaaattaaagaggaataagatgaaactgaatagggttggccaaggacagccacgtcgctaccaattcaagagagtaacaagctgctggctctgcctacaaccagagaggtctttataacgataccactttgatgccacctatagaatactatcacggcggtggtcggagccgccatccatcacatgacactgcacgagttggggatatcgtcatgcaacaagcggtacgagttctgtagctatgaccgggagtgggggtgccgcgcggacccatgggtacagccgggaataacataccggaacctgcaagcataccaggtttcactataatgagttcggattattatcttggaggtaataatggtccatagctgttgtcctgcagtaaaattgctatcgctgtcacaatcatcacac

SEQ ID NO: 56110 - DNA, 610 bp, Triticum aestivum
  Clone ID: PAT_TA_56110
cttacctgctgcaaggtgtaaatttttatgaacaaaagttatttaagtactcctggtgtgctgttggaataaactgaagatcaagatggtggaagcagccagtgtcgtgcccgagcgctggggagcttgccagcgttgtggtggagtaagtcggccgcctcctctccccaccaagtcgctttggtccatagatcgagttcatggtggataaggaaggcgtggttgatttcaccaagctgtatccgtatgtaccgaactactatggtatgaaccggcctccacgcatgcagctggatgcacttgctcaacacctttgcatctatgcacattcagctacagtgctgatgcacttgtgctagtcacattgagagaaagctaagaacctttgtcttcaagttcttgctaggaccaacatgttatgctgatgttgttcacgcacctgtgctatttacagaacgagggtacccggccttcttcatatcttgcaggactgtttttctttgattcgttcatgcaactaggaagttacatatgcttcttaacgtctcgtgcaacaatggtgattgacactgactatagcaggttgttgggcttccagctcttcaaccac

SEQ ID NO: 56111 - DNA, 549 bp, Triticum aestivum
  Clone ID: PAT_TA_56111
tgcacagtatagacccggcagcgtcttgcctgcaagtctgcatgcggaatctgaacacccaggtgtcccgcttacatgttggctctaggggacacggtttgctccgcagcccactgcctgcagcagtgtatgctgcggctcgacaagtgacctgttctcattgatgaactaggatgcgctgcaagacccaatgacttaaacatccattatataggggtctcttgagcagctaaattcgctattaagcttgaaggtctagctttttacgcatgtgattcgtctcaagacttgagctgtaaatctttactaattatgcatcataccaaataaggattgcgtatatgtgtacttctaattgttcggttctagggacacacatacaacatgctgcagatgtgagagataagacgtacaccctctttgataacatatatactctgctgactgaggttatcattgtgcataattgatggtgactctgtgactgaatcatagttgatacacattggtgcttgctgccagctccaacctcgcaaagtctaggcatag

SEQ ID NO: 56112 - DNA, 635 bp, Triticum aestivum
  unsure (1)..(635): unsure at all n locations
  Clone ID: PAT_TA_56112
ccaccganaaacaaacctggcggcgtcgtcgtcctctcgctttcgttctcgcagccacggatccatggccgtccggccggccggcaacgatgctcctccgttggatccggcctcctctccgtcgggtagggtgccgccgggagggagagaaagaggggctcgtctctgagaagcggcgaccgcacggggcatcgatccggtgccgatgaggagcgctgctcctttccatggacgccctcacatctcacatgacaggttggggcggcacggagctcctcctctacggtgttggatccgtcccggaacaggcctcctctctgtcgggtgccgtctggagaggggcttgtcgaggtccccttttcatttacgagcacacggggccgatctggttctggcgtgcagatcactgcccgcggcctgacgagcggtggagcactgctcgccacgcccgcccgcccgctcttacatcacatcacagatcgatgccacttcatttatgtgccgcggttgccgatttaccaaaaatggctttcgcccagctttattatattataaagtaaacaaccaaggccagcaagcggtccccgattccgagctacttaatttacnggttgtggcaccacgatgctgcttcc

SEQ ID NO: 56113 - DNA, 582 bp, Triticum aestivum
  Clone ID: PAT_TA_56113
tgccgatgcagctcaacgcgctcgtcggctccatccggctcaagaccattcttgccgactgacgcgcatgtacgacgaccacgtcgtctcccaagatccacggctatgcccactagtgtggtgaggtgccactactatagcaacgtgacgtgctccatggctgtggtctgttctactgtaggacgcggcgtgcgatgatggaggttagtttttggcgactggtgttttaccttaacgagttgttggcacccgtaggtggcgatctggatcatgttttccacgaggacgtctccctgtgacgaccgctctctttatagctgtagaggaaatttgtaactataacactatatgcacctccgattgacaacttttttgtccctgtgtttacatatttgcgatagaggggtcactctgcatgcaataagcacatgcttattgcgtttgatgtgtggtttgagctttatccctctcaacaaatattgatgcgaagatttctgatgatgcgtccactcttgtctattcatataatcgaccagccagacagttgctctgctgtttgactggtagatcatatggtctagg

SEQ ID NO: 56114 - DNA, 660 bp, Triticum aestivum
  unsure (1)..(660): unsure at all n locations
  Clone ID: PAT_TA_56114
ggnaaacggcggcgaaaaggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagcagcagcggcaccaaagaagccaagccaagaagtgaagtctgacat

SEQ ID NO: 56115 - DNA, 181 bp, Triticum aestivum
  Clone ID: PAT_TA_56115
caacgaagtcagcaacagatgataaccagtttctggatttaattcagataacaaattggtttgctgataagtatactgagaatcaaatggtgccgtcttattttgaagagtttgttgacagagtatataaaataccaagttggcaaaatcaatgtgatttgatcagcagcttatgggtgct

SEQ ID NO: 56116 - DNA, 661 bp, Triticum aestivum
  unsure (1)..(661): unsure at all n locations
  Clone ID: PAT_TA_56116
acccgccgccgccgcctcgccgcggnaaaccctanacccctcccccgtccgccccgtccgttcgccgctccgtcgccgccgccacccgcttcagatctcgacgacttccgcccgcgatggaggactgggagaatgatgattttcaaccaatcgcgcctgttgtgaaagctcaacctcttaaaagtaactgggaagatgaagatgtggatgaagatgatgtcaaagaatcttgggaagaggaggaagaggtactggaaagatttgcacactgtttagtgcacataatccccctttccccctggcccacatttttgtagctcttcattttatagaaagtttaaaaagggaatcacctcgttattttcagatttttttcatttatttctgggcattattaacactgcgaatatgtgaaagtagaaagtaatatccaatctgagggttatcagggacatgtgtggcatgtggccacttgccaaacattaattccacccccaatgattttgtactgttgctggaaattcgccaagtaatccttggtgttcattgtcgccatgaatttcaacatatatcactttaatgtgtagatgaatccctaacaaatctaactgatcactatgttctgtctgttcgcatggtctattcattttgccacaagtat

SEQ ID NO: 56117 - DNA, 653 bp, Triticum aestivum
  unsure (1)..(653): unsure at all n locations
  Clone ID: PAT_TA_56117
cagnacatttttttttctgttccacttgcttggacgtggaggttttggcaaagtttacaagggcacactggaaggtggaaatgaagttgctgtcaaaaggcttattaagagttctgggcaaggtatagtggagttcaaaaatgaagtacttctcattgcaaaactacagcacaagaatctagtcagacttctcggctgctgcattcatgaagatgagaagttattggtctatgagtacttagctaacaaaagtttggatgcctttctttttgatcatgcacgaaaacatgtgctcgattggttgacacggtttaaaataattaaaggaatagcaagaggccttctttatcttcatcaagattcaagattaacgataattcacagagatctcaaagcaagcaacattttgttggacacagaaatgattcctaaaatttcagattttggtatggcaagaatctttggtgcaaaccagaatcatgctaacacaacccgggtcgtcggaacatatggttacatgtcccctgaatatgccatgggaggtacattttctgtgaaatcagacacttatagctttggggtccttctattggagattgttagtggtttgaagatcagctcagctcagctcaaaatggaattttgtagcctta

SEQ ID NO: 56118 - DNA, 500 bp, Triticum aestivum
  Clone ID: PAT_TA_56118
gccacaggtgcctgctggagcccttagcgtgcctgcgcatcaaggcattatggcaacacctgctgaggaactttgagttcgatctggcctcaccattcccggggaacgacgtggatgcgcaggcacgtcgcataaatggtgaggtgatggtcaactacaagcggcggaagctcatcgcggaccctagagagcgggtggacccataagaagtgcctgctactgtgtttgctccatttaaggtgtgtcgtccgtacgccaacactgacaggtattgtatacttcaccattgtttagggcactgctattaggttacagtgattatttagacgtgaagcatttgaaaggtgattatctgtacttacatctttgttgatgttcattctcttagaccgtgtcacacataaaatgtgaacatgacaaccctatgtaaggaacacagcagctgcaactgagttcattcaaaaaaaaaagaaaagggcggaacgctgctatggtatcca

SEQ ID NO: 56119 - DNA, 669 bp, Triticum aestivum
  unsure (1)..(669): unsure at all n locations
  Clone ID: PAT_TA_56119
ngaattccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcaacaacaacgacaacaaccgtcgagccaggtctccttccaacagcctcagcagcaatatccatcaagccaggtctccttccagccatctcagctaaacccacaggctcagggctccgtccaacctcaacaactgnccccagttcgc

SEQ ID NO: 56120 - DNA, 593 bp, Triticum aestivum
  unsure (1)..(593): unsure at all n locations
  Clone ID: PAT_TA_56120
agagaacaagcaacccatttatttatgccaagcaacatcaattttcctcgctatttcgagtttggcaaacaatagctcatcaacgggcatgcaccgctacatgcgtacagactgaatttttagccgatgccaaacagggccaccgccgttagagcattggcaatgctggctaaattagacaaatcgtaactaaaccaaacaccagcagagcaacttaaccaaccagattagaggatcaatggctcagttatgaggctattgacatgaagcctaacacatggcagactaatgtaggcaaggagctcattgtggttgttttgcggccagtgccaaacagcgacgcgcctcattcgtcaaagggagacaccccttgtcctctgcattaaccggtgatgatggagtagcgaatcaatcacgctgtctgaatttcctctccgatacaagtttgaatccatggcatcgtcctggtcgccggcaccacccatatagaaggcagtgccaaaatcctttcccgtggcaagagcttcggattagcggtggcacttgttcttgcctgttgaggatactcaatggacaagggnaggcgtcatcag

SEQ ID NO: 56121 - DNA, 519 bp, Triticum aestivum
  Clone ID: PAT_TA_56121
gcgcgcaacgcacattaaaacgatttaccgagaccttatgatctaccaggcaaaccgctgagccgatgttggctcggcgattctatgtatatacaagcactggagctacatcaaaaatcttgcatcaattctgtggcgagggatcaagcacaaaacacagatcaaacgcatatccctgggttcttgcctgctgcgtgaccccttcttctcaaatgtgcgaacacaggggcagaaaagggggcaattggtggtgcctataggatatagcttcaaatttcctctccagctattgcgagagacggcgtaccacggcgtcgtcctcgacgaagacatgattcagatcgtcatccacgggctccaacaactcgttcaggtgcagctccgtcggacagaactcaacgtcgtaatgccccgtcgcgtgcttactggcaccgcacaccgccatggacgacgtcttgcttatttcatagtagaacctcaccgactagtgggcatggccgcgtctattgggcgacgtta

SEQ ID NO: 56122 - DNA, 592 bp, Triticum aestivum
  unsure (1)..(592): unsure at all n locations
  Clone ID: PAT_TA_56122
aacgaaaaaacttgcctcatcatttgctgcataactgtatgtcgtaaccaaggttctccagaagaagaggaaaaactaaactaaactagtttacaaaattagcaaattacatngaaaatctagaacagtcattggttatcttgtcctacacctgccgattcgtcattccgagataagaagttggcattaaatcacaagcactgaaaagcaggctgaagatttcctgaaggaaatcccagtcatgtcctctgctttttttctgtgatgcggtgacctcagctggaaagaatccgcgacaaaatgtcttgtgcatactggaggaacatcttgaaatcttttttgtacacccgaaaatcttccttnatgttgtgtcagcaagatacaggatggtaagataggacataagataaaatcttcaggcacaagcaccagtcaaactatagcccagaatttcttcctacaaatcaacacctgctccggcctgttttcctcattttccaacgtgtgaagtggtgacatcccataggaactttggtggcgagatcactgattcttgaganaagtggtattctcatctctgataatgataaaa

SEQ ID NO: 56123 - DNA, 271 bp, Triticum aestivum
  Clone ID: PAT_TA_56123
cccaaacgggaaaacaggggatatatatatataaaaacaggttcctcatccagaatacacagggaatcagtttggcccgccggaaaacaaccggggggaaaaatgtaaaaaaattatttggtaaaaacacgggggggggcaaaagcggcccctttgaaaaaataaactagttaaaaattaatcccccggaggcggcccttgggctggcattaagttttgggtaaaccgaatcccctggtggttccggaatctctttttggttggggggcac

SEQ ID NO: 56124 - DNA, 558 bp, Triticum aestivum
  Clone ID: PAT_TA_56124
gaacaaaaaaaacgcctcagggagccgcaagcgttcttcttattctccgagtgtcaaaatcaacctcaaatagataagacatgttcccacgcagttccaagtgttcaggggcctctgaagggaatacagaccgccgcaaaccctagtctctgctttgcctcaaaggtattacacggaagaggctattcccctcccagccaatcacatgaagtcgaactcgtcgggatcgtcaaaagatgcacccggtcgggcaacaaagtcctcctctcctttctctatatggagctgcttcttttttgctcctggagatttatggcaaacatcagcacagaaggcatatgatagtaacagcattcccatcctagggctacacatcatgtttggccagaaacagaaagtgcctaaattaggcccaaaatttcacctcctttctttttgcctgctgcagcttctttctcagccttgatcttttcattagcaattgccgtgacagaggaggatatttctttcgcatccgcacctttcaacgatgcccatggaaagtctcatgacattctt

SEQ ID NO: 56125 - DNA, 598 bp, Triticum aestivum
  Clone ID: PAT_TA_56125
ttttataggaagaactattgaatttattaaacctctggagaaggggtacacacttgaacatgactgtcaaactgcacaataccaaccagatagatccttccccctttcaaacaaggatgtctaaactgaacaataccaaactgagccgcaacactgtcatgcctgccatgccacatctccctcatggagtaacccatgcaccttgaaacagttggcttactgttttgcctaaaatccactccagatctgaagacgaaatggcgaccttgccagcaacatgagagattgcctcctttgctcctttgtagccacattcaggaacgacgtaggggaagtcacttccccacattattcggttagctccatagctggagatcacccgagaaagaagctgagacgtgtcctcatacggataagcttctcttgtgatccggaaaagagcactgtatttgacgtaaacctgttgaagtcaagtaatgcgtcattgcatcagtgttaacagggtgacactgaacagaagaaccgaacacagtactgtagccaagcaacttctgttcattcaggcaccagacatcattctatctctttggcttaattc

SEQ ID NO: 56126 - DNA, 579 bp, Triticum aestivum
  Clone ID: PAT_TA_56126
agatgaacccaactcattcatactggctccgcccctgatgtacaaaaaattcaatgcacactaagttatacaccaactaacggcctttgagcattgtgatactcattgcattcgaggaactcgtgttctcactggcttgttcacctttaggattacctagagcaaagtacacaggatgctttggaggtggaagcattgcgctttcattctctaacataaacataaccgaggacattagtggctatcatttggatgatcttggacacacaagagtcccacatgaatgcatcgtacaacttcatgaagtgggcagctcgcagcaatgaaggagtccaccaattcagttgcttttccatcttcccataatctccaggcctgaccaatagcatgaagtcacaatcaggttactaaatatattgcttgggtggagagattaattagaaattccccatattcactaccggaatcaaagtgcttgctgagtgatttctgtcgggcactaggcaaaggccctcctaaaccgagtgctgcagaaaatggacacttggtaaagccttgcctttgccaagtgccggctag

SEQ ID NO: 56127 - DNA, 569 bp, Triticum aestivum
  unsure (1)..(569): unsure at all n locations
  Clone ID: PAT_TA_56127
tttttctgatgaaagaaaaaatggctgctgaccgacgggtctaaaatctttggtttacattcaatcttgaaggactgggacttaaacagtcagtccacacattctttttgggagactgataggcgccggtgctccggcttaaaattgctccgggctctccttatcacgctgatggttttattcttaccgttcaaacgttatgtccagcttttgaccaaaatttccacatactgcttggaatacaaaaatggatgaatgccgcattaccgtcacttcgtgagcatgatgcatcccatggagtgctcgactccttcacacgaacacatacacaacggaccggcaggnacaagtgggtcggttcctcgggcgcctggcaggcacctagctgcgcttagggtgctgcacggctcgtcccgatccgcgttcattaactcccggaactaggtaccatgtttacctgcctctgtccttgtaatattgcgtgcgtccatcaacacccgcgagtgggatgtcgcaaaatctttaactacaccgtctctgggtcgtcgacccatgaactatgacggact

SEQ ID NO: 56128 - DNA, 607 bp, Triticum aestivum
  Clone ID: PAT_TA_56128
tttttaaaaacatagctgctcaactttgatccaacacgaaaacattctgcatacaaacgttgtcacgagggtcgttacaagtacaatctcttccaatcaagcattccacccccaccacatcactactcgctaagtactcggcaccagagagaaaaatagccaagcaaaaacttgtctcaggcctagaaggggcgagcgctgggtttaggttggtttcctcatgttgcgccctgccctgatcacctcatccactagcaacagctgcgacgcgatgatgggtccggaattcacgatctggcgcttcaccgagtagttgtcgtagatgccttccatctcagggtcgaccggctcgccactgttgtggttcagccccaccaccagcccacggtcgtgctcattctcaagagagacaataacatcttgggtatctaagcccgaattctctgctagcgtcttggggataacgagtagagcatcggcaaatgcccccaccccaagttgggctcgtcctttaacggttttcttcacattgtcaatgagatgcttccttgcagccatctcgaacgctccagcccccagcacaacagcttcatcctcaactgtgtta

SEQ ID NO: 56129 - DNA, 552 bp, Triticum aestivum
  Clone ID: PAT_TA_56129
agcctgaaaccgagcatgcaggtgcaagctaggcttcaagcgcacccgcgaacgcgtgcgctccacgcatcttctgccgtagtagcttgccagcgaattcgcctccaccagaagcggaggatgcttccggacacgcactcgctccaccacctgagatacgagcatacgcattgtcaacagctgaactccactgccctcctcgtccaccgactgctaggccgtgacaccaacacgccaacttccgcaattatggcgctgagagattgctgatatctctaatagactctgaaaaacctgcacaacctagcgaccaacgtagccctttatcccttgcaaggacacaaagtacatgaggactcaaggtaaaactgccgttttcatatctggaaagaagggcaccccaggcattactataaagacagacgcgctatggtcctgattctcatgatgtaccatgagccaatgactactagcaacaaaggatgtgaacccggagagactacaagactacctgcctgagcaaggaccttaagctccacctgatatgctgca

SEQ ID NO: 56130 - DNA, 657 bp, Triticum aestivum
  unsure (1)..(657): unsure at all n locations
  Clone ID: PAT_TA_56130
gngggtgtagccaacanagccaaacccctggtacgcagccgatcggtcgataaggtccctcgaattaacacccgctcgacatgtcgttcctcccgattccgctgccaatcgttggagacatagccagcaggctgcacggccaagagaaaccgcgcggcgaggacacgacgtcgtcggcgccggcgcctgtcctcggaaccgtggccagcaggtggcgcgagctccacggcgagaactcgtggaagggcctcctggaccctctggacccgcacctccgcgccagcatcatctcctacggcgagatggtgcaggccgcctacgacgcgttcaacaccgagaggcgctccccgcactgcggcgcgtgcttctacggctacgaggacctgctcgccggcgtgggggtgccccaccacggcaacaactacgaggtcaccaagttcatctacgccacctcgtcgctgccactccccagctccttcctcctgctgccgctgccgtcgctgccggacgtctggagccgagagtccaactggatggggtacgtggccgtggccacggacgagggcgccgccgcgctcggcaggcgcgacatcgttgtggcgtggcgcggcaccgtccagacatggagtgggtcaacgacctcgacttcgcgcccgt

SEQ ID NO: 56131 - DNA, 612 bp, Triticum aestivum
  Clone ID: PAT_TA_56131
cctccccctcgcgacgccactcgccgcgtcgctcggtcgcgggctcaccaccccaggtaggacgtagctagagcaccccgaccagccccaatggctcatgagctagttctcgacacggcaatccgggactgactcctacattccattctgcgaggtcatggtgctgatctgccagctctacttcttggacttcaagccatgcgctcccacccgtcgggcttcccctcccatgatcgcaagaacgtaaaggaactgcaggacggcatcacggcacaggaacctgaggaacggggctcatctcattgctgccaacgcctttaaggaccgcaagctttttacaccaacggggataccggatctgcttcatgttcctaaagaggatgcccacaaggctcatgccgctatgttactccgacccaaacatgagagtggatatgatgacataagaatctctccatgatgggctcacagacacttacatttgcatggagtgaacttgttctttgccagctctgcggcagtcaatacccactttccagtgacttaacgattgaagcgaatgctgcaacaagggatagacctgatctctgaagcagtgagctatgttagcag

SEQ ID NO: 56132 - DNA, 666 bp, Triticum aestivum
  Clone ID: PAT_TA_56132
ctgcagcgcgctttgcgggtcggcggacgcctctggtctccctcaagtttcctttccccggaacccctcaactcgggcgctcgattcctggcttcccctggcggcgatctcatctgttgttcagacatgactgcctgcaagcagagcgcatccacgggcgccgccgccacgtacgaggccgacagaaagtcggcagcaaagagcgatggagcggaggagcggaagccctcgaccaagtgcaggaaggggaagaaggccaagggcaagttggcggtgaagagcaatggtgcggagaagcccaagacccatgacctttccgatgttacacgcgggttggcggtgatgagcattgcaacggagaagccattggatgaacagctcgcccagttcgccctgttcacctaccagaacgacttctggatggacaacttcaaaggcgtctatgacaagccgtccgtagatgctattaaaaggaaagctactgaaaactggaaatcctttagcgattcggacaaagccccttatgtggccattgcacgtgtttacaaaatactcattgccgaggcaaatgagttcaagaagacactgaagttgacgcttgcgatgacggagaagatgatgaatctgaaaatgtgaacagccaagatctctaagatgtgtttgaat

SEQ ID NO: 56133 - DNA, 629 bp, Triticum aestivum
  Clone ID: PAT_TA_56133
caaaggtagtgctagtactcaccactagagccttgcgtctccgtactgatgcattcctacagggagggattaggcataacgtcactaatggaacagtggtaaccattgctcacaggtgcttaactgggacactcagctgcagcaccatggagctttcctccgtaagctttttcaaatgacacacccgcctagcatgttggaaagacataacattacaggctttaggtaaactagccgcggagtattgggctaattgcttgcggaactacaaatgattgtatcattctatgtagaggcttgacaaactagatcagcactgcaatcacaagatgtgaggcattgaaagattgctatcctaccttctaaaatgcttcatctgtatcaagactgagcttggcttgctaccttgctcattggcgaaattactgagaataaagaagacatcgacagcaatgtaaaggttatcagagatggcaaatttttggagataaggttgatggatagaactaactcaagatgcattgattgcgagtcctgcaagataatcatgtcaacaacgatattgatattccgtgcataacggaatagaggatccacctgttaccgcgataaatggcacacttcatatg

SEQ ID NO: 56134 - DNA, 671 bp, Triticum aestivum
  unsure (1)..(671): unsure at all n locations
  Clone ID: PAT_TA_56134
catcgccctcgtcgacaattctactgcagatagtcgccgtgtcaaggctgatgagggggtgctctctgtagtcacagatagttcaaatcgtcacatcaggtttcgaacaaaatctttggagttgaccaaaatccgcattcaaggagctactgaactctgcaatgctggagaacaaccatttgtaggaaaagtggacctgcgagaacagaatatcgttgacattgaagaacttgtggaactttgtacccgtatggaagaggcttgctcgggattcacaaggttcggtttctgtcagatcttggatgctacagacaatttctcagagaagatgatagttgggtggggaggatttgggaaggtgtacaagggccagttgcctggtggacttaatgttgccatcaaaagagctgatgagcacgcagcaatgcttgaagtcaacagtgaattgcagcttgcaaagcttcagcatgccaatgtgattaggtntattggggtggtgcatccatgggaaagaaagattctagtgtatgagttcatgcaaaatggttccttgggatcgttacctatgcgacagaacaaaagggccaatgctaaactggtctaagcgattcaagataattacagggttaacagagggaattgtttacctgcataagcactccatgttctgg

SEQ ID NO: 56135 - DNA, 638 bp, Triticum aestivum
  Clone ID: PAT_TA_56135
gcaagtatacatgttatcccacgagcaaggctgtttaatttcatccataccaaactgaacaactcttccattcccggcgctcggcggatggatcaggcactgagctgactgcggatctcctcacttccttggtgctcttcagcccccttctcttcttctcctatagaaaactcacgctgagacgatccaagatgggcgggtgctgatgctgttcaccctccaaacccccaggtagaacccaatgcacccaatcgcagagccactcatcaagcagaagcccaatcacaccccttcctaccatcaaagagaccgctgtgaccacccatgctcacaagggtatgaacgctgtcctgcgcctgaagaccggcttatagcgttatacatcgaatgtgtacaacaagagaccctaagctctctgaatcacttacgaaggaccattcccccaagtacatggtgcttgcatgtactgacatcacgtgtgtgtccaacactaacccttgtactgaattcaatacacgccttcactgttcaaaatattgctggaatggttcctgcctatcaaaagacacgcactgcaacgtaggttcagacatccagtcagtcgtggatgtactcaagttgagtgcattgttgtgatt

SEQ ID NO: 56136 - DNA, 645 bp, Triticum aestivum
  Clone ID: PAT_TA_56136
tacaagttttgggcatttcgccaagcctttctgagtggttaaatagccggtgccttgacactatttaaacttctccgttgaaaccatttagtggatgcacttgcgtcatgattgtgacgttacatatgcttagcccctcaattaatcaaaagtctggttgaatgacgggcactccaaggctaaaggactccctcccaaaagcttgcattatccaaaagcaggggaaatattttaggaaatgcttgatatttagctttatttattaagttctgatggacaatacattatattatatttaaaaaataccacaaatattggacaaacagattatctgaaattctcttggcaagcttctgtttgatgaggagtcattgtcagcatgaggtgctggaacatcttctgtttggtttgtcgaggtaagatgtacaacaaaggatgttgacatcggaaaagtggagtgggctatttggtgaatgcagaccatccatccacaaaataggttcttatcctctagattctacatgtttctagatatgattcacctttttaactattcatggagtttttggattctagtttcttgtttaaatcattttgtcgcaaataggtaggtaggtttgcctggtaaaaaagtaagtccagcgc

SEQ ID NO: 56137 - DNA, 476 bp, Triticum aestivum
  Clone ID: PAT_TA_56137
tactgggagtggtcgggaccatggaggggcttagggcaaacaatgggccagacgaggggtccagacgtgtccaaactcccggaagcctagcctgcgaggaggtgcggtgcgctgataggggagctagacggcagacgagtacgggttcatcgacaccgcggaccttgagaaaccctggcgaggactccaattaccgacttgcagccatccgtgtctggccatgtatcttaataagctgtgagtccacagacggcaggactaacctgatccagtcagccatattgtcgaaggacgacctgtgctgacagaccgaacgaactgtgttttttgatccggttaaccgcacgcggatcggttcgactcggcagcagcattagagcgcgctccttcgtgcgtttgctgttgttgctcggcactctttcttgctttgcatgttaacttctaaatcgcgaacagcctttagggagccaactgag

SEQ ID NO: 56138 - DNA, 545 bp, Triticum aestivum
  Clone ID: PAT_TA_56138
gcacagggaggtgtccggcgccaccatggcgactcgacctttggcgcaaagcatctccaggcggccggaccctggctggattacaacatacgataaggaaatcaccctccacttaatactaaggtctacgtaggacgcatccaaagctttgctaataccctcacaggaccaaacattaaactgggggccgagccatgagacaccattgacaaccagaaggcgaattaacaacacaaagaacgaattgctgcccaccatcttcacctgatattttgtagaaaacaccttcaggatagccgcacttatggaaactacaacatttataaggagacaaacctatacttgcatctccgtatccaaggagactcagctagctactgatcatggagatgattttgcttataagatcacaaatgctatttcatgtgatcttaacgacaaatatgtatatacatatgcacctgaaatatcgttggaactctacacatctatgatacagcgctatcaaataaatatgcaaacatataatcgtggcgcaactagct

SEQ ID NO: 56139 - DNA, 671 bp, Triticum aestivum
  Clone ID: PAT_TA_56139
cgcgggggacgaagccgagtaggagagaggaagcagtctcagttctcgatctccgaggttggtggcggcggctagggctggcagccggcggcagaagcagatctgatccgcgggtgtccggcgcagagaggaggctccccggagcttcggccgggccggccatccgattccgcagcccgcctctgcgatggttcgatctccgccccccacccacccagcagtaattttgttatccttctagggttcaaattcgggcgagatcgtcgccggatccccccgggcggttctcgtgctgggacggccaggccggcctcgatccgtgggcgctgccagttcgagtcaaattccccatttcctttgcgcgtgagttggccgcggcactgtgggattttggtctctggctgctgactgcagtgatgaattcgaggccgatcgtgctcgtcttcctcctgctcgtgctcatcatatcatcgcagttcgagtggaagcagcagatcggtgaggccgaggcgagcccggaagctacacggcggaggcagcaaccgcagatcgtaagggaagatgccgttaaagagaaaataatactggcgcaggagaagaacatccagcagctcaccgagctcatccagagcctccaggtgcagctactgcatttgccgtggcagcaacag

SEQ ID NO: 56140 - DNA, 619 bp, Triticum aestivum
  unsure (1)..(619): unsure at all n locations
  Clone ID: PAT_TA_56140
ggnaaactggnatcattcattcattctatctatctccggctcccctttcccctccttccttccttcctaatcctaatcctagctagctagctagggttccccgccgccgccgccgccgccggccaacgagatccagccagcgagatccgaccgagcgacgcctgcaggcagaggattaggaagatcgacgccgccggaacccgtctctgcctccgctggttcaggttcaggttcagccaggagacagacagagccatgtcgcactccaaccaagtaaggtacaccgcgcgctccatcactcccccggccgacagggacagcggctccaagtcgccccctcccaggaggcgcgccgcttccaagtcgccacccctgccccctcctcccccttttcctcccaagggggtgcgcaccatctccaggtcgccaccacctagtagtacaagacgcagcgtctcgaggtcccctccgccaaagaggcgtgggaggtccaggtcaaggtccaggtccaggtccaggaacaggagccgctccaggagcagagataaagacgatgtgaggaatcctggcaacaacctctatgtcactggactgtccacacggacgcaggaaactgacc

SEQ ID NO: 56141 - DNA, 644 bp, Triticum aestivum
  Clone ID: PAT_TA_56141
ccgggtgttcgataaagcaaaaggtggatctatcacttctctcctcgttcggtcagaagagcagtgagaccggagctgcggagagccggagtcagggacaagaagcagcagggaccgggcttccgctgcagtggagtggagctgcagggagaggaaggaagcaccagaattgttaatttgcttctgcactcaccagggatgtagatctccggttccagaggccggatcacccctttcctctgaaccttgttctggagcaagaactgcaacagaagatgggatgaattaacacatgttcctttctgatgtaggtgcaggatgtctgtgtgtgtgtgttgtgcttggagtgcagtagtaccagggctcctatcgctgccagtaccccgacggtgaaggccatggcggtggtcaacctgctgttctcaatctttcagaactccagctgcgtcgcttggtgcttctcggtgggtcgcccgtcggggtactccacctcgacttcatggtggagtagtaccatatcctgaatcgtgggagcagagcaaacatttagctcatcatggtccaagccattctctgttcggagtcggggacaaggaagcagcacggaccgggctcccgctgcagtggagtggagctgcagggag

SEQ ID NO: 56142 - DNA, 404 bp, Triticum aestivum
  unsure (1)..(404): unsure at all n locations
  Clone ID: PAT_TA_56142
ccggtccgcattcccggtcgccccgcgtccgctctctttgtgttcccttttttgtggcactataaatcctggcagggcgcgaggcggcggncnctctctccttccttccgccgngcccgggnnnccgcgggccccnnngggcnncnccgncggnggggcgcgggcgcgcccggcngggcgggggggggggcgccncccggttcgtttgcggcgtgccctgtgtggcgngttccgcctggctgggcgtggctgccgtctcttctgtttttgtgctgtcgngtgccgctgtcgttgttttgtgcgcgcttcgtttttgtcttgcnttgtggctcggggtcgtgtctttgtcttcttttcgttctttggttctttgtctgcgttcggtctgtgttttcgtgggtggt

SEQ ID NO: 56143 - DNA, 475 bp, Triticum aestivum
  Clone ID: PAT_TA_56143
gtccaccgttttctcaagaaatcagagcgaccacctacagcttgccatgaacagcctagagtacagtactcagcaaatggacggactaggtgaggccaggcgccgcgccacattactaagaaaacatcgtctttgccagtattcccctctcgcccaggagcaaccatgaacacgccaggacccaaacccttgaccgtttctaccatggcggggcggcaagtactaggatgaacagccaacaacctggtatacttgagtcctaccgatcaaaagaacaggatagcacggcagcctgagaaaccctgctgcaccaggtagagtccgagcatatccaccaccaagttgacctggccatgagcgacggcctcatcgtgtataccaagaatcagaggcatgccgacctacttgacagtaaagtgacccgtgcccttatgtgctgcgatgacaacccgaggttaaccagcggacgaccatg

SEQ ID NO: 56144 - DNA, 169 bp, Triticum aestivum
  unsure (1)..(169): unsure at all n locations
  Clone ID: PAT_TA_56144
ttttaaacactttcagtttctggggctctggcatttgnancttgggtaaaaaaaatactttcagtcttttcctttnacaaaatggattttcaagctttntcatataagncctcagtactggnatntaaccgnnaaaaatatatatgatcagnaaaccgnnaccaaaaac

SEQ ID NO: 56145 - DNA, 538 bp, Triticum aestivum
  Clone ID: PAT_TA_56145
ctcacattaaaattggatatgtagggacaggcactagtaaaaaaatgggacattatatccttggcgccatcctgcaaatccaataccttccgaccgtactgcatactacatcttctagcttttgggatgatgctatccctggctttatacttttatttctcaattgcttgtacatgacatggctattgttggaggaataaaacatattgctgtcaaaaaaaaatctatcttggcgggacccaaaggacttgcatggaatgcaaacccatcaacagctatgcatgcaactagcctttttcgacgaaatatttgcgactggctagctagctaaccatttctgcactacttgactataggcattccacgtttggaagctttcgtggacaaagttatagcgggcaccaatcaaattcagagtgcccttgatcagtctgcccttgactaacgggtacgacttcaaatttataagggaaaatttgacggcctccttttacagcacggtgcattggctcgtcaaaaggcaacaacctgttttata

SEQ ID NO: 56146 - DNA, 451 bp, Triticum aestivum
  Clone ID: PAT_TA_56146
gggaaaggagcactattggggtttaccaaaaagggattcccaagaccctcttgaattaacaaaacatgcccaggaaacgctagggtgcgatgcggaacttagggcccaagggtaaaacaccaggaattaaatgggcctgcttaaaaggggtaaagggaattcccgatgtaactcctggccggggggtcaaaaatcttggcagcctggtcggggcatcctgccggaacaggcaaagaaccctggtgggcccctttaccccccccaatgcaccaagaaaaggggggcggttatggaaaaaggccaaaccgtaaaaggaaccaagattaatcgcatcctggaaaaacatacccaaagctgcccggctcatggagggggaaaaaagctgaacacccttgacattgtcctgcccctgggaaagcaagggcccgtacttaaacggttttttcactgg

SEQ ID NO: 56147 - DNA, 544 bp, Triticum aestivum
  Clone ID: PAT_TA_56147
aactgattgctttttatgctttttacccgacattttaatttacagtttctttaaaagcggtgaaatttttgaattacaagtctcctaccaagtggcagctgctaagaggcaggatcaaatcggaggcgttggctaaacatagtggccgcatgtactgaaaccagaggcgctgctaactcaagaccccattgttgcacagaagtggacaaaaactccggaaggcttctttaccgacagcacctactatttccaggcaaagccgctcccattttcggaaaacacactaatgcatcaggcttacattagccgggagctgctctgaaaccacccattacaaccaatgtatacccccttccttagaaacccaaccccaggcgccgtaagattgcctatacaactcaagggcttcactatattccatgtgttgcttgccttgtcatacttgttcaccacgtctgtggactgcatatgcgccaatatttggttattcacaacgaacaactatcgaaggccactggtaggcgctagttcctccggcgtacat

SEQ ID NO: 56148 - DNA, 547 bp, Triticum aestivum
  Clone ID: PAT_TA_56148
ttttgatagccaaggacatgtgccatattcaaagaatatttatgatcaataggctagatcaatgagcgcccattaaaaaggtccataatgacggcgggaatttgctggacaattccggtcacccccaattcttgcggcccgaataagaatatagcaaggcaagaaagaacaccacaccacaccaggacatacacgcacgctgacactaaaattttttggctcacaattccacccgcgcaccgagcaacggatcaaaaaagaaagcctgtcgggcttaaagagagagccaacctcaatgaatgtgactaactgaaacaggctcattctgccgtgcaaagacccacagctagacgagataatgaacccgcacacggccgggtagaggtcggtgaaccctagcctcccaagggcgccctgcttgtcccccgcgccaatgaacccatccgattggccttcaaacactgggaatgcgagaggtacctccaggaagctcggctgctttgcctcaacaagccaaaacacctctttgtggcgccatgctggccct

SEQ ID NO: 56149 - DNA, 524 bp, Triticum aestivum
  Clone ID: PAT_TA_56149
tctgccaaccctgtctctccgtccagccggcggatcggactgactacgttgacgggcgcgcgaccaccgtgggcgatccccggcacctcctccccgcgcgtaagccatggcaggaatggtaccctaaggttcccagttggaccctaacaactatgatactaagatgcacgaactgatcagccatggagagactgaggagttcttcacctccctatgatgaagctcatgagagctttgatgacctgggtctccaagacaaccttcttaaaggaatttatgcttatggctaccataagccttctggcatccaacagatgggaataagaactttgctgaaaagggcttgacgttatccagcaagcacactttggaacaagaaaaactgctactttctgatctggaatacttaaacagtttgtctatggctatggctgagtgccaggccttgggacttgctcccacacgtgagcgttcacagctaatagagaaggtcatgcgaccactaggcgactactctagagtga

SEQ ID NO: 56150 - DNA, 581 bp, Triticum aestivum
  Clone ID: PAT_TA_56150
agtaattttgtactagtacaactcgcccctcccgtcgccgtccacgccggcccaaaccaaaccctagccgcctgcccggcggacgggcgccaggccatggaccgcaagcgcatgaacgacgcgctcaacaggcacctgcgggcggtcacggagcggacgtacgacctaccacctcccgcggtgccaagccgaacccgacccccgtcaagcgtccccaaacccagagaccaagtggattctgacagtatcaaggggggtcatggcctctggtcctcgaaggcggacgacaccttgtgtatcaactggttctgcgccatgacgggcaccgagttctttgacgtggtggatgatgactacatccagaacaacttgaatatctgcggcctgagcgcccaggatcgctactacgatcacgcatcttgatctgatactggagctgatgctcgtccagagggatgtgtgtggcagggaccagattgagctgataggggcgttcatctttgatgctgtacaggtcgatccacgcccggaacatccttgacaccaaaggcttggctgtcatgctgcagaaggtacagaac

SEQ ID NO: 56151 - DNA, 122 bp, Triticum aestivum
  unsure (1)..(122): unsure at all n locations
  Clone ID: PAT_TA_56151
cttgtggactccttgtatgtggatcaataagcaagtcacaaggattacataaccgctatggtagncgtactctcttattatcacatacaagcgagtgccttgtttgtttcgcgattcaagaa

SEQ ID NO: 56152 - DNA, 530 bp, Triticum aestivum
  Clone ID: PAT_TA_56152
aacctcacatcccatctacctactgctcgactccctgctagcccaactatccatgggcccaagcggagggcaagaaccccgcaccgaacacgatcggcggccgaagaagccctaggtgacccaacgggcgccgctgtgcaatgaggccggcctggaggggcagacgaggggcacggaaggaatggtatcctggcgcaagattagacgctgcagacatgcacgattttcatcttcaacgtgcttaaacacgcgcaccctgactgggtcatctcactatcaggacatgtgcatcattaacttcttgatgaagacacgtgtcatctgaatctatctctgggtagtcgacactagcctgccccgctacatccaagaagcccaccatcacctaccgccagatcacagacctctgatcgacttgtgcttcttgtagagcgcgtcatgcacgccgcctgcgaaggaacgcaaggcgctgcaccaagttcacctgctattactgcagcttatattgatcgccattgcatgaactgatg

SEQ ID NO: 56153 - DNA, 661 bp, Triticum aestivum
  Clone ID: PAT_TA_56153
ctggctcttcttgctttgccacgagcggttaccacgaagaagaagcagaacctaaccttggagttggagatgtcgacaatcatcatgagagtcgaccttgactgcgaccgatgctacaagaagatcagaaaggtcctctgcaagctccaagacagagaaaacatcaagatgatctcgtacgacgagaagagcaacacggtgacggtgtccggctcgttcgacgccgaggaggtcgccgacaggctctgctccgatgctggcaaggtcatcaccgacgtacaagtcgccagagggaaccagatgaagcccggcgccaaggtggcgcccaagcagcacggcaaggagggccacggctacggcgacggccccggcccccaagcgcacggtcacggcggcaagccggagaagaccaagcacgtcaagttcggcatggacgacgacggacgaatcgatcggcacggccctggcccgcaagcgcacggtcacggcggcaagccggagaagaccaagcacgtccagttcggcatggaggacgacgaacgaatcgatcggcgcggccaccacgaccaaagccacggacatggacacggcaacggccacggcggcaagccgaaagtggtaactaccaccgcgatgtcacggaatgagggcccgcgcgccc

SEQ ID NO: 56154 - DNA, 648 bp, Triticum aestivum
  Clone ID: PAT_TA_56154
cagcgattgcgtattcacaaaattccagctcacagggcaattagcagactgttgtggtgttggaactcaggcagtgtcacacgctcagcttactttacaacccttgatggtctgcgagcagctacataaagtttttagctggttatgtgtactcgagcgatatttgtacaggacacgtgcacctgtattataagaaaatattatgatccttcttaccgtgaactttcagtcgacacatggtacatctccatgcagagagggaaaaccttaaaattgctaggaaagatcacccacagaccgaagatgactcgaagagctgaagtcactgcaaagtgttggacaaataataagagaggtccttcgtactcttgataatgaacgctttattggtaatgctagcagcggtccaatatatgtgatcggttgcgcggattaaagatgacaaggaaaactctactcctggaactcgtgctgcgctggacatgacatctttgacaatcatgcgcactctgcctaaggaggtggatcctgagctgtataacatgctacacgaagatccatgcaatgtcagctactctgctgtacgtggctggtctgaccaaatcaggcaactcatggcatcaattgagctgcctttaatgaaccctg

SEQ ID NO: 56155 - DNA, 589 bp, Triticum aestivum
  Clone ID: PAT_TA_56155
catttcttccaaccgacggcggcaaggcatggcctcgaagctccccgacgcgaccaagggcctcggcgccggcggcatggacgtcgaggatgggagcggtggcggcggtggtggtaagaaggtggccggcaggtggcccgggttcgttcatttcttcttcgtgctcaccgtcgtcacgtgcgcgctcgtctacgccccgcgcttcctctcgcccaccgtgcccgtcgacttcttggggccgcgccagccgtcgtccggtagactccccgtgcgcgtcgacggtggccgcggcaatgaaggcgacgcgctggttctcgacaaccaggtgaactccccgtgcgcgtcgatgggcgcccacggcatctgctgcgaccgctccgacttcaacaccgacgtgtgcttcatggccggcgacgtgcgcacggacgccgcgtcgctcttcttcctgctcttcccgccgcaagcgcccaacggcaccgccaaggacgccaacgccaccgtggcggagaaggaggaggtggtgcggccctacacgcgcaagtgggagaagcacctgatggccaacatccatgaagtgcggtttcgcgcg

SEQ ID NO: 56156 - DNA, 653 bp, Triticum aestivum
  unsure (1)..(653): unsure at all n locations
  Clone ID: PAT_TA_56156
cttgtccccgtctcctctctcctttccccacccaaaccaggagcgccctccctcccccagccgcccgccccctccccacccaggaaaccagccatgaagggggccaaatccaaggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcgngtggtgtcataaggagcctatcca

SEQ ID NO: 56157 - DNA, 451 bp, Triticum aestivum
  Clone ID: PAT_TA_56157
ggctggcgaaagcagcagccagcggtggatcggtcatggccatgggaggctacgcacgcgagggctggcaccgcggcgaccaactgcggctccagacacgccagatcttgcggcctctgcctcagcgactacatgtgggacggcgacggcggcatgcccctcgcccaccgcgccgaccttttttcaccctactcggactcacgcccacaacaaccctggcggaagacacggccacgggctgatccggcctggcctgataacgactccgccagctcctcttcttcaccaccaacaacagcaagggatgacgctgcaaaaccatccacttcccatgatgagtccacgaccaccacaaatcctacagatgcgaccactcgctatacagggaccagcccaagagaccccgcaacatcgacatacctaactaagcacgaagacttacacgcccaaa

SEQ ID NO: 56158 - DNA, 584 bp, Triticum aestivum
  Clone ID: PAT_TA_56158
gatgggacggcaagcgagccgcctgcggcgacgccgccagccgccggccgggatcagcccgaccacgtggccggcgtcttcagctgcatgctgctcaatggagtctgccatcatgcaaagcccgagcaaattgcctgacccatctgtctctactcccccaagagtgttggggcaccaaggttgggctgacctcccagataaactgcttcactgcattgatcctctgtggggatctttgctcgaccttatagacgttcgctagcacctgtgggtattggtcgtgctggcttctcttcgtacccatccaaatcgaccatatgcaccaaactcccaacttcactcgggcgaccgaatctgtgcgtcgatgcccctaatttactttccatgaatggtcggcacaagctacacacatggaaggtcattgatctggccaaccagaacagcatccctccggtgtcagattcctcaagaaactttttagaggatgcgttctgctggctcttcactatgggcatctcatctgctgctcgacgaggaaattgccttgctgttgatgcgttcactggagacgatgtttcacttgc

SEQ ID NO: 56159 - DNA, 538 bp, Triticum aestivum
  Clone ID: PAT_TA_56159
tttttctttttttgacccaatcgaatgacatatattctggctatcacctagtgcttaacaattaaatacagggacttcagcaccatcttcatagatcagaagggcctacgtaactcttcacataaaaccacagccttagatcttcaaaacatcccaaatcttggtgttagataatccaaattgtgccacgtacctcccctttaagagcgaatccccaacccatttataattcagaacccctccaccaacagtaaggacacatgggtgatacttagacaaaaacaaagccctttttagaccctcttaccatattgttgtcaccgccccaccgagcacaaaacgtctgaaacagtacatcggtatctcttcagtcaccacttggtaaaactatttaatgttaaacatgatgctgttatgttcacgggtcacaaagttgatggtcacacccttcctatctaaccgaccattacgcacatttcaaaccaagtagtcctctgactcacctgggaggtcatacactattacaagggacacttgc

SEQ ID NO: 56160 - DNA, 457 bp, Triticum aestivum
  unsure (1)..(457): unsure at all n locations
  Clone ID: PAT_TA_56160
gacttgatcagaggacacacgacacctggtgtggcacttcaaaatgaagttctatacccccgaagggggatcttctttatgcccattatgtgtaccgccaagaccaaatggaggcttaaaggacaccatgttngaaccctgaaagaatttttacaataaggcttaggttagcatcatcctaattgttcttttgcttgttcagctcattctttgccctaagcagcagcgtcgttttccaggatccaggcgtgtcatgccgccaaattccttgttggcctccgtaaatttggcggcatctccgtcatccattggtgcagccagatcagctaaaggccttggttcacgagctcctgagaaagtcgggtcgtttttgctggtcttctctccaatgaattttgggtagcaacagcatcagctctacttgggtggctgatccctgcattggggaggatgccta

SEQ ID NO: 56161 - DNA, 112 bp, Triticum aestivum
  Clone ID: PAT_TA_56161
ttttgaatcgcaaacaaacaagcactccttgtatgtgataataagaagtacgctaccatagcgttatgtaactcttgggacttcttattatcacatacaaggcagtcacaag

SEQ ID NO: 56162 - DNA, 588 bp, Triticum aestivum
  Clone ID: PAT_TA_56162
tttttcgattcaaacagcaacattactattgtttcaaaaccacaagcagcacaatacttacaaaggtagtgacattgtaccgatgccggcatcaaaacatgaaccgagcaaaaatcctaactgcccaggacgaggcaaactaggagaccgcctagctgccctaggagacagtgagcttggcgagctccctgctgaggacaaacgcggactgaggtcaggctctccgggaacgggatggccgacttctcgactatgcagtccaactggggctaatcacgcgggagcttgacaaagatatgtggcatgaatggaactatgattgacatcatgcttgaaagatatgccaacgtaacgagcgcacccgttcaagaacctacatgatgctgactttgcaccggtgcccctcttaatagccttgataatactcgtagctgcatgagcgatctgcctaacgcactgccaccttggacgccggcgcatcttacttggccttcatgttcttacccaacatgaagtagttcgcggccttcttctacaacccttgcgtgctatgtgtgcatctgatccaatgcattaatacctgcgcgt

SEQ ID NO: 56163 - DNA, 503 bp, Triticum aestivum
  Clone ID: PAT_TA_56163
tttttcaatttagtgacaaatcattgatcactgaatgcaaaagcccagtttctagaggtctgcacggcgcttgcttacaagacagtatctaccatgaataaaactggggctcaggaaacatgttgaccctgcggagaatgcagggcgcctcgcggacagatctaaccatccaaaaaccctgcatgtcaaagtgttgcgcttctccagcaatgacatcaccatgcccaaacacatcttggggtcttgcaaagtaatgactaacacgatttcccacacgaaacgcaccgacgaatagctggagagttggtgggtactgaaagggctggtaaatttgtacctgcggcaccgagaggcgaggcgccggcagctcggagagtggcgcggtgcagtccgggcagacgtgctccggacagcaaaccagcccgcactgcgagcaaaagaacagggcgtcgacgccacagcctgcccgctggcatctggcgaacggtagacgctgtggatag

SEQ ID NO: 56164 - DNA, 600 bp, Triticum aestivum
  unsure (1)..(600): unsure at all n locations
  Clone ID: PAT_TA_56164
ccaactagaaagcctgcccgagactcgtcaagccagtgagtacacattacaagctcagcgcaaccactgccccgagactcatcgcgccagtgagtacacattacaagctcagcgcaaccaggcaaaaggatttggcgcaaggacaacacaaagcaaaagggaaccactgttgattggttaattccacagaaggacagcggggcaggcgctgaaaggagatgggtatgtacatttgcattgcgacttcacccctcacgctgaaggacaggtttggcgttccagaaagcatcaggcagggccaagaatcggactatccaccatgacagaatggcgagcaaggtccgagtcaaggagccttcctccggctgctgctgctagggcttatagggcccccttgtctgcctgaagggtacttgtcctggccccttggcgaagtgatgccnactggtagtccctccgggcatcggacggtgaggagaaccagttttcgtgctctgctcggcctccagttgtttatgctcctccactagcatagccaaccgaagttcgttttctttcacacggtcctgaagcacagttatagctggggtcaagcagtac

SEQ ID NO: 56165 - DNA, 125 bp, Triticum aestivum
  Clone ID: PAT_TA_56165
ggcacctgcactatacactgcagatacatggtttatgccttattttctcaacacgccgagacggcagaccaaaagcggggtacaccaaacaggcgggtttttaggaggctgtgttctcttcaaaa

SEQ ID NO: 56166 - DNA, 498 bp, Triticum aestivum
  Clone ID: PAT_TA_56166
tctgtagacactattttttttttaaaaaggcttagtcttatacctacgtacctacatactatggcggcacattattgtaccaatgctaaactagggcttgtggtgtgcattcatatacgcacgcatagtataccatgacctggggggtggcatacatggattagcccgtgtaaagtgcaaatccctatcttattaacttacgtatgttttaccatcgtttcaatcgatctggactttaaactagttcgtgcgtatatgcttctatggcttgtatggtgctggtctttgctaaaaagcgcgtccctttttaggatggtccatgcaccattcagacggccataacccgcttttgtttaaatatatcttgaagggcacaaagcctatgcgattgttaacagcatccggaaatcttgcccagcactctgactcatgatagctctgaaagtgcacatgatacatggcttaggagatctttcttgtttccacccgtacttgtgc

SEQ ID NO: 56167 - DNA, 561 bp, Triticum aestivum
  Clone ID: PAT_TA_56167
atcaacagttaaagtggactttgaatgttatcatgtaaatacccctgtcaatggaggcagatctgactcaccatatgaacaaataacgttcacccttccggccaactgagaaacaggtatcctgtatgaagaacacatggcatcacatattcaactggttcaatcggacttatgcatatatgaggctcacaggcgacgcggctttttcttacaagaaaaggtcagactcaaaatatttgcctgtcaagagaaaccatctaatatgttgcaggcgaccttatgttttctttccgcatataatcaaactctcaatccaccggacccaactactgattgcggtacatgacctgtggttctgcatttgcttgttctacatcatgataatctgacatgagtcctattgacatggcttgatttgtcatcacacagacatgacgctcattgatgacggctcatctgtgttatcagtcttatgcttatggcaagcaagggctccatcatgttagaaccatcgcccccctttcttgacagatttcaactacatcactaattgctccctgt

SEQ ID NO: 56168 - DNA, 488 bp, Triticum aestivum
  Clone ID: PAT_TA_56168
cttagcagaaactggggcttaactagtcaactccaacacagatgagcaatccgtagtcaattacatatccatacagcgcatcaaccaaacaggaaatcgactacaaataacctggcaaaagctcgagtcagcaccgattgcaaccctaaacgcctcctacagtgttctaaagcagacggatgaaactaactgcagaagcttaagcttgactggcacgatgaaaaagcagcttttttgagctgcctaagtctgttggaagtgatagcttccgacaagaagctggctgagcaacacgctgtagttgccccatcgatgatcactggccatcggaatagaacatgcttgggtacacccagaaggcctgaagctggccgtaccacattctcttgtacacaagatcagggtctgtggaaggaccccacgcaggatctgccgtattaccaaatccatgtgcgctccaaggctgatagtaatgggcgtattacaag

SEQ ID NO: 56169 - DNA, 591 bp, Triticum aestivum
  unsure (1)..(591): unsure at all n locations
  Clone ID: PAT_TA_56169
ncatagtagnaaatatttgcacaccggaccggagnaatgcagacgcccaagctagccatcttgctcgccctagcaacctttcccaggcgcagaactcgccgcaggactacctctcacctcacaacgctgcccgtgccgcggtcggcgtgggcgcggtgagctggagcacgaagcttcaggggttcgcccagagctacgccaaccagaggatcaacgactgcaagcttcagcattcgggcgggccgtacggggagaacatcttctgggggtcggccggcgcggactggaaggcggcggacgcggtgaacgcgtgggtgggcaagaagaaggactacgactacggctccaacacctgcgcggcggggaaggtgtgcgggcactacacacaggtggtgtggcgcgcgtccaccagcatcggctgcgcccgcgtcgtctgcaacaacaacctcggcgtcttcatcacctgcaactacgagccccgcgggaatatcattggacaaaaaccatactaactgtgatttgattgtggttgtgaagcctttgcacattttagccttggcgtcagcccggtggtgattgtttgagtttctt

SEQ ID NO: 56170 - DNA, 515 bp, Triticum aestivum
  Clone ID: PAT_TA_56170
atgattcaaccatccaaccgaaagcaacagagcccaccgatccgggcccgcgcccttatcttacccaacggtctgcccgaccagcacggaagacagcacaggctcatagtggcgcgctatgtgtataaaagatacagataggtagccgtgacgtgcggcccatgtccggtctggatacttgcccataaggagagcgcatccaccgaccactaataccgagtgcgctgtcaagcgggttgcgcgtcacgcaaaggttgatgtacgtcaatctgtggcacaaggacctgctgaacctcatccagcaattagttctggtgccgcccatggctggaagctctatcgtactggtgtacctcgtgccctgcgagctgctctcactatgaagagcactacacatggacaatcagaacattcactgctcttattccgtggctgtttgggagtgcaccttgtactcaattacggcgttcaggggccggtcggttgcatgacactgttgatataatgctcgaaga

SEQ ID NO: 56171 - DNA, 653 bp, Triticum aestivum
  Clone ID: PAT_TA_56171
ggcatgctgatatttttgagttccttgatctgagaaagaccatggcaaggaggagaaccgtgcaagggatcttttctttgctctctgggttcctgatctattcatgcaaagagtacaaaataatgaggattggtccctgttttgtcctaatgaagctccagggttggctgattgctggggcgagaagtttgaggagttgtacaagaaatatgagaaagcaggcaaggccaaaaaggttattccagcacagaccctctggtttgacattttgaaggcacagatagaaacgggcacaccttatatgctctataaggattcatgtaataggaaaagtaaccagcagaatctgggcacgatcaaatcttcaaacttgtgcactgagataattgagttcacaagtcctgaggaaactgctgtctgcaacctagcatctattgctttgccacgttttgtaagggaaaagggtgtcccaatagagtcccatccatctaagcttgctggtagcaatgggccaaaaaatagatactttgactttgacaagctaggcgaggttacttcaactgttactttcaatctaaacaaaataatcgatatgaattattatccggttgaaaccgcaaggaggtctaatatgcgacacaggccaattggca

SEQ ID NO: 56172 - DNA, 468 bp, Triticum aestivum
  Clone ID: PAT_TA_56172
cccacacccaaacctaagtcggaccagtgaaccgacgcccggtgagacgtgccctacccgcgggaagccatgagtaaattatcgtactcgaccacatgaatggaggacatcatcccatagtgcgtgcgcggcatgtctaaggaaggaagtaacaggcatgactcaccagagcatcatgcaaatctcctgcatcagggctgaagtaactacgatccgcaaaagccaagcgtcacatcctctccttcaacctggctcacctccttagacacacgagcatgatgcggatgctccgagacgaccaaaatagagtaaaagcctagaagattgatcttgagtgcatggctgttgaaactctcatgagctcatcataacacgtagcttgctaatatgattgcctataataccatgctttttcttgctccgaagctatcattaaataaatttcacatctacttgtacctggtctca

SEQ ID NO: 56173 - DNA, 645 bp, Triticum aestivum
  Clone ID: PAT_TA_56173
cccatccaccacctccgccgccaacaccacacctcgagagtcctcgtcgccggagaagtagcaagcaagatggccggaaggaagggaggcgacaggaagaaggcagtgacccgctctgtcaaggccgggctccagttccccgtcggccgcatcgggcgctacctcaagaagggccgctacgcccagcgcgtcggctccggcgccccagtctacctcgccgctgtcctcgagtacctcgccgccgaggtccttgagcttgccggcaacgcggccaaggacaacaagaagaccaggatcatcccgcgccacctgctgctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaccaagtcgcccaagaagaagaccaccaccaagtcccccaagaagaaggtcgccgccaaggagtaggcgccccgcccccatagccgagccagtgttgcttagatccatttctcatggactaaaaagatgagatcctgtatgtagtctgtagtgcccgtcagattcgtcgagcaagggtgacattgtatctgttatctg

SEQ ID NO: 56174 - DNA, 668 bp, Triticum aestivum
  unsure (1)..(668): unsure at all n locations
  Clone ID: PAT_TA_56174
agnaaaagctaggcagacagcaggtccagaatcaacttgtttggaaggccgtagttattctagcaggcaccaaggtacgcaatcgcagtcatgcagggatcatgtaatgaattcttcgctggttacatctgatggctcatcaaatccagtattagagcccacaagtacaagcgaggattcttcgctgttcagcagttctgatgtagggtcaagcggcaatttaagcagcgataacactgacagcacaaagaacccaggaagctcggaccaaatgcacccagtaagcacagtggtgatgcccgaggagcattcgcggcagatgtccagcttgaaccctagctcttcaacccagtatgctgatcaagctgaggttgacaggctgcaccagctcaagcatcaggcaagcaaaggggtttgggatgagggttgtgagaccccatccttcttctatgttgaccaaggtaaatacccgggtagtattagtagtagtgacagtagcagcagaagtaggcgtagtattaacagtagcagtagctgtaatttaacaggacagcgtaattgtcggatggtaggggagattgatcatggccctggagagggccagggccattntaagtagcaggccgaatgggccaagcatttttgttggtacagagggcttgggctgt

SEQ ID NO: 56175 - DNA, 564 bp, Triticum aestivum
  Clone ID: PAT_TA_56175
gggttcgggtaccgagagttgctagtcctagtctacggttatccgtgacttcggcagaggagcagaaaggcgagagatccatgcgcggcgtacggtactaccggcgtgcttgcatggcgctggcctcagtctgggctcgacctacggaccacaactctcgcagccatgtcctatcattgcattatcggttgatgatcctgcgacggcccaggatcatccaacgacacgcttaaactggtcaagatccactggccttcggcattcgtgacgattctgcagagaggactcaatgcgccaggccatcgacgcctatgaacgcaaaggagctcgacgggcgcaacatcaccgctatacgaggcccagccacggctgctcgtgcgtggctgtcggttgccgccgctgctgactgacctcgccgtggaatcctttgctacggtgtgcgaggagttggcttcggcagctcttattgtggctgatgctgacagagagacggtgcgtgttctcgcgatcgctggtgttgagtctgttgccatcgacgaccgtcgtcttgcggatacttcggac

SEQ ID NO: 56176 - DNA, 646 bp, Triticum aestivum
  unsure (1)..(646): unsure at all n locations
  Clone ID: PAT_TA_56176
caaaaacagtcgaaatgccaaattcatgcaatatcatcatgatgaatactatcaaaataacaagcaccataattcttcagctcacattgacaacattcaacaatctgtttcattcactgctgccccctgtgagactggttatggtattcttccagtcaagaggaagctccatgctggtctgggttcgatgagccgtaaagatcttctcggcatagcaatttcaaaagggagaagactgaagcatgaccaattcatgatcagtgataggaagctttatgctgtggagatgcacaattctccaaaggaaactgttagagaagccatttatagtttcagtgatatgagagatagtaatactatttcaaacattcacgatgaaagaagacatgagcacatgaatattcagcccaaggacacagctagcatccgcttgaatgataggaaaagaaagtttaagctccaaggcaatgagataaggcgagttgaaagtgacaatgagggatgtcttcctgcagacaagaatttgcacagttccaaacacaaggatgtacatcagaaagcacagaaggtgaaactgaatagaagttactatcagtcagtctgccagggcttggagaaaacaacanaccanagacgccaaactacc

SEQ ID NO: 56177 - DNA, 512 bp, Triticum aestivum
  Clone ID: PAT_TA_56177
gtgatatgagcagacgataaatgtgccgaggcaacggttgatagcacgtgagccgtacgcacggactgaggatgggacactttctgcaattggcctaaaaccgcaacccctggatagactgaacagtatacacagataacatgagaccattatctcttagcacatatacggagacaccagacagttggagaagaagataattgtcacaaactataaagactcacagatgcatttgctaagagacctaacttttgaaagcacagatagagctacggagaagaatttaattagagttccaaagtaaagccaagctgacgaaatacaacgcagggatgaataagaaacgcatgcttaacgcacagaagaattctcatctcgagacaccaaacagctatagagaccagagtgagctagagatgatcaatacgataggtatagggataacgattacatctccaagaggctgataacaataccttcgtgtctcagaacagattgcacctattgtgcgt

SEQ ID NO: 56178 - DNA, 660 bp, Triticum aestivum
  unsure (1)..(660): unsure at all n locations
  Clone ID: PAT_TA_56178
caggtactgcatcccgtagcagttggtgaagtccgagaggctgccggaggtcttgttccatgcgaggtccagnccaccggaaagacaaaggctggcacccaccatccagcggaggtcgtcatctctggtgatcttgttgcgggacaagtcgagagcgtccagggccgcaaaatccctgcccgccaccgtcagcgtccttggcaacacataccgcatcaccggacagattcaacgtcttgagccccccgcaggagccggccagcacggtcacgtcggcaaaggagccgcgcagcacggaatttacagagaggtcgagcaactcgaccttgctgccgcacctgccgccggagcacatcgctgacgttggccctgcggaggctgagcctctcaacgccgcagagctgcagcagggtggacgcgacagcacggaagtcggtattgagcaggacgtcggagagcgagagcgagagcgacgtacgtcaggcgcccggccctgcacaccgcgccgggaacctgcaagcgccgtcgcgcgcggtccagctgtctagcgacgcctggttgagcagcgccgccttgaagtcgtccagcagctgtgtgtcgtcggcagccgtcgccgtgaaagatgccgacgctatatcgccaactgcacgnaatccatgt

SEQ ID NO: 56179 - DNA, 562 bp, Triticum aestivum
  unsure (1)..(562): unsure at all n locations
  Clone ID: PAT_TA_56179
ccctaatccaatcccgatcagagcgcggcggaccgaccgcctactccaatccaccactcttgattccgttgcttccaaaaaagtcctgatgggctgctcacatggtagcgaccgtactctagatccatccgactccaggatccgaggcggcagnagcagtgataccaatgcctatccagtactgtacaccggatatcatggtagcaggggtgacctgaccacgatgcgaatccatgccatgcccgcaattgcgatgacgcagcagtatggctcacattgcatctagatcccgtggaagtcgcgcgtcacggcatgagacatcgtcttcgaaactgctacctgtgggttcataaggaagtaatcactcttcactttctctccagccattcatggtggatgatgtgcgccccttgctgtcattaatggatgactggctctatgatcctcattcttccgatgtgtatatatgctatctctacactcactattctaactccggcgacagatcatccatcagcatgctgctcttctaggtattgctcaaactggcatatggtcgatc

SEQ ID NO: 56180 - DNA, 658 bp, Triticum aestivum
  Clone ID: PAT_TA_56180
gctacccacgtccccgccgcagccccatcctcgcatctcccctgcccctgccggattagctcgctccgatccggagacccaagcctgaaggtgaccttgtctgctgttgttgccataacgatgagactagagggatcagtggtagcatagagctctgttttctgtttatacttggtgcaactggaagcagatgctgctgcgttgcgcgcctgctatatgtttgcaacgccgcacctataccatgtattctcagcctagccagttacaaggaggattgtcacagagcatggccttatggaagcattctcgctcacatgcagtcagttatcaaacaaaaatgggtttagttagtctttctcctaagagcacaacatcatctcatctgcaaaatgggacatgctttgcctgcttggagcaacagtctaaacacggattatcagcgagagatcgtatcctacatgctaagcttgatatggcctcacatcacgggttttctagtattagctggaagtcgagaacgacgagaagtttagcacaaaaaatagggggtacaggcgctggactttccttgagtttcacagttgctgggatagcaaatgctgggggtccggtggataatgacattgattccaaatcatcctctagttgtgctcatggg

SEQ ID NO: 56181 - DNA, 492 bp, Triticum aestivum
  unsure (1)..(492): unsure at all n locations
  Clone ID: PAT_TA_56181
gnagcggccgagnaatacaaaatctgtagcattcttggcacaccaaatcagcatacttgggctggaggactgcagctggcagcatctatccattttcagtttcctcagtctcgatgcataagtctttcagaagtggttcccacagcaagtgaagatgcgctgaaccttatttcgtggctttgctcatgggacccccgtaaaaggccaaccgcagtggaggttttgcagcatcccttctttcaggtcataatatttccaatgtctttgcataccacattgatgatgcgttgatttggttcatggacctgaccagaattgtttatgtcacagccatgcttctatgtccccccttcacttcgtttcagatcgaccggatatgcaacaacaccaccatcagttggggctaaaggggctatggaccagaagaatgctaggagataccctgtggggactntaaccaacgggagaccggcagtcaataactcgtacctg

SEQ ID NO: 56182 - DNA, 622 bp, Triticum aestivum
  Clone ID: PAT_TA_56182
acaaccctgacaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagctggaggccctgccaaagttcctcaagatggtgatgctggcatagtga

SEQ ID NO: 56183 - DNA, 485 bp, Triticum aestivum
  Clone ID: PAT_TA_56183
gtgtttgggtgttttttttttttgagcttaaacttattttctgatcggagtgggttttacacaatttacagaaggcgttgaaaggaatattgaagaggcgtcataatctcttgttgtgctaacatttattgagtgcactatcatggtgtctggggtgtgggcaaaacgtgtaatggttcaaacacattcagagaagtcgacgacgtcactggttgatcgggagcccgttctccttccaagcagaaaaccctccggcgatgtcggtcacgccactgaagccaggggagcaaagttcggctgctgccatgagagatctcctgccactctggcatccgatgatgatctcgtcctctctcctgaatatcggcgacacttgctctagaaaacccgagtttttcgccatcccagagcctttgctgtgcatgtaggggatgttcaccggtcctgccggatgcccggcggcgaactcaccctccgttctgacg

SEQ ID NO: 56184 - DNA, 311 bp, Triticum aestivum
  unsure (1)..(311): unsure at all n locations
  Clone ID: PAT_TA_56184
ancattcaaaccantttgataactccaaannaaacttataccncnanatcancaacatataatccanncaaacaccttntatntacattattatacttaaatctaaattaaacccacaattttctaacatcagcggtggtactactatacttccatcacattttcttcaatnaaaatcactnnaatnacaccaaacanatatattnctcatgtccaccacatacatanctcntcnaaaacacatncactttncaatcaggccaaancatcantaccctttntcancnnncccctnntantttctcctcctc

SEQ ID NO: 56185 - DNA, 532 bp, Triticum aestivum
  Clone ID: PAT_TA_56185
gttgtgtgttgcttaattgataaaaacaccgagctagaaaggaccgtatgtgcggcattacacattgatgatgaccaccatgggctctaacaggcggaacaagaagatcacgtggctatcgacatggtgagccctggctgtcccaatggagggcgatgtcagcctggtgcgactagccggcgatggccatgaacttcttggacagccagatgtccgactgcccctggggacattgctccttgggcacactcaggttcgatgggaccaccccatacattttgcggccgaacaagatgcgcctccctttacttgtctcgcccggcatgaagaagtcgaaaggacagccttatcgcagcatgtcccatgacgaacaggaacctggcgagcagcaaacgccgtaggttgcgccaaggccagtcccaaacagatcatctgataagagcatctgacaccgatctggatctgcatattcttctactatatgtcttgaccacaagtggaacgacatgaggtagacaatgaacgccatagc

SEQ ID NO: 56186 - DNA, 391 bp, Triticum aestivum
  Clone ID: PAT_TA_56186
aaaccccaaagcccagcgggaatatttcgaaccccttcaaaaaagcggggggaaaaacagaccagggtcccccacccccgaaaaaaaacccccgaacttaagccctggggtaaaaacatcccttgccccagggaacagatctaataaaaaaacctgtaaagaggatggggggcccacccccaccatgcgggggaacccagggccgattgccccccgggggccccttaaagggctggcgggagggcccaacggcaaagggggccccgggggcccccccaaccccggggggggcggccatccccaggaacccccccatgcccaagggccccttgggaacccggattttgtggaccccaagcgcccacttttccgggacaaaaaccatgcgggg

SEQ ID NO: 56187 - DNA, 185 bp, Triticum aestivum
  unsure (1)..(185): unsure at all n locations
  Clone ID: PAT_TA_56187
attatattcataaannccttnnatccatttattncccaaaccatacnncanncatccacacannnnaacacntaancntactanncttaatatancacacacacnatacgatgatggacnacacnacacaaccnaaacaacaacttattcatcaccaattctctctcttntnntcntacacacac

SEQ ID NO: 56188 - DNA, 504 bp, Triticum aestivum
  Clone ID: PAT_TA_56188
gctgagaagtaaacatgtagacgcggatatggacagccagtcgtacacagcacatctttagtcactcatgcgtcctgctagacacatctccttgtgcactaccttgaattagcggccatacagataggatgatataacgcactgtgtcctcaccagaagctacacaaggcagccagacttgcgcaacggagagccgcagggacccggctgggttccaaccaatagctccacggcggtgttcgtcacctcaacctggcgaacgcgatcctgggaaaaatagccggtactacattacctgatggctcagctcaagctggaaacaaccacaccagtgggtgttctcgactaagaacatggtgccacccatgcctaaaccaagcgtcctacacagcacacctcttgtagtggagatgtacatccactatctgacactcgactttcatcagcggtttaaactttcatcacctgcgagtgaacttggctgagctgaataaccatctgacc

SEQ ID NO: 56189 - DNA, 502 bp, Triticum aestivum
  Clone ID: PAT_TA_56189
ggtgttttgggttttttttttttttttttttttttttttttttttttttttttttttttttttttttttttttttttttttttttttttttttttttttttttttttttaaaaaccaccccccccctcccatttttccaaaaaataataaaaaggaaagaagggaaaaaaaagggttaaatttttttttggccaaaaaagccccaccccccccccaaaaaaaaaaaaaaaaaaggggcccaaaaaaaaaaaccccaatttgttaataaaaaccaaaaaaccgatttggtaaattaatggggcccccccccttccccccccacaaagggggcccagggggcaaaaccaggaggcaaaaggggttttaaccggccggggggaacaatctaatagggggggggggggggggccccctccttttcccctttaaataacagggggggaacggggacccccaagtaatggccctttaaaaaggcccgggtgcaaaacccccccccaaa

SEQ ID NO: 56190 - DNA, 428 bp, Triticum aestivum
  Clone ID: PAT_TA_56190
gaaaaaggacaggaaaacggaaagaaaaaagaaaaaaaaaaaaagaaaaaaaacaaaaaaaacaaaagggggggggaaaaaaaaaaagaaaaagaaaaaaaaccggaaagacaagggaaggggaaagagcaagaacggggagagaaaaaaagaagaaaaaaaagaaaacaacaaaaaaaacaaaaaaaaggaaaaaaaaaaaaaaagaaaaaaaaaagaaaaaaataaaagaagacggagtgggcagcacctatggcaagctaaggttccaccaaaacaacctaaacttaaaatgtaatctacttcaccacatcaacaaattcaaggactgacccaacgggagaaaccacacggcctgcaaaacaggcataatgctaatcctaatcctgcctattagcttgcttgacagtatggttggcaccatatta

SEQ ID NO: 56191 - DNA, 500 bp, Triticum aestivum
  Clone ID: PAT_TA_56191
ggttttggggttttttttttttaacttcacatacatgatgtcttaagtaatactggcaatatatcacctgaaacattacactcatatttggctcagaaaatgctcgggtttggggctaatgacacaacttctaacctttgggcgacaaaaggagtggagggtttatttattaatattcaagcactccaaggggctatactcaatcttattactggacaacttcacaaatatctacagcctcaagcttgaagctgtctcaagagtgctatgcaaaaggcgcctgccattcttgttcctctggcatctacaggggcttccacttctccagtcctggtcttataaaccgaactaatcaaagtgcttaagcaaacttggcctggaatgtagcactctcaatggccacctcctgctgatcggtgttcctaaggtcgtaactaaaataggtcctactgatctcttccaacgattttttaacattactgtccccagactgaaccaag

SEQ ID NO: 56192 - DNA, 412 bp, Triticum aestivum
  Clone ID: PAT_TA_56192
gggacaaaccgaaccgggcttttgcacaaattttttggaatttacatcatgaaaggccaaccgggggcacagggaaacatgccttattgggggcccaggcccaaaacaccttacttggcggggacaaaggggggggggaatgcccatgccttgttgttgacgggggcggcgatgggggcaacgagggtttaaagggggcccttgcccgggacaatagcttggacaaaaaagccaaacattgaaaacatgggaaggggaccggtcttgatctccttcaccttgagctcgggaaatgccccaggggcttcggccaaaccaaaaggggcaaaactcccccctggggagaggggggcaacgatctcaccgagggggccgccgggaaaacgggaccccttgacgggacccatgagca

SEQ ID NO: 56193 - DNA, 499 bp, Triticum aestivum
  Clone ID: PAT_TA_56193
ttttgattactcagatccagaattatctgcctgatcaggttgtgtacgtgcgtttttatagaaggaagttaaaatgagagggaaatagatggacaagatttggctaagtacacatctgaatctcgacgtttgcatgcgatacatgcagcggaggatgtggccgtgggttgttgagatccgctggaatggcgtgacccggactttttgcagctccaggtgctcagctacctgtgagtctgacaagcgctgctagtatctgggttcggcgtttcctggtatatgcagcgcttcatagtggccacagccatgatagaggacttggattgggtcttctttcccgtactcttggccatactccgcgatcgctatcaaaccacccgctgcttcttcgtgcatataaacagtgatcggcatctgaagaacgtgagaagccatgagcaattctggctctcctccccacacatgtggcttccttatctgagagacatatgtatcgaaa

SEQ ID NO: 56194 - DNA, 502 bp, Triticum aestivum
  Clone ID: PAT_TA_56194
ggggtggggggtttttttttttttttttttttttttttttttttttttttttttttttttttttttttttttttttttttttttttttttgggggcaaaccagctgggggtttcaaaaaccgcccggacaaaaaatgaaatagttcgctgaaagggggggggccaattcggggtttaaaaacccggggacctagagccgacccaactgggaacaaaaaacccaacaggccctcccctagggtattctaagcagcaaccccctttttgggcttggcaagcccttgcctgaaagcccccccccttttaatcttagccaacaagaccctgaacccggcaaaggcattcaggggggcccttttttttgggacaacaagctttttaccccaagagcgggtcccccattggggtttaaaaatgggttcccccatggccctgaacaaaggggcctttttagggaaacccctgagggcaatcttgatggcgggcaacaaaagacccttga

SEQ ID NO: 56195 - DNA, 473 bp, Triticum aestivum
  Clone ID: PAT_TA_56195
cgtctattacaatcccacgaatactcaggagggactcatttacacgcataccaccactctagtcagtggcggtggcatagaagcggggaacgagttctttctactgactccacctcaagatgactctctgacggtccggctgtgccggcatgatctgctgtgacaactccggctgcggttacctgcgcatgatctggggctagggtatcggtgcactttttaaccggctcactgacagctgtgcggacatgacatggctaacgacaccggatagatacaaaagactatgctgtcgcaataaagccttgccctgtggcaatacagccacagaacaatgccatggaggctgatccatcagagcctttctgagatggtaggactactatcatgtgaacgttaatcgcaagggacaatgaagggatccaagctctatgtgctctacgcaaaggaggtctacgagctatggccactta

SEQ ID NO: 56196 - DNA, 639 bp, Triticum aestivum
  Clone ID: PAT_TA_56196
gtgccgcgactgactgctggcaaggaggtggtcctggtactcggccccgggcgcgtgcactggcacttgcactgagcagcactcgtgctggggtttcgtggaccagagcaccgccgagcgtactgtgctcaaggtggtgtgcgaccacgcggcgccgctgctgttctgccactgcaactgacgccgctgctgtgcatgcggcacagcgagcaatgacagaccgtttgcgtcaggcacacggagcgtgcgtcagtcgctggccgggcacatgtgaactggcgtcagactgaactgccgcgcgcgatgcggtctgtggcagactaacactctgttctggacatatgccggcgaggtgcgtcggacgtgccggtcgacgccggctacagcgtctggtgtggccaagaaggcagagctaacattgctgaacctacacgtgggacgccccttcagcaacaggacactacacgacatggcttaggggcgctatggaggacctcgaatcgcgctgcccctcgcgttgtcgccatgggcgaacagtcgcgtgttgatcagctgcgacctctgcttcctgaacgactttaactgttagcgctcgtttgtttctgttagccttgtcatacataagccgcgtaatacgta

SEQ ID NO: 56197 - DNA, 643 bp, Triticum aestivum
  Clone ID: PAT_TA_56197
ccttacctctctctgtggtagcgactcggaggcgccgtgggcggtgcaagatctgggcgagctcggcaggacgacggcgttctccggcgtccctcttcaccgtcgacggtattatcatcagtaagacccccctcctcatctcttcccgtatcctcctccatgaacttctgaatttctgggattagggttattggtttttgggagcggtgctgggaaagaggaagaagaccaaggaaaggaaaggaaaatgagaagctcgggtgatggaggtaatgctggagaagggctcctggcggtgggatcaattctaggaggaggtggagatcatagcagaggatatgaaggccgtgtggatgacatagaagaagaggaggagctcaaggctgcggagaaaaaggacaacagtagagtatcagacttccatctagctgagatcaacttttgttttcacgggacatgttttcaagctttgggtgcctgcggccggctcgacgggtggcatcagcaagcgccggccggcctcggcactgctgttggtggttatatggtgggcggagcacactagtgggcttcaacgtcaggatgcaccagcaacagaacatgaagaatgttgtggcgaggtgagcgaaatctggcagattgc

SEQ ID NO: 56198 - DNA, 587 bp, Triticum aestivum
  unsure (1)..(587): unsure at all n locations
  Clone ID: PAT_TA_56198
cggccgcggtattccccgggcgcgccccacgcgtccgccgtcgcgtgggcctcaaaacgccccattcttcctcgaaccctagctccacgctgcccgctcctcacgcctataggcgccgccagaaccgccgcgcccatggctaagacgcgtcccgcccacaaagatcctatcagccctacaccatcaaggggtccgacaaagatcatgcacgcctggggactgtgtgctaccgtagatcagctggtacataaaacccaccatatgtggcacaaagtaccgacacttgaggcatcaggagtcttgaggctcaaatgagggagtacggctgtcgatggtacaactcggccaacacgaatgcgacgagtgcgaggtacaacatatatgaggaccncaactaggtatttgctctatgaccgacccgaagaacgagctggtcgtccggagcgaggggcaaanggcgttctgcgctggaggcttgcggcactcctcggtggatcagatcgactgctgcgaaatcgacatgtggnggtggctttgtccaagcagntgttgcctcgtctgnccctccggttcggtgaccctcgcgt

SEQ ID NO: 56199 - DNA, 492 bp, Triticum aestivum
  Clone ID: PAT_TA_56199
gacgagctctttgggcgggcgccatgcgggagcaccactttccttctctgtctagtcagggcacggccatggcgtgctggcagcgtccgacgctgtgcggccgtgctacacagggtcatgtgcagaactacgaccgaaggaggtgaatgatacaaccactgtgggccatgacatggggggcgtgatcatggccacgaggtcactgaccactggccggactggggtgcttgaaccacatatgagctatgctacagccaagccgcttttttggtaataatgccttatgatttggctgcaatcaacgccctttttttgcttaaacatacttgctgacaaggagatgcataagcgccaagatgtactttgcaacttggaatctaagacagggctgatggtgtcagggatcaacgtgtaagactctgccgaaagggaggatttgcttattcagtgtgcgcaaactgatgataatatgagcagggttgctacgctgga

SEQ ID NO: 56200 - DNA, 336 bp, Triticum aestivum
  Clone ID: PAT_TA_56200
ggtccgccatttccggggcgcgcccccgcgcgcggtatcccaacctctcgtctcagactaccagcactgatctgccttcggatcgtggcgacggtggggttctcccgcttgctctggctatttcggcgaccatctagagctccatacggcctgcttgtcctgcctcctcctctgggactccttctggtcccccagcgtcgcgcacccccgtgctcagagccccaatcctctgtacccctcccgcgtggctcgacaacaacagcaggggcggcatgaacggctatggtctcgaaatgcccctcgcttacgatgtgtcaaacgttcatctgctgaaca

SEQ ID NO: 56201 - DNA, 627 bp, Triticum aestivum
  Clone ID: PAT_TA_56201
gcgtgcgggcatttccttcttaggtttcagttctcctccgactgcggactccagagctcgccaaatggctgcccacaggttccaccagttccagctggtgggtggcgcgctgtcgacccccggcgatgagcagcgcagtatctgccgtatgaagctttggtccaccatcgaggtccgcgccaagtccaagttctggtactttctcaggaagctcatgaaggtgaagaaggacaacggtcatattcttgccatctacgagatctttgaaaagaaccccacctccatcaataactactgcatctggctgcgctaccagagcaggaccggatgccaccacatgtacaaggagtaccgcgacacgaccctgaactgcggcgtggtagcatatgtacactgagatggcgtcgcgttacctgatgcgtgccccctgcatccatatcatcaggactgcgacggtggacttaaagctgtgcaagagggacaacacgaaccatgtacacaactccaagatcaagtgtcccggtgatgtaccagaatgtgcgcccacccacccgctagctatagaccacctacaaggcgacgaggtccaacctgttaattgtgagtcgggtccctactctactggtc

SEQ ID NO: 56202 - DNA, 317 bp, Triticum aestivum
  Clone ID: PAT_TA_56202
gactcgcaaccagcaacaacttcttagctataacataaaatctttacaatggctaacatgccttagttcaccaaacaggtcacacacacttgaaaaaacaacaggagatcaagcacagggacacaacggccatggggttttcaatgttttagttcggcggtacagaccagcaaagccagaaatggagacgttccgggcgttgcttattgcaggatctggcaacgctagtcctctatccagtccctgctgtgcgacccgaacccgaattctcctgcgaactctgaagctgcctgaatgtccatcgacggcaagcgcga

SEQ ID NO: 56203 - DNA, 585 bp, Triticum aestivum
  Clone ID: PAT_TA_56203
ggaggagaaagaaccactacgccatccacgctcacgttgctcaggagtgagaacacgaaggccgccggtcatggcgtgctttcagacgcgtccaagggctgctgatgtggtcgtcgtcgccgcgcttctgcttcaggcttgctatgaaggtggtcaagcatcagcgtgttccttgctgcagctgcatcttcctcggcatcacatgcgcaagatgctcagctccagtgcaccttccatgtcatcgagcgggtgaggagtgcgctcggcggagcctttctaactggaggagtgcggaataggatctgctggaggtgttccatgatctacgcgccgaccatggcggctcggcataccaacctacagcgggggacgcaccaacaagatgcatggattgtctcgcgtgccgggtacatgttagcatgcgtctacttcgacttaaatgatatcatctacccggccgagtaccaccgcctcaccgtcaaaaacctggctgtacacgactgaaaggcctttgagcccagcctccccgtgtcctttcggttcagaaactcctttccctacccgatcacattctcgtacgcctgc

SEQ ID NO: 56204 - DNA, 676 bp, Triticum aestivum
  Clone ID: PAT_TA_56204
gttgggcgtctcatcgcaggctcgccactgcgttgctcgactcggtaaatgggaggagcacaccaagctcgcaagctacagtaggaagcaatcaagcgggccaggaagcgctgactgacggccgcttggatccatgggctccccgcacaaaaatcttggatccatggacgccaagacgccgcttctgctgcttgtgacgctggccaagacgatggccgctcgtcagctccaggaagctacccagctggccagcgcttgggcgctcgtcaccggcggacatttccccttctcctacgccttgggctccgccatcttctacgcactctgctacctgcagctgctgtgccgcgattcatgcgagcaggaggacgtcacgcaccgcgccctctgaatcgggcagttgtactgcgccgcactccaggcggccgtggcggcgctggctctgctgctcccgtgccgtcgccgccggatccgccctgccgttgcctacctcgcggtcgcggtcgccatcgtcggccactgtttgctggccagcatcgcgcccctcgccgccgacgcaggactaggcttgctcgtccccttgatcgtctacgccgaggcggcgctggtgctgctactcccgtgccgttgccgacgaatctgccatgccctcgcctaccttgcgcttgcggacgcg

SEQ ID NO: 56205 - DNA, 557 bp, Triticum aestivum
  Clone ID: PAT_TA_56205
gccaggactggtacaactgcgggggggtacttctgaagttctgattctgaacccacccagatagctttgatctaaaaagcccaccctgctagcccagatgctactagcctatccatccattctgctgcacgaggactgctgggcttacttggagggggagagacacagttacgaggatgtgcttatcataacacatcaagataggtgcagctgcaggttgatctgaatgatttgtactaatagacataagtactactctcactcaactgaaagcaacatgtcataatctactagtttatcacagagtgatctagtgtgtattatactgactaactatgaaccatgtcgatccggaagattgtaccagctacatgtgaaaccccctgccaccgcttatcggcgaatacgacggcctttgctaactgctatcgtgcatgggccacatagtcatgcagagccaggcgccgtctaggacatccgagcccacagcacgaggcggtgccatggttccagtaccccatagtcgatgaagacgactactccgtggacagggacct

SEQ ID NO: 56206 - DNA, 656 bp, Triticum aestivum
  unsure (1)..(656): unsure at all n locations
  Clone ID: PAT_TA_56206
gggaagcagaagcttggaggaagaacgaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaaggcaagggtgccacagcttangctgaagagctgctgcatgttactcgt

SEQ ID NO: 56207 - DNA, 482 bp, Triticum aestivum
  unsure (1)..(482): unsure at all n locations
  Clone ID: PAT_TA_56207
attatacatcgacttactacaccccagagtctgaaactacagatactgcatatcttggcagcattccgagtaagtcctcagcccgctgttccgcccgaacaagcaggggctgcagtagctgcccaatcttctactggtacatggacaactgttcggactgatggacttaccagtcttgatcgttacaaaggacgatgctatcacatccagcctgttgctggggaagacagccaatggatctgttatgtctcttatccattagacctatttgaagagggttccgttactaacatgtctacttccattgtacgtaacgtatttggtttcaaagccctacgtgctctacgtttgccaggatccactaatttcccttacttattataaaactgtgctagagcacgcttatcttactcaacttgatagagacttggtgacctaatttatcantcaatcatgtttgatggaactatggtttttggatc

SEQ ID NO: 56208 - DNA, 639 bp, Triticum aestivum
  Clone ID: PAT_TA_56208
aggccgggcaccaacaaatggtcggcatcgttcggggctctctccaccttatctccccacagccgctctctctcttgtatcccccacttactcccccggggacgaaacatcgagaccgcttcggacaccgccgatgccaggaggacgaagctcgggttcttcccatgccgggcaccggcgctacacacccgatgttgccagggcgcctagcgcgccgccgttctggcaggatcgacacgttgtctcccgagcaactaccgcggccttgggccttcgcggcggcgggagctgcgacctaacgcacgcccccgtgaacgcggacggagtcatctgcagcaacatccagatgcacccggcctagtacaaaaccatcatctcgtcgttcatcatcgtgctcaacgcacaggggactccatggctgcttccggcgctgggcgccactactgctggggtgcagcgcctcaggcgcactcccagtacggcttgtacccaggtgctcacgaacgaggacaccgacttggacggcccgtgagactccgagctagtcaagacccttatctacctctctgggtctgccaccgtcgaggccgtcgccgacgaccgcctttgccccaggggggccgctaagggggaggttgc

SEQ ID NO: 56209 - DNA, 485 bp, Triticum aestivum
  Clone ID: PAT_TA_56209
gacactaccaaccagcagcaggtagtgcaacacatgatggcaagatcgatcgaccgaggtagctagctagtaaggaagagcggaagaagaataaagatggcggcaggcgacgtgtgggtgttcaagaacggggtgatggagctggagcaggaggcggctagccggaaggcgctggtgtacatgccggcgaacgagacaatgcggtctctggaggcgctggagcggctgctggggtcgctggggtgggagcgctactacgaggaccgagccatcgtgcacctccacaagcgcggaggcgtcgacctgatctccattccccgggacttctgcaggctccgctccatccacatgtatgacgtcgtcatcaagaaccgcgaccacttcaaggtcgttcgacctctacttagccattttgatcgtgtatattcttcctatgcgagccgcataattacctcgttccgcgccacaaatatatgtataccact

SEQ ID NO: 56210 - DNA, 507 bp, Triticum aestivum
  Clone ID: PAT_TA_56210
ttttatgacaaacaataaggattaagctgaaatcaacaatgagccaaaacatgcatcattgcattgattacggtacacacaagtacttgtgatgctccagacacaaaagtacagcataccttccagcccaagtgatatgataggcacccaggactgaaacaaatggcgactagtgaattttctaactatatcaaagagaataacttactcgaccttctatatcttggggccagcaccgccgctggcaaccggtgcgtcctaatgcatgcctacgggcatgtgagcatcggcaccctggtacatcttgggaatgatggggttgcagaggacctccacctccttcatcttgtactcaaactcggcaacctcaccaaggtggttggcgtcaaaccactggatcgcggagtcgacagcatcctcaatcttcttcttgacctcagcatgcaggttggaggcaatcttctcgtcctggatggtgtatcctcatgttgtaggcgaagttctcca

SEQ ID NO: 56211 - DNA, 435 bp, Triticum aestivum
  Clone ID: PAT_TA_56211
ttttatttcgtttcttttttagctataccgtaatgttcattatcctggggttatgaacacatcaccattgcttacgcgggcaaaactcgaattcgatcgccttacatactaaacaagctgcggccggtccaggactcccttagaggcgtggacgatgatagatcaccttacatagcaacaccgggccctgaggcacatagccggcacacaggtctgctaaagcccctcgataaggggccagcaccaggcgcatccccccaaggaagccctaaagttgccacaccaaccagcgatacacaataagcccaaaaaaacaccgtccgagctgctatatgcctaacatgaatacccgatgacactaccggtgtacacaccttgcaaggatacccattcctttgtgaaaaagagacctgaagctcgatccttttcaatcaa

SEQ ID NO: 56212 - DNA, 487 bp, Triticum aestivum
  Clone ID: PAT_TA_56212
agagaaagcccaataggttttgaaaaacaaaaatacatcagcgataaatacaggtcaatcgaatcgtatggttaatcctgtcgactgagatttcactaattctcagtcgactgagaattagcagacccctatttataagggatcaccatcaccattacatagattctataccacggcgagccaccgacgcgagagcggaccacattaggtaacttcacttgaggtagctgatgctgacgccgccaacggtgaccagctcaccgccgcacctgggtacgagcgacaccaccaccgtctggtcgtcgtccgccccgatgtcgtccatcaggtcgcacacgccgaacctcgccaccgtcttgaccggtcccttcctcatctcctcgggccggaccatgtgcggcgtatgcgcgaagctcccagcgcagtaccccgtcgccgtcgccggcgtgctgcccactccgccctcgggctcgttcaccaacacgta

SEQ ID NO: 56213 - DNA, 487 bp, Triticum aestivum
  Clone ID: PAT_TA_56213
aagagttgataaactaaacatacaagaacacctgctctgcttttaaaatccgaatgcaggaatttcaaatatcagagtagcagtgttttagatagaggtgagcataaagtagaacagtacagatagccataagctacagcgggggccaacaacgtcaaaagggcttgctctcatagtttcccctctcttgccacagccagattaataattatccaaagcacacacacaacagttttactgcttagctactaaaggggggtcttagcaacctcttttccttgctaatgcatcttgcaggagccatcatatcatcctgcgactcctcctgcgcttgaccactgtgagttcttgcacacgatcggccatgtactcagtacactccgttagggtggctttccggtccgccctgtagttccatagctcatagacggtgctcctgtcgcctaggcagttgtactctttcatctccatcagcgcatcgatgaca

SEQ ID NO: 56214 - DNA, 505 bp, Triticum aestivum
  Clone ID: PAT_TA_56214
gggtttgggggtttactatgcaaacagcattgcaaaattttgatattccatgccataccaaattgcaaaccactacacgggcaccactcataattccccataaactccacatctaatcaagatgacacctcaaagctacgcatgcactactcatggggtcgccgcgacatcaaggtgacagcagcaacaaacacaagcccgcactgctcgacccattattattattcattcaggaaaaacgaatcaaaaaaaaaaaactgccttgatgaaacagaggacggaaccgagccgacaacggactcctcggccatggaatagagcggaggggggcacggttcaggcctcaaaacgccttgagcatgtcctcagaccatctgctggtaaaggctccggcctcctttaggttaaacaccttgaccacaccgtcctcagacattagcgcgtatcggcgcgaccggacgccaatccccaccgggttgttcgacaagtccaacttcacgcccat

SEQ ID NO: 56215 - DNA, 492 bp, Triticum aestivum
  Clone ID: PAT_TA_56215
aatctggggagtagtattatctttaagggcctgaggctgaactttatttaaacattgaagaatttacatatcagctcaaagaaaacagagctagaatttacagggtcagctctcaagaaaaacagaactggaactctatgcgttgcctcagatagcacactgattacacgaccctccagggagaaccctatactccaatacactcacagcaaggagaaaaaagcaggaacatgattctgaaagaaaatgaaactggttagtagaaagcaaggctgcagctattctgccatctatagacactccacaatacaggcaaatgcaactaattttatttgttctaagcaggcgattaggtgcgcagaaggatgcatggcacatcatttatcaaaaatatgttttcttcgagaagcccaactgatttgctctgtgcctttgagagctgttgaacagcaaaatcaaatggaagagtagcctccggaagtcatgcgttgc

SEQ ID NO: 56216 - DNA, 502 bp, Triticum aestivum
  Clone ID: PAT_TA_56216
ttttctttatatcgttgtacagcataggataggattagaaattatttcattatcgcgcgtttattttgacgaagctttgaaacctcccttggggatcgcaacaatgtcctcctcatctgtatgcttcacctgacccaatgtgacggtgaagttctcctgatcaaagatggagtatactcccctcaggaacgggtcacccattgtgctcacaatgtcgccacgtggtgcaataaacgatccacaagttccatcatggaactgcgacacgaggctggaaagtgggacactgactttgccagcagtgccaaattcaaccgtgacatagccctttgtgtagctggggtcacggtaggcgcaatcgacagctacgtgtcgcgtcccgccggaaacttcgcctcgtcctccaagaccgtagtaggtagcagcaaagattttgtccggcatgtaccatgctgcaatgccagtgtcaagcagtaccgggagtccgacatctttctcacca

SEQ ID NO: 56217 - DNA, 447 bp, Triticum aestivum
  Clone ID: PAT_TA_56217
agcacttgaatttgttttgtaaagaacctaatcccgcacaaaaagggatttatcccgggcatcaacgcttacaccagccacaaaagaggccgcgcagaattccaaaaaaacacagggggggcgggcccccagcccgtcctgggcacaccggttcgaaccctattaacaacccccgtggagggcccccacgggtacagatcaagccccgtgcgcccgtgaaaactatcccggacacgcggggctctctagacccgccggtaggaccctcgattcccggcacggaacttgcaagccgaccaaaaaccgcgtaacggagtactgatcatgactccgcgcaattgggcttttccttagcctccttcttaacaggatttcctcacacatgcccgcctgttttccaaaccttgaaatatagggggttgattctggggcgggaaatgacagggc

SEQ ID NO: 56218 - DNA, 493 bp, Triticum aestivum
  Clone ID: PAT_TA_56218
ttttcgaatagagtagcagaacttatataaaagggaaccaggagagtattattatgtaaaatggatatcacagattccccagaactgacaacggtaagaacgtcgtcattacgattttggtcagaacagtcaaaacaatattgttccatttgaaatattatcttaaccacgatagccgccggagaattccttccgtttgaaatattggtacgttggctacacggcttgagaccttcgagtaagacaggcaacgactaggacagttctgaagacacatacatcaaggcgtcgacatcaaatgacctcacacgacgaatatgtacaccggccggtcagtcaacactaccgtacatgtcgccatcgtgagaagcacgcggatcagaagggcatatcctctttcgacaccgaatagactgccatcgcactagctactcccacagatgacagaactatcctttcatgcacaggaatcaaaacacatcagatgcgcacc

SEQ ID NO: 56219 - DNA, 410 bp, Triticum aestivum
  unsure (1)..(410): unsure at all n locations
  Clone ID: PAT_TA_56219
ggttttgtttttttttttttttttttttttttttttttttttttttttttttttttttttttnggacccccaaccagcaacaaccttcttagctataacaaaaaatctttacaagggctaacatgccttaattcaccaaacaggtcacacgcacgtaaaaaacaacaggagatcaagcccagggacacaacggccatggggttttcaaagttttaattcggcgggacaaaccaacaaagccaaaaatggaaaccttccgggcgttgcttattgcaggatctggcaaccctagtcccctgtccaactctgctccacgaccccacaaaccttgcgggtggacccccccttgttctccctggacattctggctgcttcagaggtcgcaggaaaattcgggttccggtcccccc

SEQ ID NO: 56220 - DNA, 364 bp, Triticum aestivum
  Clone ID: PAT_TA_56220
cacctctagcttgtccttaacgcgctgggtgggttctaactgaaataccatataggattcatgtgataaaacatccaaatcctaatgaacagaaagtaacacatacatccttgacaatcaaactagcgcaaaaccctggggcatgatgaattactgggataggacaatgtatttctggcagcaacaggaaagaagactatcagaggcagccatctcgctcctcttccttgcagtgtttaactgggggcctggcaactcctctgggaaatgatcctacatccacaactacaccgagctaatgaaacctggtcctaatgagtggctactactaatgggggcgtcctgccggttcactggaactgcg

SEQ ID NO: 56221 - DNA, 500 bp, Triticum aestivum
  Clone ID: PAT_TA_56221
ttttgtatagtactagtttttaaggaagctcgaccttttccctgttaaaagaaggacaaggtgttcagactagtatgtttttagtctgtcaagatcgctgcggctagctgttagaaccatcatttctattcacactttggctagtaaaaaataccgcgcctgctaattgtgtaatagtgacgtcacaggtgttcggcccctaaattgtgtcatcatgacatggtaaccatcaagataagggccgaactacacattttctagtccgccttgcacacttcgctttccttgctcttctgtgtcgccaactccgattctgaagagtgatataccactattgcagcaaggtagcatcagactgcaaatgattcacactttacaaatttgtgaagaaagacacaattccccagcatatccaaatgctctttcagcagaaacgctctctgatatgaaccacggcgagctgtcaatcacagctgacattcctcatgactttatatttc

SEQ ID NO: 56222 - DNA, 500 bp, Triticum aestivum
  Clone ID: PAT_TA_56222
gttttaaaaatataagtagttcgatctgcatatactgccattatactactaccatactattatacccatccatccaggcctaccacaaaccatcactggttcacttcgctgccactaccactattgttattatcgatcccggcactagggcaggacgcaacgacagcaagaaccaaagaacaacacagcaacaatgccatgcaccgagcaccggctcaactgaaacaacaacatactaccaccgtcttcaggtctagatccgtggcggtggcatggtctagcggcggtgggggcagaaggtgacgacgtaggaggtgccggcggcgcaggtgaggatggaggtcttgtcatcatacgcgtaggagtaggccttggggcacgcccgcttgaacagccgcgagtaggtcgtcggcttgcactgctgcgggccgccgaactgccccgtgcagcagtactcggcgctcccgaacgcggcgcatgcgctgcggcaccccacgacc

SEQ ID NO: 56223 - DNA, 470 bp, Triticum aestivum
  Clone ID: PAT_TA_56223
ccatgcaacattgatacaccaattgttgccagcataatgaaatgcttaacgccaaatacaacatgagtgcatgcatacatagacgatttcagcaacatcaattataccgaacctaggcatgtgggggggatcatgcaaagaaaaaggtccaatcttacatcaaagcaaactccatatatgtagcttgttcatcaatactacaaactcaatactagcatatctcgatcacacaaataacaggctaattcagcatcaaattaagggccattactaggcacatgaagggcaccacatcaatattaatattccccggaagtcgatcgttacgtacttacctaagtacctcatgagcatgagctgatccatgggcatgagcttggggctgaccaatcagcagtcccaggggaattcccctcctaggaggagggccaggaagctgaggtcgcccaccgcaagggtgaacatgaccg

SEQ ID NO: 56224 - DNA, 515 bp, Triticum aestivum
  Clone ID: PAT_TA_56224
ataggccacatcacctgcagctgcagctgcagcgatttgaggtactacatcgcctaatccaacatcgacgccttgggcgttttgttgaagcggggaacgagttcttgcagggccctcattttatggttgatcctgtccctactccttctctgcgagaggtcgtgcacttgggcggagcgccaacgtttggctgcagacggcttctgcgccacctcacacgtgacgtaagcggagtcctgactacacgtcctgtatagtctgactggggcagctcgctttgttttctcttgctggcgccggaaggcctcgaccacatcaaccacgaggtcaacgatgtcgacgctctgtggaaagacctagagttcttgatttccctgacgctccgggggagtagctcactgatgttgcacggcggtatccgagacgagcatgcctctgggcctgtttgctctccgccgcagcacccttctgaaacccatattgaccaccgaggactggacgggctctgactccgg

SEQ ID NO: 56225 - DNA, 492 bp, Triticum aestivum
  Clone ID: PAT_TA_56225
agcaaaccgagcagaaaccagttgacggtttgactagcaaactgaagagaaaccacaaatccgccgtcccaccatcactaccgttccacggacgaagccaaagaaaaatcaggaccgatgctaggcgtaagccggcccatagcatccaaatataagccgccttaataaccgtccgattgtgcatataatagccgttcattttgtctcgccatgcagcgcccaagagtgacgctccaagcacgcccatcagcatggaggcagcggttgccatgcaacggccacgacgccactcgagctgcggtacaacaagttcgtcggagctgcgttgtaaatggacgtcaccgcccgagctgcgatatagcaaggccgccggagctgcgatgcagcaaggccgccggagttgcgatgcagcagcagccgccgccggagctgcgacgcagcggacgcgtcgccgccggagctgcgaggccgccggagctacgatgcagcaga

SEQ ID NO: 56226 - DNA, 630 bp, Triticum aestivum
  unsure (1)..(630): unsure at all n locations
  Clone ID: PAT_TA_56226
cgcagctggntcggtgggtggcgacacgttcgctgtttggtcgagccgtccacagcgctgttgctgccgtccaggatgagctgctcagcctgctactccacgagactccctagcagcagctgaagagaggttccattggaacaagcacccatggttgttgtcgccgttagcaccgtcccttaactgcgaccctttagaccctttgctgatccagctcccagaaggccaatgcctggggaagggaagtggtttctctctgtcgaggaggacaagcagagatagaggaggcagatgtgatatgcttggcattatgctgtgaggatagagggccatggatctggatgtggagattgtgaaagtccatgtgacgttcgtgtcaagatgagcggccgttcctgctgacattgtgtaaactagatgaattttaggcgctcttttgtcagagaccgcttgatggtttggttgggactgctaccgcagcatcgccgtcgcccttcagtacccgacgatcacgcgtccggagatcgcatatgccgtccagcagatcttcctgcacatgcacgatccccgcgagtgccatctcgggttgatcaagtgtgtgcttcggtacgtgcgcggcacgcccgcgct

SEQ ID NO: 56227 - DNA, 627 bp, Triticum aestivum
  Clone ID: PAT_TA_56227
cgcttactcttgctccctctgctgctagctagccggtcgatctacactagaagaaggaaggggaaatggccgggagggacagggacccgctggtggttggcagggttgtgggagacgtgctggacccctttgtccggaccaccaacctcagggtgaccttcgggaacaggaccgtgtccaacggctgcgagctcaagccgtccatggtcgcccagcagcccagggttgaggtgggcggcaatgagatgaggaccttctacacactcgtgatggtagacccagatgctccaagtccaagcgatcccaaccttagggagtatctccactggcttgtgacagatatccccggtacaactggtgcctcgttcgggcaggaagtgatgtgctatgagagccctcgtccgacatggggatccaccgcttcgtgctcgtgctcttccagcagctcggccggcagacggtgtacgcccccgggtggcgccagaacttcaacaccagggacttcgccgagctctacaacctcggcccgcccgtcgccgccgtctacttcaactgccagcgtgaggccggctccggtggcaggaggatgtacaattgacctacccatggcccacgtacgccgcccgc

SEQ ID NO: 56228 - DNA, 620 bp, Triticum aestivum
  Clone ID: PAT_TA_56228
cggccgcgtgggcggccgcgtgggttgctgtttgctggaaaaacaccagctctcatactagtacttggactggagcttgtcttctcagccatccagccttcttaagagctgccattgaggagcaacatcaagtcgccaagaaatacaaggacggaccagaatacaatgccttcttagagatggatacgctgcataattgcatcaaggaggcgctgcggaagaaccctgcaacaccactgctggttcgcagggtccataagcgcttcacggtgcagacgaaagaaggccaacaatatgacatcccgcaggactacatcgtagcaactcctactatagtaaacaattatatcccttacatttatacggaccctcaggtgtatgatccaaatcggtttggcccagaaagaagagaggacaaagtgggtggcaagttctcttacacatcatttggtggtggaaggcacgtttgcactggagaggcttatgcttacatgcaactcaaagtgatatggagccatttgctgaggaactttgatctcgaattggtctctcccttccctaacacagactggagcaagttcttgccagatccaaagggaaaattactcgtgagatatacg

SEQ ID NO: 56229 - DNA, 412 bp, Triticum aestivum
  unsure (1)..(412): unsure at all n locations
  Clone ID: PAT_TA_56229
ttctccccactcagncctcggngcccggcccttcccggcccgctcgggtttagccgcggggaagaggaggaagaatggcggacgtcgagtaccgctgcttcgtcggcggcctcgcctgggccaccgacgaccagtccctccagaacgccttctccaagtccggcgacgtcatcgactccaagatcatcactgacagggagacgggccgttcccgcgggttcgggttcgtcaccttcgcgtcggacgaggcgatgcgccaggcgatcgatgccatgaacggccaggacctggacggcctgctcatcaccgtctacgaggcccagtcccgccgctccggcggaggcggcggtggcttctgcggcggttgcggtggcggcttctgctgccagcgccgcgagggcggttgttgttg

SEQ ID NO: 56230 - DNA, 521 bp, Triticum aestivum
  Clone ID: PAT_TA_56230
cgacacgcggggctggcgcccgcactgcgagctgcggaagcgcgcgctctacttcgcgtccggggtgcgcggggccgagcacaaccccctctgcctcgccctggtgctcaagtagagggacttgttgatgaaccagaacgtgcagacaaacacggaggcgctccccttcgtgacaaaggtcctcttatgcttactaggggccacgctcatccgactcgacaagacgctgatggtcatggggctggactctgttcttctcatgtatggcacgtactatgatcggatccaaaagacctggctcaagcatgatgttatcaatacactatctgtgcacccactgggagtcaaagactacgtgctagctgaggtgcgcaagctgcaactggcactctcaaccatcccgaactagctgattgccgacttgacatccaagagtctatcaaagcagatagacatgccaatatcgatgctaatctctgacggaaaccaatcgatcatgctgctgtcacaggagaagaaac

SEQ ID NO: 56231 - DNA, 185 bp, Triticum aestivum
  unsure (1)..(185): unsure at all n locations
  Clone ID: PAT_TA_56231
gngcgagggcgcngagccgttttctacctcgccggtgcggtgttttttctgctcgcgtggtgcgctgcaaccccacgcgcgggcacggtgcggtggtcttttttccctcgcgtggtaccgtgcgctcgaggccttcgttgtgactaccactctaggaggctntatatgtgtgttgacaagctaca

SEQ ID NO: 56232 - DNA, 635 bp, Triticum aestivum
  Clone ID: PAT_TA_56232
ggaagtagagataaaaagtatcacgcttttctcttcttttaagcatttcatctgtttgattcattttaacagtacaaggatttcctttattcatacgtgatttggaagtgactctcactcatgtgaggtttagcattagggatatttccatatgtttactttgagctcattttatcatcttttttgttagcgccttcctgttctgcattcatgttagacagcggtccatgtacagaccaagaacaaaaaactgcttatgaatggtttgagtggaggtataaacaaattgtggtcttttggctaattggttggatgactactttcactttttaccttgcacaaaataatcgattccccggtttccctttatgtttctttctcgcaaatgccattggaagctctctgtgatttctaatgctggttattttgttggttcattgtggcataattcgaagcagccggatataaatgtgtaagtggcatcatgatttgggacactacagcgacattttgctcatatcatagtgcatacaacctttttcacatgtgttatcttattgtaccatggatatcagatatgcactgcatatgtatattcatttgttgtatgctttacaggacagatgggcctggga

SEQ ID NO: 56233 - DNA, 421 bp, Triticum aestivum
  unsure (1)..(421): unsure at all n locations
  Clone ID: PAT_TA_56233
ggaagggaactcccgcccccaccctgcacgacccactcaccctcgaacccatctccagcgcgccgccgccccatgccccgccgctgcgcgtcaccgccccatgccccgtcgccgcgcgccgccgccccatggcccgccgccgcgcgccgctgcccccagccgcctcttactgccggatccgacccggccaccatcgccatggcgcggcgcctccacctcccggcgacccatcccaccttctcgcgcggtgtgtccacccccgccgatgcgtcccgccgccccaaccctccccttcctcgcatcgggatgggaaacatccagccggtgcctgaaccccatcccaccggcgcggctcacagcagtcgtagtgctttcacgccacgccaccgctngaaataaacacatggggacgtgctgccct

SEQ ID NO: 56234 - DNA, 661 bp, Triticum aestivum
  unsure (1)..(661): unsure at all n locations
  Clone ID: PAT_TA_56234
acagctcataagcacgcctggggatgaagcgatgcatcgttcctagcatcttgctgatgctttcactggaggcggccctcctcatcgccgaccgcccctctgtagacgacgaggtgggtaccattctcctgccgagccaaggccaagttgcagaccagcaagcagccatggcggcgccgaggccgtggaagtgctgtgaccggccgcggtgtaccaggtccatcccgccgatctgcacctgcgtggacgaggcgttcgagtgcgcctccacctgcaaggcatgcgtgccgtcgacgcggaacccgtccctccaggtctgccaagaccagtacgtcggcgaccccgggcctatatgccggccgtgggagtgctgcgactcggcggcgtgcaccaagacagacccgccgacgtgccgctgcggggacgaggtcgagcagtgcgctcccacctgcaagagctgcgaagcgtccacgtcgaacccgtccctcaacgtctgcaaggacgcgttcaccggggccatcccgcccacatgcacgccgccagaggctcttgccgccggcggtaactagcacgcgcacgcgnttggtgtgcaccatgatcgagtcgctacgtccctactccttccttgctgctgcagcagcctgcagtttgtgattataca

SEQ ID NO: 56235 - DNA, 588 bp, Triticum aestivum
  Clone ID: PAT_TA_56235
ggcgcctatccaacgaatttcgcgcagcgacgcgtcctacaagctcactccccgtggcgggaatgggaccacggtttggtagcgtgctctccacctgcccccggggtgcaggttacatcccgacggtaccaggagctggagatgtgctacctttgccactagtgcggcggcctgcccatgaacgtgccggcgatcgtcgagggcgacctgtacaacatctagcccttgagggtgctggtgaaggccgccggatggtgggccgaacgccaatgaatggtacttgttctcgtcgcgcgaccggtactaccccaacaggtcgaggaccaaccgcgccgccgctaccggttcctggaagggcaccggcacccacatgcccctggagaccccccgccccgtggacgtcaagatggccctcgtgttgtacctcaccgagctcacccagggcgtcctgaccaactggatcatgttctactaccgcctggacgacctggtgctgttctacgactacctgccgatgtgcaacatcgcgctcaaggtatctacctggcctcatgtctatctgccaatctgctgtgatgctcgactgac

SEQ ID NO: 56236 - DNA, 561 bp, Triticum aestivum
  Clone ID: PAT_TA_56236
accctcccgagcggacttcactgctcagctgctggcaagagctttgaacgcgttgcaaccttgcatcccggtcgatcgtatcgatggcgtccatggccgccctggtgacggacataaggcccgatgggcaactacgtgccgcgaggaccaagcaagggttcttcccatcccggtcaccggcgctccaaagtcgatcttgcggacgcagcataagccgccgcagttcctgcaaggccggctcggcgctgagaggcacgagcgcgggctgctccttcggtgggcggcggagctacaactcaacgggcgtgccgctgcacggcgacggcggagctgcaacgtgggtggtgagcggaggagctgcaacgccacggccatggtgttgcgcgtcggcggccgagacggagggcaacgaccatggtgtctggtgccgaccgggcgatctacagtgcatgttgggcgtgctgtattggaacgcccggtcgtgctgcgacccgggaccttaccgccggatgtagctgcataggcaccccccatggtggctgcgagacttgcgacacaggt

SEQ ID NO: 56237 - DNA, 627 bp, Triticum aestivum
  Clone ID: PAT_TA_56237
ggcagacgcgcgggaagaccggcggcgtcaggatcaacgcaaccgaatccggcctcggatcacggcaacacggcacggggtatgcgtctgcagtgcgcaccggcgcgctctatgccccgaccctggtggccgagcccggccaacctggtgatctcgccggacagcgacaggaggagggtggaaagctgagccggaggagagcgacgcgtccacgtaactttaagtgcagagcagacaaacacacacacacacacacacacacactcaggcacgagcacaagcactcctcgcctatggacacagagccgcagccgacatgcgtgcccgcccggagcgaaggccaagatggcagggcagcccttaggaggcgctactccctgaccagacacagccaccgttgcaccagctcgacctactattaaccctgccaatgccgggcactgaccgcagtactctctgatttacggcatggaaaaccctgttgaccgactttgggatctctcccaacatctgaccggtgctgtgggacatatacgacatctgtgcttcatgccattgcaacgaccatactcaacgtccatagccttccctagatacatcggacatctgcactgctgcacgccaact

SEQ ID NO: 56238 - DNA, 471 bp, Triticum aestivum
  Clone ID: PAT_TA_56238
gaagagaatgggattcaacacacatcgattatgctcgaggctgcagagttatacagggcgctggccgcagccgagcgggatcgtgggtgtgccactaccgagcgacgtgcagcactactcaacaaaactgctgcacggtcaaagctacctaagccgtatacaatacaagaatacagactccataactaccctggctaacaccccccacgcagtcgtgacgtcggtggcggcgacgaaaagactggaccggaagtcggagaaaacctcggacggcagccctttcatcatgatatccgcaagctgctgccgtgtggggatgtgaaggacccagaattcgccaagcgccacacgctcgcgaacgaagagaatatccagctcgacgtgcttcgtccggcgatgatgtatggggttggcagacaggtagactgcggagacgttatcgcaatacaccagcgtggccttgtcgatggg

SEQ ID NO: 56239 - DNA, 388 bp, Triticum aestivum
  Clone ID: PAT_TA_56239
gggggaaaaaacctttcatttcaaattgccccccaaggagcggaagccaaaaaacccttacccttccccccggccaaaaaaccaccataaataaatccccccccacaaaggccaaaaaagaaaccggtccaaccctgggattcccccaaaaaccctgggccatgcaaaaaaattgcccaaaaactaaggttgcccaacccaaccttataaaagggtaatgccacaaaaaccccccaagccccacgtaaccccaatttggtttaccaccctattttctccccaccctaaaaaagccccttcccaaaattttaccaactttttccccctccccacccggttggcccccccaaaggcctccatgggcccggggcggaaataaaactttccc

SEQ ID NO: 56240 - DNA, 494 bp, Triticum aestivum
  Clone ID: PAT_TA_56240
gtttttgcaacaaaagtcaccgcgtaatcggatggccgttgccaacattcaaaatggacactatctgcattgcctatgaccaagcgcaccatagctcagtatactacacaacgacactcatcacagcaggcacactaaccatggatgggggtgcgatataatcgctcctgctgcatgctctggccctcgagtccaagcgtgtgaggcctaggtccttgttcttggggtgcttgcggactgaaagggggctccttcccctgttcacgtacaccgtcagctttccgcactggacgtggagggccttaaacactgtgatcatctcctgcaacaccaaactgcctcctcactaacctaatccacatgtcctgcatgctgaccctgttcacgctccatatggacacctttaccttgctggggtcactcacatgcaggaggacaaccctcagaccatggtacctaagctccttccttaccggcatgtaacgcagctttct

SEQ ID NO: 56241 - DNA, 506 bp, Triticum aestivum
  Clone ID: PAT_TA_56241
gggttgggtggtttttttttttttttttttttttttttttttttttttttttttttttttttttttttttttttttttttttttttttgggggaactatactaagggatataatttaatcattttgtaaacatacacccctcccagtgcaaaaaggcgatgggataaaaggggaaagggtctacatgatcagttcgggtaaaaacaccacttcccacaacgactaaaataatgaacacaacaaaagggggggaaacggggcaacaaaaaaatatgaccactggaaggctggaacaaaaaataacttacatggggggggatactatatcacagggggcttcaacatcaacaggactgaagcacgattgggccaacccaagggctaaacatataactcaagggcacctgcactttacctgaaccatgctcacaggtgatgaaaccagctagtagggggaaaaactggccaaggtttttttcaaacaatgagtcccccaaaccccttat

SEQ ID NO: 56242 - DNA, 170 bp, Triticum aestivum
  Clone ID: PAT_TA_56242
gggttgtggttttgaataaaaacacaccatttattggattataatccactacacacgcatcttgcgatggatcgcaccattattcactagtcctactaggcgatgtctatctcaacaccattggtacaggatttacaaagtctttattggagcatgttggggcatcatat

SEQ ID NO: 56243 - DNA, 494 bp, Triticum aestivum
  Clone ID: PAT_TA_56243
gggttgttttgtttttttttttttttttttttttttttttttttttttttttttttttttttttttttttttttttttttttttttttttttggacaaaaggacgaagaagaaaaaaaaaaacgtaaaaaaaaaaaataaattggttggtgggaagcaggcgaaccttttcctgccatttttaaaaagaaaggagcggcatccgttttacacgtaaaaaaaaaaaaaaaaaaacaggggcagttaggaaaaaggacaaaaaaacccactggagcccaaaaaaaaaaaggaccaccaaccaggccttctttttgggcccaccaaaaataaaaagcccacttccaccaaaattttttaaatcgggcccatcgaactggggcaggttggggggagcggaaaaaaaggcaaagaggcccaacaccggggcgttaatgtagggggggggctaaaactgctgaaaaacggcccccccctcgggaaaattgcccctggggt

SEQ ID NO: 56244 - DNA, 489 bp, Triticum aestivum
  Clone ID: PAT_TA_56244
aaaaaaatacaggcattcaattacaatattcaaaaccatatgtataatatgtagattaataaaaattcataattctcatagtaaatatccatcaaatgaaactcaaatgtaatttagccatcccaattaagtgccaagactaaattgtccgtgattagagtccagtcgagctagttctttggatcctgcaatcaagaaatcaaaaaaatatagttctagttaatgagtgcaacataacatatgccatacaattattccagacccattgttaaaacgaattgttgccagactacctggaggagtaatactgtgtcagcaagcatgtaactgaggggtcagaacagttttacaagtgtaaatgtctaaagtgtatgcacaagtacatgtactaaaagcttccgctattgatttaagttgtgactcgatctatagtttcagttaagttcatgtccctagctagcacatattcatttttttaagttgtgactc

SEQ ID NO: 56245 - DNA, 495 bp, Triticum aestivum
  Clone ID: PAT_TA_56245
ggttttggttttttttagctggaatgtttataaagacttatatttaggaacggatgaggtagtaaagcttgcagtgcactaatgctcttgtggatgacaagatgctactgcctgcaggcgcaggctggacctattttgcacgacgataccaaacaggtggcccatgtccagcgtctctgggcctgccccacccggaatcgcccagtcaaagtagtacaggaggtttgccagcacaagctccatctgtcgtgctcgcaaacaaggctgcaaggcactgcctacgaccagctccgaacgggatgaactccatctgtggcccttgcttgaaatactccacactcatctcctcaaacctatgtggcctgaactccgcggcatccttaccccagtgtgtcgggtccttgccaaccgctaaggcgtttattatgaccgaggtgcccttgggtatgtggtagcccatcacttggcaatcctacatggccgccctgtgtatca

SEQ ID NO: 56246 - DNA, 496 bp, Triticum aestivum
  Clone ID: PAT_TA_56246
gtttttacccaaattccatattttcaccacctccaaagcttgtccaagaaaatcacaagctcgatacagattgtcaggcaggttggaacaaaattgtactgtatgtagtagcatagttctgctcaaactttcaaacctcaggtaggggacgggcataagattacataagcttcccatgccagggcgtacatatcatacatatagtctgtatgtcccgtcatttttccaggtttatgtcgtgagcatcttcttgtactccttgaacgtgcccgggaacggggcgaccttgccgtccgtcaccgcccagagctcgtccacactccccgtgatcagatgctcgtcgtgactcaccatcagcactcctccctggaatatgagcagcccctggatgagcgcctccacagcgtcaagatcaagatggttagaaggctcatcaagaaggatgatgtgcggcttcttgaaggtgatcttcgcaaacgcaaccctactcttctga

SEQ ID NO: 56247 - DNA, 576 bp, Triticum aestivum
  unsure (1)..(576): unsure at all n locations
  Clone ID: PAT_TA_56247
catcgcaagatacatactttcagaagttgacatggcgtatatggtacatccaagaattcaagacgccatttttctttgagacatcatactgcggggtgttatatttacatgcacatacaggtaggagctaccagataacgataacaaatcgggtcttctagtggaagacatatcncccagcacagaggtccgtctgtcgttaccatccagagcataaacatcgaggaaacataaaaaatataacacatatatcccacttatgatcagatcggggaccatggctctccttattgcatgatacccgcagggtagtaagagtaggtagtagagaatagtaacattacataggtctagtttattcctagcctcatgttataggacagtcagccctttccagtttcagtaggtgagtagcttcgaggagcctgagctagacctgttagttaggtcccttggacagctagcctagtccttcctagctcttagcttggcattccaacaatctccgatgaaacatnccatggtggtttctggccatgagtgtgcgcttggcgggaacaacgacctccagaggtg

SEQ ID NO: 56248 - DNA, 289 bp, Triticum aestivum
  Clone ID: PAT_TA_56248
gtgggtgtttttgacagaaaatgatgatcattaataactaaaactcaatgttgattggacactaaccaaactaggaggggaaacaagggttcttctcccttaaaaccatcttatgttcacatgtctaacatgtttcctctttccaacgaggggggggggcggacagagcttgatattcatactcacgcaaatcaactgagaagactacattactttgcaactcatggaaacaggtcgaccagttccttcctacaatccaccatggtgcccgacctcttgccttgggtgg

SEQ ID NO: 56249 - DNA, 471 bp, Triticum aestivum
  Clone ID: PAT_TA_56249
gaacccaaaacttcagttgcatcttcttgttcaacctctactagtaatttggttggaatgtcctaccacgggaaaagttgaaattttacccgacggatgcctgaccatgcatgctcgccatgtccaatcggtggccaaagggcaagggcagcatgtcacatggtacaacgatcctggctagaaccaagtgacccaaatgccatccaaaacctgacgaggataacacctggtttatacgtgcgtttgggaaaactctgcatccgaaccccgatcgatcgatctaagggcattagatttgtacaggttaatcctcactaagtactctctaatctacattggtttcggaagcttgcacaccgaattacacgatacctgacaaacatgttagtggaagctgctaaggaggatgggtctgacggatgcctggttcattcagaacgggttatgcacgttcgtgatcatgtccccgaa

SEQ ID NO: 56250 - DNA, 400 bp, Triticum aestivum
  Clone ID: PAT_TA_56250
caaacgggaacaaaaagggggccccttaccatgggtattgttgttatcccaactccaagggggcccccccagttgcgggcggtgcccacgtccacgggcgcccccccgggtgttcacgagggactaaacttggggggggggccccggaaccaagaggggaacaccgcagtttttaaggatggggggccggcccgcccgcccgttggaggaacctccccaaggcccctccccaagggagataaaatcgcctggctctggaggggggctccggataaggacacggaaggctttggaggccggctcctttgggacacccgggtggggaccctgatcgctggccttgttgaaggccaggggccagaaaaccacctaccccgcaccatccgggcccttgcaggca

SEQ ID NO: 56251 - DNA, 477 bp, Triticum aestivum
  Clone ID: PAT_TA_56251
aaacattgacatcggaaacgatatctttataagcaagtgcatgagtaacaacatatggggagaattggtatatgccccaataaaccagtttaaacaaaactggcatgcgagctatacatgtaaatgaacggcgacttagtgggcggagactaatctaggggataaaatgaagctaagaggtcctttcactattggctccaagcaaatccctaaatagctttacgccaaaagtctaaaaaatggcctcgaccagaatactaatagtgataatctgaaccaccgaggcaagcttacattctaaatcactcaatccaaatagtatgccatcgcttctcatgtgcgtatgagctatggatcatataaggagatacaatatcttggcagttccagcaatgcataaagggaagataatgtatgaatctttcttggagagaggatccccataaagctaagttggagcttcctgctactagctat

SEQ ID NO: 56252 - DNA, 485 bp, Triticum aestivum
  Clone ID: PAT_TA_56252
aaaaacctcgcaccatagccggccattcaaggtcttcttacttaaacagagaataacatacactatcttccacaaggcatactactacatatccatgtcaaaaaaaaaaaactacatatccatggagtcaatacgacatagtagcaacaacgtttctcaaaaagggattgcgcatctgaatacttgactctgttctcgtgtcagcatgtcacatgtagtacacattatgcttctgaatccttgaaactacatagatggatgatagggagaacactgtcataggcgcatcagcaattcctatcttcaggtccaaacacgaatggtcccatcgacagatgatgtcaacatgcaggtctttgttgggtgataactgacgctggtgaccacagagctatgtgctcggaaagtcgcaacaatcggtgcatccactaactcccagaagaaaacaaacccgtcctcagatccgccgataacaaatgcatcat

SEQ ID NO: 56253 - DNA, 653 bp, Triticum aestivum
  unsure (1)..(653): unsure at all n locations
  Clone ID: PAT_TA_56253
gccgctactcccctgcctcccccanagctcgttagggttttctcttttttcggggngagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgac

SEQ ID NO: 56254 - DNA, 429 bp, Triticum aestivum
  Clone ID: PAT_TA_56254
gccggggaacagagctgaaggtggctggggatgtagcgcagggcgaaggaacggtgcgtggcgcgcgcgtgatctctgcccagggggacctgaggatacgcgacctatgtagccgtgaattgtccgagacctagacgaactacgatgctgatggcctgggcacggatactgtgataggggtcgagctctggacgctgtgcaaactgatgcaggctgcctgaggacatataaagctgaagctgatgtacatttttagtggcaaagcactgacttctgtaaccgtgcacactctttggaacgaagatgcgatctaagatgaatattgaaagagccaacggaataactgatcctgtcaacttttataagacgtgcaacggattacctacagtctcaatgatatgagtaaaaaaaaatgaacaaggcggtcca

SEQ ID NO: 56255 - DNA, 641 bp, Triticum aestivum
  unsure (1)..(641): unsure at all n locations
  Clone ID: PAT_TA_56255
gccagnactgatctggtctgctacccccttccccggaccccggccgcggtggtttaattagcagcgaagaagatgggcgacaacctgatggagaaggtgacggcgctgagcgagcagctgaagatcaccgggacggaggtcggcaagaagatgacggccggcatgagctccatgagcttcaagatgagggagctcttcctggggcagactccagccgacaagatcgtcgaggacgccacctccgagaccctggaggggcccgactgggccatgaacctggagatctgcgacctgatcaacgccgggaaggtgaacagcgtggatctggtccgcggggtcaagaagcggctcgtgctgaaggatgcaagggttcagttcctcaccctgtcccttctcgagaccgtcaccaagaactgcgagaaggtgttctccgaggtcgccgccgagagggttctcgatgagatggtcaggttggtggatgatccactgaccgtggtgaataacaggaacaaggcgcttatgctgattgaggcttggggagagtccggcgaggagctccgctacctgccggtctatgaggagacatacaagagtctgaaataagaagagtgcggtttcctggacgcgacatgagagcttga

SEQ ID NO: 56256 - DNA, 432 bp, Triticum aestivum
  Clone ID: PAT_TA_56256
ggcgcacaaaagcctgagggctacatgaatggtccaggcgcgctctcacctgcgcgtgcctgggccgctgaacattcacgaccacgtgatgcgcgccatgagccgctagaacgaggtactaccgctcgacggacagccctgccctcaccaacaccctgctgtacgacgagaacaagatcttgaagacaacaccggcacccacttacctgttgcacagcaccgaaaccggagcctgggagagcgcgctcaccaacacactctccatgggggaaccgcatcatgaacttctcactgcggcacagtcagcactgctgaggatagacagcagctaagtctttgtttcatgacgtacgatgcggaatccgactggggctactgtgcctacctgatggacctagcatgcaagctccgcaacgactcaaagaacaccat

SEQ ID NO: 56257 - DNA, 354 bp, Triticum aestivum
  Clone ID: PAT_TA_56257
actacagtggattcagggcaagaccatgcgcgcctgtggggggctgtggccggggggggccggcacagcacagtgcgcgactccatctccgcggcaacctggactgcgccccggggacctatccacctgaccacaaccgtgcgggcggccatcgtgacgtttgcgccgcgcccacgcagcgtctggaggctccagtgacacgggacgggccaacacggagatggcaggcccagggctggactgatggcacgcttacaaacacacacgatcgtccacaggccactactaatacattctgatgcggatgatactttcgcatgacaagctctacttataataaagctactaatattg

SEQ ID NO: 56258 - DNA, 470 bp, Triticum aestivum
  Clone ID: PAT_TA_56258
gacgcatacgcctgcctgtcgcagcgagggacgcgaggctccgtggttgaaaagtacaggtcgtcgtggggctgacgcaggcagggacacgcgtaactgcgtccacaacacgggcacgaagaacctatacatcatatggggaaaggatgataaagggccggattaaccgactgcctactgcctgcacctgaaacattgccatgggaaccatctagaagaggaagccgaccctgcgaaaaatggtcatgccacggagcatcatccttcagatgatgacttggactacatcggacgtggctttaatgtactgaaaatacaccggtggaatgatatcgaaatccaagggtgacataaaatgaactgcgatcactggaccaacgggacacgaccacgctaatctttgaagcaacaatcgtgcatgaacgccaatgcaatcttcagagactagaacatgctgtatatggtatata

SEQ ID NO: 56259 - DNA, 300 bp, Triticum aestivum
  Clone ID: PAT_TA_56259
catatctccagttgcaatcctggtgcgggtcgggagcgtatactaggctagcagattgcaaatcagtgacgagacggattattggtgtgacgctcttgatctactcgcttccgaatcagtgagcctggccgcgtggcaggataacctaccaagatacttatcctagctatgccgagctacgaggggttaatagagtaaaccatcacctgcgcatctgtggtagtggaagtgctaaacacgtaagacgtaactggagccaaaactatcatgtgcgaaacggtgctataatttgtctgaaaa

SEQ ID NO: 56260 - DNA, 678 bp, Triticum aestivum
  unsure (1)..(678): unsure at all n locations
  Clone ID: PAT_TA_56260
ngagaagaagnatgagggagatatcgactgaagctcttgcagtgaaatggctaccgccgggaaggtgatcaagtgcaaagcggcggtggcgtgggaggccgggaagccgctgtcgatggaggaggtggaggtggcgccgccgcaggccatggaggtgcgcgtcaagatcctctacaccgccctctgccacaccgacgtctacttctgggaggccaagggccaaactccggttttccctaggatcttgggccatgaagctggaggcattgtggagagcgtcggcgagggcgtgacggagctggtgccgggcgaccatgtcctcccggtgttcaccggagagtgcaaggagtgtgcccactgcatgtcagaggagagcaacctctgtgacctcctgaggatcaatgtcgaccgcggcgtgatgatcggcgacggccagtcccgcttcaccatcgacggaaaacccatcttccacttcgtcgggacgtccaccttcagcgagtacaccgtgatccatgtcgggtgcctcgccaagatcgaccccgaggcgcccctcgacaaagtctgcctccttagctgcggtatctcaaccgggctaggtgccaccctcaacgtcgccaagccgaaaaagggtatgacagtggcgattttcggtcttggagctgtntgccttgctgccat

SEQ ID NO: 56261 - DNA, 528 bp, Triticum aestivum
  Clone ID: PAT_TA_56261
ccaccgcaacccaacccaaccccaccccaccccaccccaccctcccgtctcaaaaccctaatcccaacgccgccgcggcgccgccgatcaagccgacgacaggcagcccccctatccggccgccgctccgtacgcacgcccgccccggcccgtcgcgcgcagatcggcggccgtccaccgcgaccgtgggccgccggggggctagatttagattccgatttcggggcccccagccgccgggattttcctcgcgtccccgggcaaggtaggagtgagcatggtgggcggaggcaggaggggaggcgcggcggacgaggccaagctcaacaccggcaacgtgttcgcggcgctcgagaccctcaagaagaagaagaagggcgacaagtccaaggggggctcctccaagggagggaagcagggcgacgaccccacgccgcagcagcagaaggagctcttctgggcccccgccccgctcaacaccaagtcgtggggccgacgtcgaggacgacgacgacgacgactactttg

SEQ ID NO: 56262 - DNA, 395 bp, Triticum aestivum
  Clone ID: PAT_TA_56262
ggctgctcggcctgccgcgtggtgacgcccagacctcacatgacgttccgccgcgccgacatgaagagcaccgatcacggaacctgaccaggcccatgcaaaagagcactgatccgatcagggctttaggctcacacgaggtgcaccgcctaaaataaaactcagatgacatgatcaggcatggcgcctatgctagtgtgtagctctgacgctatactgtcaacagtatgtataatgcgtatcgccgtgacattgaccagatgcgacttctctctccagaaagtgctgtgggctctagcacttgttacacctacctccctgaataaacacatgtgacgatagactgtgcctactcactaacattacaaccagctctcttggcaaatatagcacaa

SEQ ID NO: 56263 - DNA, 505 bp, Triticum aestivum
  Clone ID: PAT_TA_56263
ggtagcatcaacacgtcacatacagcagaggcgctctcaaggatgcttcctatatggatcacgctaaccactggcggtgccgaaagcctggcatgcctttccaacggggctagtattactacctactggctgtgggaagactagaacctgggtgactatgccgtattgctactgaggggtgagacacaacacctgccaccctacgggtgaaacgtgcattagaacgctggcaaacctctttgtctacacgtgctgtgccaacgcctacatttaatccttacatacatccatgaattatttgaattatgagcgctacttattgctgacgagctccactattcatatgttcgagagcctagaattgctaataaaaaaaaagaatggctgctcgttttcaacaacacaactttacctccgtaagcagagcaactacgtatcacacatatacgggtctctaaattcatgcactggtctgtgatctacatagctacctactgtgaaagcc

SEQ ID NO: 56264 - DNA, 664 bp, Triticum aestivum
  unsure (1)..(664): unsure at all n locations
  Clone ID: PAT_TA_56264
ccaaatttgcggngaacgcgacgccacccggagaaaccctcctcccgcacctcgcctcccccctgccaaaaccctcgcccctcctcctcctcctacgatggccgcgccgacgcctccgcccgccgccgctcccgcccccgcccccgccgcggcgccaggaccgacgccgccggcgcaagtggtgggcaacgccttcgtgcagcagtactacaacatcctccaccagtccccggagctcgtcttccgcttctaccaggaggccagccgcatcggccgccccgccaccaccggcgccgacatggacaccgtcaccaccatggaggcgattaacgagaagatcatgtccatggacatcgcgcgggcggagatcaggggggtggacgcgcaggagtcgctatgtggcggtgtgaccgtgctcgtcacgggccacctcacagggaaggacgacgtctgccgcgagttcgcgcagtccttcttccttgcgccgcaggagaagggttacttcgtgctcaacgacatactatgttatgtcgggcagggtgaggccgaccagtcattgccgccacctcagcagcagccgccggcaccggagttggatgcagtggttgcccctgctgccgccctggcaaatggtactgttgcccttgtggagagtgtgcctcgc

SEQ ID NO: 56265 - DNA, 500 bp, Triticum aestivum
  Clone ID: PAT_TA_56265
acaaaagttcattattgcaaaaacattctcgggaaaaataatccgtattcttgaaaaaatacagatgtagtccgcagaaaaactaaacataatactacgggcggcccctgcttggggttcctggcttgctggcccgtccttgcgccgaagttgctgttttcctctgccgcctgatttaattaatttggccgcattttctcatgctgctttccggaaaacccctggcgtgccccatcttactggcttggtgagacatcccctttcctccgcttggccacatacagacggggcccttacggtctcctcttccaactggttgcctcccctgacttgcctatggtcccccccctcctctgcctccttactgccgaaccagggggggccacccccttacttaacctcacctctggcctggcccttaatcccgctcccttacggtcatttccttccttttctccccacgtgatccttctgtcccgggagactttaagcgggggctc

SEQ ID NO: 56266 - DNA, 451 bp, Triticum aestivum
  Clone ID: PAT_TA_56266
agcctctgctctatcaattcaaaaaattgttgcagaaaatttgtattcttcacaggagtggcaagctcagtttatactactagactgtactagttagaatttggaagaaattgtttagagaaacccaaagcattttgctttattcatgcgtgaaacacaaacaacccaaaacattgagccatggtcgcacagaccacacaacatgttcgggcggggctcgttcttgtcttcactcctgtgccttctttcccaaccccaagtttggcggcatgaactccgtcacccttttcgccgccggcctggccttgagctcctcccaccacactttcacgtgcgggcgctccaccaccagcgacgcgtactcggtgtccatgaagtaacccatgaacgggaagtggctgaggtccgcgaggcttaaggagtccccggcgaggtacctcgaccccgacag

SEQ ID NO: 56267 - DNA, 255 bp, Triticum aestivum
  unsure (1)..(255): unsure at all n locations
  Clone ID: PAT_TA_56267
atctcttccttacatgttcaccaggtcaaataccctttaactaacaagcaaactcttccaaaaaatacatcctgtttccacacctgaattttgagtcctatncttggttccttttgtcacccgccttctcctatcccagagaatgttgtccnctttacnttnaagcatcttggcgtccatcattggccctgcccctcaaactggctcatatgtccttccgtcattcgcttctacaccgcttcttcttgtcctcct

SEQ ID NO: 56268 - DNA, 489 bp, Triticum aestivum
  Clone ID: PAT_TA_56268
tttttagggaatgactgacatggattattgtactgtgataattaatatcgtgcagaatcaaagaggcaactttggaagaagaaacgccatagatttacagtaggtaactaattaatttacagtaggtaactaattaatttatatgtggggattttgctgaccggactcaacctgagatcggacgcacaagagatctttaaaaacgcctcttgatgtgtacagagctcccgcgtccgcatcgcccgatctgggacgtccaatcctgatcgtacgttgcaggatagccgtcaggatcttctcgccagcgccgtgcctgagcgaaccgggcggcagccggttgggggcccggagggccgccgcgtttgccggccgtacgtcctaccagcactggtcagtctcccacgtcctccgccggaacgacggcccagccgcgcccgcccgtcgcatcatcatcgtcccggcggcgcggcaggccatgtcgctgtcgta

SEQ ID NO: 56269 - DNA, 280 bp, Triticum aestivum
  Clone ID: PAT_TA_56269
gtggggggggggttaaaaaatcaaaacttcaccaaacagaggaaaacaccacaagaggcaacacaaaacacaagggcagaagctgagcagcacaaccaaaacacggaaaacagtctcagtgcaacctataacgcaaagcaataacagaaaaagggggggggcaagacaacaaacacgacaaggacagaacagctaaaaaaacccaacgagaaacatgcaccacgtctacacccaaagcggaggcacccgtgggccgacgggaacccggagacccccacaa

SEQ ID NO: 56270 - DNA, 471 bp, Triticum aestivum
  Clone ID: PAT_TA_56270
ttttattcagtccctacacatgtctcataaacaacttgttgccaatccacacattatagggtttcacagtgccaatcggtgggaggaaaatcctctgatcgaaatgatgcaacgccgtcaacctacgtctgggtcgttaccgttacctttgaaaggaagttacgtggaccttcatatcactgtgctgaaactaacaacgatggttcacaccgaaagcggatccccctcaatccttgctgcggatggagatggacctacaatgaaacatccgggggtggcaactggacattcctggagtcttatcggaccttgctctactgctgacgcgggtggggacccaaaaatttcctaccggggcctgatggcctaccacatgagaatatactgagatggtattaggaatctgtcataatcatgtgtatagcgtgcaatctgcaagaaatagccatccgttcacagttgcccatactt

SEQ ID NO: 56271 - DNA, 395 bp, Triticum aestivum
  Clone ID: PAT_TA_56271
gggggggtggggccaaggtttgaacaaaaaaacaaaagggagggggggggggtacatttaccccccccaaaaagcccaatgggttcatgccgggcggaaggggggcttttttaccccccgcccaaacatttggggacggttaaattttcaaaccccaaaaaaataaaccccccccccgccgtttgcatggttaaaaaaactcacttccaaggactaggtttcggggtaaagggggaggaaaacaaacggggccttcccgttaaaattccccgggggattgtattttgaggggaaaaaaaccccccggttccccgggaaaaccaaccgcccccaacaaaggggggttgatttgccccaaaacacctgggggtagggcccgcaaaccttggcggggg

SEQ ID NO: 56272 - DNA, 453 bp, Triticum aestivum
  Clone ID: PAT_TA_56272
ggttttgggtttttacacataacataggtggctgttcggaaatccctctaaacgttgcatgcaagattacagggtggagtgcttgactctgactttacaatacacttaagctgcataagacggctgctagatgcgagctcggatacaattgtcatgcccagggcggtgaacatggacttcagctacagtgctatctgtacggtgcgggtctgccacggttacatcagggaccagagcgcgagccctataaccggatgcctgaccaggcccttgaggaaagacctagcccaagtgtactactattacgtgcccactaggcgggaggacctgaggtccccccggggagagatcagcgcaatacaccaacccgttcctatgcgccttccagatgaccctaaccaccgtcttgctctagttcaccgtccggacggcatagttgacccctgaatgaaa

SEQ ID NO: 56273 - DNA, 394 bp, Triticum aestivum
  unsure (1)..(394): unsure at all n locations
  Clone ID: PAT_TA_56273
tttttataaacaaaaactatatttatatatacattatcacactatntatcttttcttacaacaaccatatattatattctaaaacatacataaccatcctttacaatcactaacctacctatacactaacataccacctctttcattatataatagatatgtacatattattctaccataaaaatacaaacataaaaccatattaaactcttatacttatcatacttcaacctttcaaacttatcacactcttctttcccacataaccactatctttatccaatacacatattataccttaaccttatctcatcctacctactttctaatctctcttaaattcttcttatcaaatactacatatcctttccctctctcttaataaattctttct

SEQ ID NO: 56274 - DNA, 507 bp, Triticum aestivum
  Clone ID: PAT_TA_56274
atgccgttgtcgagcttgaccgcatacccgatgtgcttgagcaccatcttcaccccgttgaggcaacccaaacattgcagcttgctgaggacggaccaggtgtccaatactgaagacgcttccggcgaccttgtttatcccgagccccaggactgagggagtaccgatggcacacgtggttgactatcttagagctgacattgtacggcggcgacgcttactaccagggaccgtgtttctgaagtgttcctacttcaagagcaggtattgagtccccacgccgccaccatcagccttgttgccttgccgaggcaatgtgtgcctgttgataacgttgtgcatggctcctcctagaataggatgcctaggaacggcgcatacgtcgacgacgacctgcatggaaggcgtaaccatgcattcagggctcatccagtaaaacttgaggcagtgcttgcacacggagaagacccacaccatctaggccgagatagtcttctatagctgctt

SEQ ID NO: 56275 - DNA, 223 bp, Triticum aestivum
  Clone ID: PAT_TA_56275
ttttaacaaattaatacattaccaatatccactttataacatcacaacttaaatttacacaccctatccataacataaacatctcaactaaaccaatttttatttaccacattatatctatcttccccaattaatactatataaaaaagtggaacaatacactctacactaccataccataataacttctcaacccttcatatcatcatcctcaataccccaa

SEQ ID NO: 56276 - DNA, 234 bp, Triticum aestivum
  Clone ID: PAT_TA_56276
ttttgttctaacctcacggttaaccattgagaatggtacacctttatcacaaggatcaagctatagtgatacatgccagggctggtcggatactaagaaactgcgtgatgccaatacaacacatgagcaccagtaaaggcatcactgatttacctaggaagaactagcttaaaacaaaccagggcagtgtgtatcaatcacagtcataacatgtttgacaacaatgcttctaaa

SEQ ID NO: 56277 - DNA, 493 bp, Triticum aestivum
  Clone ID: PAT_TA_56277
tttttagtaggatcaagaccggtatgacaaccaagttacttgcaagaactgtcagcaatgccctacggctacaggcaaaatttgctttcattcataagtccttatcctacccacatacagcgaaacacacagcattacaccttcatgcgtggatcttccatacaacattctagaagagcgtacgctaacgcaagtcggaaaaagaaaaccacaaccagcagcctaagagcctatagcaactagccatcgcgtaacaaacagcgaccagatggtaaaatggcatatggctactcttcttggccagactcttccttgtcgagcttgatcatgtcgtcgatcctcacaatggtaatggctgcttctgtggcaaactggatgatcttcactttgctcattgctggctcgatcacgccatgttcaaggttgttgcggattacaccttttgtcaggtcaagacccatgcttgataagtgctgcttatcagcatttgttt

SEQ ID NO: 56278 - DNA, 443 bp, Triticum aestivum
  unsure (1)..(443): unsure at all n locations
  Clone ID: PAT_TA_56278
ggttttgttggtttttttttgaaactaaattgactagggtacataatattttattgttgtcatctagggtttcctcagatcaatcctgcaaccttcttatgtttatttcatgatccgaggtcctaaggggcgtgtcttaaataaaaggcttgctgagatgtagggagtctgtattgtcgtgccatagcagataaggatgaatgaacagccaacgctctataatatactcatccatcctgatgacgctgcgcaggccttcccaattgaacataacgcacaaagccaggttaatatgcgataagggcactctgcgagtgatgaacttatccagctgcagattcttcctgatgtacatgcncactacatcctcggatgtcaatgcgcggattatagttgccgaataaggtgcccttcagcgccctgctcttaaggaagctcatggg

SEQ ID NO: 56279 - DNA, 495 bp, Triticum aestivum
  Clone ID: PAT_TA_56279
ggtttgtgtgtttttttttctttaaaccctgtctgtacccattcacgaccacaacaagttcacaacatcctgtctgtatactctcaactatacacccgtacaagggttggttcacaagtccactagttcacaacaacaaacgaacggtctctggcggtcgtattctctctgcaccagccgcggcagccccagccggcaatggggcgcctagcctaggcgaaggggtcgttgtccgacacgccgccgccgccgtccgcatcatcatcttcctccatggcctgtagaccgtcttcatcctgcagctgcagcacaccgtcctgcagcaaatacaggagctgcgcgtccacctgcagctgctgcatgaggtccgcgtctccctgcattgcctggatttcctgcaggagcgccgccccatgcggcgcgtcctgcgcggggtgcgccggcccctcgtggagcacgttcaggagggcggtggccagatgccccgtctccctg

SEQ ID NO: 56280 - DNA, 481 bp, Triticum aestivum
  Clone ID: PAT_TA_56280
gagtccgggagtggagattaatccacctagcagccgagtaaggtaatcaacagattattattttattttacacagctctattgcaagtttttggacataaatatggaagcaccagtatcttgcaaacaactagtgacactattacatgctgctagtgtccggtgattattcatacatcttcagacctaattgactgactgaaagcgtcgaaacacagtggttgctattatttgcagcgcacgcgtggacaaagtacaacctgacagagtatggtagtccgtgcgacatgctttaatttatggcataagttcattctcggatgagacataaggctttggtggcatctgcagactctgaagcctcccagttagcatgttcacgacctttgtcatcgacggccggtttcttgggttccactggatacaccacagtgccaccatagccagcttcctcaccttttctttatcttcttcagtcgttt

SEQ ID NO: 56281 - DNA, 490 bp, Triticum aestivum
  Clone ID: PAT_TA_56281
atacccaagcacgcgcacccgtatcacgtcgggtcactgaagtttataatatttttcttcgcgtgtgtaaagatgtgcactgtcccgtgaaagtggctacaccttttgtgagtggaaatgaacgcgtccctgtacatacatgatacacacatcgaacattttagttctccaaaaggtggtcgctgtcgtcggccgggtgggtgccggcggggtgcatctccacctcatccttccgctgcagctgctggtagcgcttctcggcctcgggcatggcccccatgatggccctgagccgcaggttcacgtcgtcgaggcgctggtacacgatgtcgttggtcagcatccccgcgcacaccatgctgatggtgtcccagctctccaccagcggcatcaggatgatcaccgccgagcccaccgtgccccacgcgatcgcgatcgccgcccacagcgtgaagtaccccaggctgaacctccccgccggcaccgacag

SEQ ID NO: 56282 - DNA, 493 bp, Triticum aestivum
  Clone ID: PAT_TA_56282
ttttgagtgaatttgattttaaagaaataaaaatattgtatgagaatacatgcaaaaggggggtcttgattatttcagcaaaatgtatgccaaaagaatggagttaggaatagacccatctatctacaaattatttgtgcaatcgaacgttgtgaatggaaatacagtggcaaaaaaaaattggatataaaagtaagtaaaattggggcttatgtttggcgcaatataaatccaattaggatcaaggaaaaggtaaattgtgtctagataacggggaaaggtagtgaacttgattttgaaaccacatgatgtgagggtgctcttgttttttttatttttgaagcaacctaataatgcatatgttttgcatggatgaacatatgcgacttacctgtggttgcccgtaggcggtgattgccatgaaggaaattgggtgcccacatagcgttatatgttcagatggcccaacaacatttgataagagtgtgcttgt

SEQ ID NO: 56283 - DNA, 492 bp, Triticum aestivum
  Clone ID: PAT_TA_56283
tttttgagatgaaatcataagcattactattatgtataggcactgattttatacaacatgagtccatgtgcaatttcagctgatccacatggctcatgaacccaatggattttcctggtacagcattttacttgttacaaatcggatgcctgaatgggtgtatgtgtgtgtctgtgtgacacacttgcagcttgcaatccatttggtggcgcggagaaatatatgtacacaccgaagtaaaaccatcccatgaacatggggaggttattgttgtcagcttgcgccaaactcatcgttccatttctccagctcgtcccacttgctcttctgcaagctcggccttatcgcggtcatcgcatttctgaaatcttcatacctcaatggtcgcagctggtttgctttaatggtgagaatattctgtggaccgagctctctgatcggcatcattgcagcttcctcgcacaaggctctcaggtcacttccagaataccc

SEQ ID NO: 56284 - DNA, 357 bp, Triticum aestivum
  Clone ID: PAT_TA_56284
tttttgcatttttctacaagagaacttggttttcttgttattgagtaggcacacacaagtactcactatgatgtttattcacagtgaggtagggtgaacatagtacatagcaccagccagccatttctctgagatgagaaaacacatgtgaccagagacgcggagtgatagcgattatacgatacgtgtgtggtccgtactagcactgacctcatcacacaatgctatcaggctactcatgacgtgcgtcatactcatcgtgagcgtttattattaggcgggcacactctcgtgctgagcactgaagctcctgacacggatcacgagcgtttttgcgatggccacgcccgcatgtgc

SEQ ID NO: 56285 - DNA, 497 bp, Triticum aestivum
  Clone ID: PAT_TA_56285
gggtttttagcagtttgaaaattcgatcagcaatccagcattcaatgtctcagacagagcaacacggtacctgcggtcttcagttcttttccatacccaaatattacaggaattcctagctgaggaagtgacagcgacctaaagctcggggggataaatctgcttgtcgctgccgcaggatccgatgatgggctcggtgggatggaatgcggtctcattgacggaaccgttgtgcccaggaagcttgtacaggatccgcctcgatgtcgtgtcccagatgtagaccatgcgatcagcactcccagcagtgaccttgcgattgtcgggtgaccagctgcacttcaacagggtcttctcaaagttgtgctgatggcctgtaaaggtcttgatgttgcggttctctggtgcataagggcgcagatcccagatcttgagctcattgtccatcgcattagtgaggaggtatgacccatcaggactaagctgcatcccagtta

SEQ ID NO: 56286 - DNA, 500 bp, Triticum aestivum
  Clone ID: PAT_TA_56286
ttttacaaacattaaccatttaaaaacttgaatcgctgagcatccgagctgacatacctacacatggtggcagatacaagtattacagtgactgtcatagcattacgatggccgggccctgggaaacacgtgtatacaaagattctccgcagggtgctacatgcacgtgtaaatcaagaggacgccggcgtcgacgtatgacacagagggtaccagcccacatatcaacccaggttctagcttcggagaacccgtcaggaaattgaaaccattgttcgtccggctccatgattgggctcaagcctctgacttgcccgccgttcttaaaaacaatcagaaaaacccctttcatgaccacctttctgtcgaaggcgttcatggacactgacaagtcggctgaccctgcaatgggctaccggaccctgatcgtgtaccaactgttcctatcgagagtcaaataagagccccggctaaagatggacataactgtctcctgtgcc

SEQ ID NO: 56287 - DNA, 506 bp, Triticum aestivum
  Clone ID: PAT_TA_56287
gttcattggggtatgatttttttttttttacatactaccatttttcacatttttatctgccaacatgtgtcttttacattatttttcatttctaactgggaaaccacccgaattatagaaagtgatggccgcggggcccctaccaggcggaggggcaaacacggaatccacggagggaattgccgcctgttcacacgctaaggggagtgcagaggtaaaacaggggaatccccagcattaaccattctgggggggaaaacaggctacgagactaattactcgcttttaaccacagcgggcagcgaaagagccaatactgggggcagccaatgcgggcgaaaccgggcatttatgagcgcagggttttttttcccatttaatggggagaaatatgaggcacacaagttggtatttacagcaacgcagaagcgggtgaggcaaacttgcaagtaatccccaacgacagttacttttttcgcaaatgaagggggaatgttgggagatcc

SEQ ID NO: 56288 - DNA, 641 bp, Triticum aestivum
  Clone ID: PAT_TA_56288
ttcgcggccgcgtgggcggcggcagactgcaactccaagggaaggaaggaacgaaggaagcagaggacggacggacaatggcgtcggcggcgccgcccgccgccgcacccggccgcccccatccgacctacaccaacgcaagctccctctcctctcctctcctctccttggagatgattgcgggcgcgctcgcccagctgggaggcgcctccgcccgctccgccatcgccggattcatcgccgcgcgcttcaccggcctccccgtcagccacgacgcgctcctctccgcccacctccgccgcctcgtcgccgagggcctcctctgcacctccggattctcctacttcttctcctcccaccactcgccgaccaggccaccggagagtaacagtcccgattccgattcggatgatccatcaactgggaggttccacttcctccagagtagcagtagcagtagcagtgaggaggaggaggacgaagatgatgctgcctacacgcctctgcctgtgcatgtgcatgtgcctgttcctgtgctgggagagaagcggggccggggccgcccgcggaagaaggttgtggttatgctgtctgctcacaccaccactgctgctgcaacgcctggagaaccctgtcctgct

SEQ ID NO: 56289 - DNA, 509 bp, Triticum aestivum
  Clone ID: PAT_TA_56289
atctccactaggctccccaaaaacccaatgcgctttcttagcaccggcgtcaaaaaaggtcctagtaacgcccgccacgagctgattatgcgccggattgtagcaaacacagtgccggcgaccgcaggcataacccagcccctgggaggcacttgagacgccccgcgctactttatgcgtggcgaaaccccaacagccagcctctcttaccatttctgcatgcaaaaagaatctggctcctctctctctccgcacgcagaggtgcgctgcagcacgctaccgagctcgtcgcctgtccgtccccctccccgccaggctccaccgcgccacatgacctcgctgcgtaccagggcggatcccgctaggcactccccctgctggtcgcagacacctcctcgacaagcgccgggcggtctctgcatactcaccgcgggcacattagtgtaccaatacatgggcacaccggcgcatcgttgagcgtcgcctcggtggccgtgcgaagagtctac

SEQ ID NO: 56290 - DNA, 507 bp, Triticum aestivum
  Clone ID: PAT_TA_56290
ggacgaaaaagtggtctcggcgccaaccaccggcggaagctaggaccaggctatgctcacaacacctgtaaggcgaagatgctcctctccatccattggagactctgcatgggcgcccgcgcactgctgggagctggtgaggtcgatctccatggctcatcatgactccacaacacgcacaccaacgagtacgagacgcgtctactactacgacctgagaggattcatcatcctggttcatgccaacaagctgtgcacggcctactccctggactgctgctccacattgtgcgtgccgctgaaccacaaacctgcgccactcatgaatcctcttctcataacagtgatcagtccctaatactgacctccggcgcggcgctgggaaagaactgatctaactggcgtacaacacctactaggaagggtcccgctgccaagcgtactgtccgttagaaggatactgaaggcccgccctgacttccgtggcaataacattaggttccgtgc

SEQ ID NO: 56291 - DNA, 443 bp, Triticum aestivum
  Clone ID: PAT_TA_56291
gcgggcaccaacaaggactcccaggccttgtattactccatgcttaggtcctccatgtgacaagggaccggagatcgaagcggacccgttgagccaccggctgcagctcggggtgccggacctccactttaggaggtaccggactcgctagccttcaaaaaaagtgctgccatgatcaccagggagaggccgtgagaaatctcataggtgagatactacgaccttcgaccatagcttcagtggtaggaactagataaagaacaattacctgcgtatcacgtggataagctgctgggggccgtcgccctcgagggcatggtgatccccatcttcgaagctgataaaggacacgcgctgaccgaggcctaatggcactctgaggtgccgtaacgcgctggatgactctgatacatgcgctcgcaccatgcatcaagatgcggcgg

SEQ ID NO: 56292 - DNA, 612 bp, Triticum aestivum
  Clone ID: PAT_TA_56292
tgcggtggcgcgcgcataggagtgcgaatcatcatcggaaaccaatccgccgacgccaccatgggtatctagcgtgactccatgcacaagcgccgggccaccggtgggaagcagaaggctcggaggaagaagcgaaagtatgagctcggccgccagccagccaacactaagggtgcaagcaacaagacagtgaggagggtccgtgttcgcggaggtaacgtgaagtggagggctctccgccttgacactggtgactcctaatggggtagtgaggctgtgacccgcaagacccgtcttctggatgtggtgtacaattcgtcaaacaatgagcttgtgaggactcagacccttgtcaagaatgccattgtgcaagttgatgctgcccccttgaagcagaggtacctgactcattatggagtcgaaatcggtcggaagaagaaagctgctgcagctgccaagaaggaacctgctgaagggcaagacgctgaagttgctgctgctgccacagatgaagcaatgaagagcaacattgcacagatgaagcttgagaagcgccagcagggacgtgacactggactcgcacattgaggagcagttcagaggtggaaggct

SEQ ID NO: 56293 - DNA, 635 bp, Triticum aestivum
  unsure (1)..(635): unsure at all n locations
  Clone ID: PAT_TA_56293
acgtcaaggtgaaatggacgttgctgaggtcgccaanaatgagtacgatcttgagaacaaggtcgtcggtactgttgccgtcggccgcatcggtgagcgtgtacttcgccgcctcaagcccttcgattgcaaggagcttttgtactttgactaccagcctctgtctgccgagaaggagaaggagattggctgccgaagggtcgagaacctcgaggagatgctggcacagtgtgacgttgtcaccatcaactgcccgctccacgagaagacccgtggtctgttcaacaaggacctcctctccaagatgaagaagggctcatggctcatcaacaccgcccgtggcgccatcgtcgtcaaggaggacgttgctgatgcactcaagagcggccacctccgtggaacggaggtgatgtctggttccctcagcccgcgcccaaggaccacccgctccgctacgcccagaacccatgggngtggaggcaacgctatggtcccccacatgtccggtacgtcgattgacgcacagcaacgatacgctgccggcactaaggctattctcgactcaatacttctcgggacgtcatgattataanagcggaggatttaatagtctaacaatggtgactacgccacca

SEQ ID NO: 56294 - DNA, 624 bp, Triticum aestivum
  Clone ID: PAT_TA_56294
cgtccctgggcctgcgcgcgcgggactggcccgccaaggccgacccctgcgccgcctgggccggcgtcgcctgccgcgccggccgcgtcgcggtggtccggctcggcgggctccgccgcacccgcctgggggaacgcagcgccgccttcgccgtcgacgcgctgcgcgggctcgcggccctcgaggagttcaacgcctccgggttcccgctccccggccggatcccggcctggttcggccgcggcctcccgccgtcgctcgccgtcctggacatcagctccgccggcgtcgatggcgagctgcccctctacctcggcatgtccgggaacctgaccaccctcgttctcgctggtaacagcctctccggccggattccggcgtcggttttctccagtaaggctctccggacccttgacctttccaacaacaatctcaccggggagcttcccgacgtgtctgcctccgccggtgacggagccggagctctgtttaacgcctcggggaattcactttatggtgcgattggcgatggcctggtgtccctcaagaagaggtttcaggtggtcgatgtgtcgagcaattactttggccaagcggccaccactggatttcagaatggctctg

SEQ ID NO: 56295 - DNA, 567 bp, Triticum aestivum
  Clone ID: PAT_TA_56295
caaaccttttaccctgacccgcagggccctggccctcctgaggcctgtagccgtatcctctgcctgccgcctgagttgttccgctgtacgccatggcaaacatggctgcaccatatgtgcgtcccttgtactgttgggctgatggcagctccaactgggctcgtctgtggcatgaagccatcccggatatgatcatatctacattgacgacaggcctcaacctgtgcgccttaagaggaaatgcaacctgaaaattgaagcatctaaggagacctactccaacaacgatgactcacgcaccaagaacctggacgttggagccaacaatcctgcgtatattgttatgagtcaccttgggaccaaaggcaaggaatgttgccatggacagcaagagcccaccccttaacattgtcaatgatactgttacaaatgcaagaaaggttgacctgaaggaccctgtcgaaaacattgcagctctgtccgctaggcaagctgcagcagagaccaacgacatagctggcgatgagacaactgcttatgacagtgcttgctcaggtgcctattgct

SEQ ID NO: 56296 - DNA, 370 bp, Triticum aestivum
  Clone ID: PAT_TA_56296
gccgattgcaatcacatggtttcagcggagtgaccaggagtgcgagggtgctcccggcggtgagggcgccggcggacggtgtccacgacgaggtaccatgatgagctggagatggtataaaaggggaaccaattttggtcatgggctagtaggcaggaggagacatggataattggtgctgtactaactttgcgtgggggtccagggtgagccgggtttgcatcgaaggacactgctgttattattctggaggcccatttgcagagaactctctttgctgctggtgatgttactttcttcagatgttatcttcgatgtgctattatactagacaaggtgatatcaaaaaataatgcatgcctatgataaa

SEQ ID NO: 56297 - DNA, 639 bp, Triticum aestivum
  Clone ID: PAT_TA_56297
cccgtctccggcggacttcagtagcccccaccccccgccggccgccgcagcccccggttcctcgaggatactccacggaagcagggctccatggcccagggcaagaagaaggcggcggcggcgtccaagccccgcaagccgaagcagcgggacgcagcggagaagaagaggggaagaaggccgacatgtcggagttcagggcgcagctgggctccttcgggctcaagatagtcgaggtcaccgcagacggcaactgcttcttcagggcgatgggcgaccagctggagggcgacgaggggcagcacatgaagtaccgggagatggttgtgcactacatcgtggaacaccgcgaggagtttgagcccttcatcgaggacgatgtgccgttcgatgactactgtgactccatgatgaaggatgggacttgggccggcaatatggagttgcaggcgggatctcttgtcacgggaagaaacatctgcatccacatgcttaactcaccacggtggtacataaacaacttttctggtcgtgaagctagcaatatggttcacttatcttatcatcacggtgagcactacaatagtgtcaggcttactgaagatccatgccaaggtcctgcaatgccagttgttatca

SEQ ID NO: 56298 - DNA, 543 bp, Triticum aestivum
  Clone ID: PAT_TA_56298
gtctagtacccctacttcgtgcgcgggcttgcctgcgccacctataaccaatccctacacaacgcctatccaacccgagtgacccatacattccaagacatctactgcccgggacgaccgtccttcccacagttacatgttcctcacctctaatgttatactacgtcgattcgccatgcgatcgatgccatcaacgggcataacctggacagccgctacatcccgtcaaaacccccagacccgcctatccttagagatgcggaggcgctttcatcgacaacaagaagcgcggctgctactgctgtcacactggcaatcgaggacgctgctgcagctactgtacaggccgctgacgctacagaggtgctcgctaatgacggccgaggtggcttcagatgccatgatggctgatgctgatactgcaagcatgcgggattgcggactgttgcatacgtgatgaagccgctgctgttacctggcgctactcacagtactgaatggtgctgcctctcgctagccagactatcctagctaccgatcctt

SEQ ID NO: 56299 - DNA, 644 bp, Triticum aestivum
  Clone ID: PAT_TA_56299
ccatttctattttgatgttgcaaaataccgactttatgttggtggccgagttagctacacgagtgaaaagctgccagacagtccttgctgcacatctactctaccttgttagggccattgctccgattatgccacacttagcagaggatatctggcagaacttgccctttgaacacaccttggaagatggatctgttgccaagtttgcttttgatctaaaatggccagataagaatgaagaatggtgctcggttcaaaaggatgatgttgattttctgagtgttatcctggagttgagatcagaggtgaacaagattttggagaatgctagaacaggaaagctgatcggcgctagtttggacgcaaaggtttatctccatgctgaaaatcctgatacggtatccaaactgaaggagctggcttctgcaaccaatgatgcagatgcccttcatcgcctatttatcacgtctcaggtggagattctcccatccctgagtgaggaaaccacatcaggcgtgtcctacgcaggaaagttcagcgacccacgcacgggagagatctggatcggtgtgactcgtgcggatggcatgaaatgcgagcgctgttgggtttataccaaggacgttggggtcgttcggtgacca

SEQ ID NO: 56300 - DNA, 653 bp, Triticum aestivum
  unsure (1)..(653): unsure at all n locations
  Clone ID: PAT_TA_56300
cttcccggtcgacccagcgtccgggcttcacaatcactcgntagttcttcaacatggcgttctcggcggatccgaccgcacagccctacgtcgtcgaggattgccgcggggtgctgcagcttctcagcgacggtacagtcgtgcgctctgcggccttgcccttccctgtcgacggcaacgtcgcatataacgaccacggccgcgtcgagtggaaggacgccgtgtacgacgccggcctcggcctcggccttcgcatgtacaagccgacgacgaatgccggagaggagggcaagaagctccccgtgctcgtctacttccacggcgggggcttctgcattggctcctgcacgtggcccaacttccacgccggttgcctccgcctcgccgccgagctccccgccgttgtaatctccttcgactaccgcctcgcccctgagcaccgcctccccgctgctcacgaggacgccgccgcggccctcctctggatgcagaaccagctcgctttggacccgtggctcgcagacgcggccgacccatgcaaggtgttcgtctccggcgaatctgccggtggcaacatcgcgcaccaccttgccctccggttcggcagggcagggctggacccgatgaggatcgcggngtacatcctgctcatg

SEQ ID NO: 56301 - DNA, 599 bp, Triticum aestivum
  Clone ID: PAT_TA_56301
acagtacgatcacagtacaatacggagcgaccgcaacacaagcccacgggccgctcgtgaacgcagaagcgcagcatgggctacaccctgtacggtcagttggagaccacatcatgcgcacccagtactaataaccttcatcacataaattaccagtcaaagtatcaccccaccacgagacgaaccgaatggactgtacgaggcccgactgcacatgctgaacatgcatgaatagactcatgccatgctaaggtcgctggggctgtgtacagtgaacaacctgaaggatgaacattcattaacattaatagatgattcattggtgtatgctaaagacattcaaggttacgtactcttgcattcgattatatagctatcgtatagctactaactagaaataaattactgtatatgctatgtacaaaacagccacctgtataaaaccctacgtcatccaaattattcgacctggatgaaattggaaagtctgctaactgaatagtcaacaacacgatcctagctgtctgacttcccaacttcctttcaaacagcatggatacaagcacgcaccctgatgcctgaactctatacatatactg

SEQ ID NO: 56302 - DNA, 643 bp, Triticum aestivum
  Clone ID: PAT_TA_56302
gggatgcgcagaccgatgcactcggtccttggtctcgtctcgatgatgcagcaggaaagcatgaatccagagcaaaggctcgtgatggacgccatcgtcaagacaaccagtgttgcctcgacgttgatgaatgatgtcatgcaaacatcgacgatggaccgtgagcacttatctctggtgaggaggcccttcagcctccactccttgattaaggaagcggtcagcgttgtaaggtgtctgtgtggctccaagggggttgatttcgagtttcaagtggagaattctttgcccgaaaggtcgttggcgacgagaagagggttttccatattgtcttgcacatggtaggcactctgataaatcaatgccgtgcgggctgcctctctttgtatgtgaatagttacaacgagatggatgagaggcataataatcaggactggatgctgctgcgaagagcaatcttttctgccggatatgtgtgtgtcaagtttgagattaggattaaaaaatccagaaacagccttttggatgcgtctgccagccaaataagtcaagagccgaacgctagcagttcggagatgggccttagcttcaacatgtgcaagaagattgtgcagatgatgaatggtaatatctggtccgtatc

SEQ ID NO: 56303 - DNA, 418 bp, Triticum aestivum
  Clone ID: PAT_TA_56303
ggaagcttctccactcgaattcagttcatataatgcagtattacaaggtaatgtgcaaacgttgtttcaccattcaagcattatttttttgttccattctactatgctccacttcaaaatgtcaagtctagcttttttgtttgacacaaagaaaaaaataaatatttaatgcgactaggaattagaaaatagcttcttctccaaaccaggcctggtttcctacacatggactagcttcttctccaaaccaggcctggtttcaatcaaaggaaggccagctgctctttccttggcctcccacgccctctctttctcttcattaccatcgacacaaaatcacctgttgatggcttctccgttctaagtgcttacttgcttccagttgacactacataacctgatattggattctgaagcg

SEQ ID NO: 56304 - DNA, 562 bp, Triticum aestivum
  unsure (1)..(562): unsure at all n locations
  Clone ID: PAT_TA_56304
ntttttaacttaataaaggaatccagcacagattaacaacaaacgtattaatgctagtaccgagcttatagaattaattgaacaagaggaggggctgttccactatatgtcccgtggagaaaaacaatcaaccctagcagcttatttcgtgtgtggacacacaacactcgattctactactgtcgtgcgcatctttagtgacaaccaaatatataatcctcaagccacagaatatagggatcctgtaggcttactgcgggaaggaagggatatggactcacttggtggcgaccgaagctattggtgctggggaggcagctaaagaggcgtgctgactagatcatgtaaaggacaatgtcgcacacaacggaatcctaggtgatgggcaccgatgtccggttatgtctgtacaatccagcgaacacgcggaactcctcgctccacgtcacctgcttatcggctggtacacgaggtttaatatgtgtggcgacgccgtgcctgacgtcagaatgaagctcgtgaacacctgccatatgaggaagattatccaggatcgggacat

SEQ ID NO: 56305 - DNA, 405 bp, Triticum aestivum
  Clone ID: PAT_TA_56305
gctcaggcaaacatatttcatgcccttggtccaacgtcggttcattgcagaaggtacgcggtgggcatatggtctaacactggaagaccaataaaaatactaagcaggcctatttctgacaggcaagctggtgctctaatacagactttgacaaccatctgcccctaaaaagacacggaaacacacttacagacaaaaaccacagagtgggcacatggactccgaggagagtcaaactgaaccttggtgtgcaccgctccaggagcatatgggcactgaactatacgaactacaggctaagcattgcaccacaactggctaatcagcggaaatgccttctgtatagagaagatctggacatgctctctgcacaatacaataacttgctgagggaggggaatgaga

SEQ ID NO: 56306 - DNA, 571 bp, Triticum aestivum
  Clone ID: PAT_TA_56306
tttttgaccacgaaaggcgtacattcctgcacgcgcgtaaaacaggagccggctgtatgttgcaattacattaatataacaaaacggtgagagaaactctgctcactatcgcttatctggctgcacataacaattgcatccaaatgtccttggttatttgcaaactacatcttcataatcaatgaatctaaaaactaggtccatgcctaccaaaattaacccacgccctccaaacaaactcctacccttccgtgataactatcccaactcgatagttgtccatggggtcggtgaggggctcggcctccggctccttgatctcgaccaccaccacgcactacgtcaggaaaggcttgttcaccgacgcggtgcgcttcaggcaacatctcaccacacttagtggggtcgatgataccagcagacattaagctctttgactgcccagtggcggttttgcagcctaacttgaagttgacgctagaaagaacctttttggtaacaacactgccattgacaccagcattcttggctatcaattcgagtgggtagacacagggccctgctgactatt

SEQ ID NO: 56307 - DNA, 578 bp, Triticum aestivum
  Clone ID: PAT_TA_56307
ttttcaacaaataaatttgttttaatgacaaatatgtactacatcaagtacgccatccatgggttatatccattatcaagtttcaagggcaagaaactaatacgaagtcggtgtattaagaagtaaaggttacaccacctaaaatacaaaaaatactactgcaggaagcctttcttaacaattctccaaatttcaagagacagactgcctccgaaattcaggagacagacaggcaggaagcatcaacttccaagttacggctgttcttcgaatctcatttgataaccaccaaggaacagatcagtggttgccttcattcgattgtgcataggagaatgcagcctgtggaggggccgctggggccaggggtggagcgccagaagttgagcctgcagttggtggttgatttggttgatacatcggtggaggacctggaggtgatgcgttgttggacatgggtgcacctggggccccaaatgttggaggtggtagtgtcggaggccttgggggaggtgccacctgcataggcattgaaccaggagggcccccgtgctgcggcatggttggagcaccaggat

SEQ ID NO: 56308 - DNA, 541 bp, Triticum aestivum
  Clone ID: PAT_TA_56308
cgtccgcatcaggacagcattgatcacaacctaatcacaatgttcatactcactgatcacaactgaggtttcaccaatggaaatcagtgtcgtatataatgtacccatgtgaatgcgcctcccattagcagacatcatcgtcgcccctatacatcctactgctaggatctagcatcacaagagcaaactgtcagtcagcaatggctggcattcgctcaatgataccggtcaagcgagaggaatcatcgcaaccccgttggtccacgcctcgcggttcagccatggctaggcgagcacatgcgcctcttcgaaacctctcaatggagtgtgctggacatcaatgagtgttcatatgcacagggcccctaggtctggcacaggtaatgcagacttgcgttccttgacgggtgctgcctggacttgttctttcttcttttgcttcgccttccctttctggcccttcccttggccaccgcctttgttctttggaggttctcttgacggtacagccgtggctaaactacaagaagccttgtgcttc

SEQ ID NO: 56309 - DNA, 529 bp, Triticum aestivum
  Clone ID: PAT_TA_56309
gacaaatcgttgcgattattgtgggcatgagacaagaggaggacatacaaaatgtagacgacacgacgcagaaatgataacctccacgattccaaaaaaaaaagtgagataaccttcacgaacgacagccactcgatcgttcttctcagcaggctgcttccgtctccgtggccatgaaccgcctgattacccggacgagctcgccggtggcccctgacgtcggtttcaccccgaagaacgcgtgctcctcgccggcaaacacaacgagctcgacgtcatcgttccccttaccctgcgccgccttcagccgctccgcgtactccacgttcttgtccctcagcaggtcgccctccgcggccacgacgagcacgcggccgacgtccaacgtctcaaggcttgggctgtccgacccgaacgggttcaccagcgggtggtccttgttcgctccggcgggcaggaagaggcggcagtacctgtcgcaggtttccctattcaggaacgccgtcgccggtgagtcaagctcggactg

SEQ ID NO: 56310 - DNA, 317 bp, Triticum aestivum
  Clone ID: PAT_TA_56310
acttactggatgacgaagcgtcactgtagaacagacgtacccacacccaacggatctcgagatgtctagagggccttcatcctagcacaacaggggcacggacggctcaaaagtacattcactatgccacggcgtggggggagtctaaggctggctgttcatgtgatgacgggtctcggagctaaccccatccatggaaaccacctggacatgcacgctttaaaccatggcgttcttctcaacccagtagcgcatccatgactcgcactttgccaccttaaacttgaacctgctagcaatctcagtggacccactag

SEQ ID NO: 56311 - DNA, 550 bp, Triticum aestivum
  Clone ID: PAT_TA_56311
actgagctcaagtgagcaaggcaacgtgcaatgacaaatgctcaacaagttgagtcggtcttaacacgagacataatccaagaaattccagttctaccataaaggaatcacgacctgatacatccaagggtgactggtagtcgtaaggggggaaacgagatctaaccattaattagcaagggcaacgaagatgcccggtaatccctacacataatctaaatctaatcagcaaacagaagccatagaccagcccccgcaaaaaaaaaagaagccatagaccagaatcaaattgtcctcttgaaccaatggaagtccagtccagagtgcacctgctacaaaaataatgcccccaactgtgctcttgaagtcagcgcctgcttgccaagtcaaggtaggggaagacagtccagtcacctgagccgacagctgagaattcttgtgcaagggtaatttaggtgatgtaacttccctgctgatgatgaagcaactgagcagaggactttgcgtccaaatacagaacacgaacttcttcgagatcagccttgcagat

SEQ ID NO: 56312 - DNA, 354 bp, Triticum aestivum
  Clone ID: PAT_TA_56312
caggccttgaacgagtatggatctcgcgtcgaagcctggttctcttgggtcgattggaactctgtgctcgccactgtggcggcgtctgtcattgttccgctaaggcgcaaacgacgcactcctcgggggaggcgtgggtcctcgacgacgattgtcgcggtcgagtggatgatcataatgtccacggccctcacgctatggtcgtagcagtagcgcgtctgcaggtaaaagcgctactactataattccctcactgttaccgataggctaggaatagtagtaacgatcctgcaaacagcatgctactgctaagtgacttgtagtagcgcgtttcttgtatagagcgctactgct

SEQ ID NO: 56313 - DNA, 443 bp, Triticum aestivum
  unsure (1)..(443): unsure at all n locations
  Clone ID: PAT_TA_56313
cctcacttctccaatgcataaccttccaatcacttctctttttgaaaacaattaggcataagaggcaagtaattttttttgtattttgaattatttaaaaaaattgtttcacccacaactaaagaaaacaaaaacaaaagggaaaacaaaatctacttagtgaagaaagaaaacaagcatacacgagaatatcaaccccacgttattgctccccagcaagggtgccagaaaagagcttgataatccccaagtgcaaggaatcatcgtagcaatttccaaagatagaagtgataattatggaatgtcgaacccagaaggatctaaaggtaagatcaatattgtctcatgtcctatctgccactgatacgactctacgtataccgagcgtttgctttcatctagaaacgagaaatanactatgttgtgggtatgaagaagtatga

SEQ ID NO: 56314 - DNA, 275 bp, Triticum aestivum
  Clone ID: PAT_TA_56314
caccctaaagtgagtcggattaaggtgcgtggtccaggaggggttttggatgaaccgggggtgttggagtcctacgtggctgctgtccagactcctgcaaagtcctcatagtttgtttcgactttgcggggaaaaatgcgtccgaaccgatacaattccatactggatggctaaatttgtccagacgtgccgtttggatggttgcgatcagttagagggtccgctttacgtatgcccttacaaatctacgaccaaaaaaaatagacgtcatccgc

SEQ ID NO: 56315 - DNA, 173 bp, Triticum aestivum
  Clone ID: PAT_TA_56315
cacggggtaaatctaattgtatccacatatgttagtcgacaaggttacgctatacatccatcagcactaagtagactgcctataaatcacgtaagtccatcgtacgtgttaatgatctcagaactcaaactcagaacaataccatccatcggaacatcagctcgctctacatt

SEQ ID NO: 56316 - DNA, 336 bp, Triticum aestivum
  Clone ID: PAT_TA_56316
accatgaaaacgagtatagccggcatattgtaggggataatgcagtgcgtgcatatacatagacaccgggagcaacaacattcgaacatgctatggtcaggcatgagaacacaggtcgatgtattgagacattcacctacgagtacgagtacatactcaattgtgaccgatggtttgggttgctacgtccaagaataagattaatggcgctacgaccgcatccaacacgagccatctactcagtgcaccctaccgtacgtggggaaagagcccatgttgcttcctttgctgttgtggagggccttcattgtgaagagccgcaggatgagcacgagg

SEQ ID NO: 56317 - DNA, 374 bp, Triticum aestivum
  Clone ID: PAT_TA_56317
cagcacacaacaattttttgggggaattacacacacacacacatactagcagaataccaatggacaaaaccaaaatatgatagatcaagtttctttaaaagtaacaaagcctaaactggtcagatctaaaaacacatacccttttttatacaagtccttaaacagagcaaacagcagatggcaggtccacttaaaatctgaatattacataagcatctaagggcacaaatttgaatattacacaaggttcacctgggggttttaaaaattttgcaagaagtaagagaggagaaaagcagcagcagttcaaaaaaaaactaggagcagcaaggaaagaaaagcagcagcaggttcgggggaaagggagcagcacc

SEQ ID NO: 56318 - DNA, 673 bp, Triticum aestivum
  Clone ID: PAT_TA_56318
gcccatcctccagcacacgccctccccgtactcgtcgccggcaaagatgactccgccgctcctggtgaagggcctggtggggctggtgtaccggttcctgaaccaggacctcggctggaagagctccagcttgggcggctcgctggagaagacctccctgcccccgccgccgctgccgtggaggaaccagctcagtgacgccgtgttgccgtgcaccgagtgctcgaacttccagggcttcatggtcctggtcaccgtctcgtgcgccgacacgctgatgcccatcgacgccggagcggcggcgagcgtcgtgtcgatgcccttgtcggtgccgacctcctggacggggttgtccgtggacctgctcacggacagcgagaggatgtccgactgcgccaggggggtgagctgcagcgatatgcgcgacgggaagtgcttctcgtcggagccgtggccttgcctcgccatgagagtctcggacaccagctgtatcacgtcacaccgtatgttgtcgacgttgacggcgacgtcgatccagttctcctggaacgcgactctgtacgtgaactggatgacgctctcgagctgctggtagttgagcgagaagagcagtctctcgtctttgaccagctggtgctgctgctggtggtggtggtgatgggacgggtggtgc

SEQ ID NO: 56319 - DNA, 505 bp, Triticum aestivum
  Clone ID: PAT_TA_56319
ccttggcttaaaaggtggcccggcaattccagggggggggccttaatggtggccaccccttccttccggcttaacttttccccacaaccctgggccgtaccaaaacaaccagggttccacctttgggtaattggcccaaaaggcattgtcctttccttggcggctaaaggaaccattggattgtccaccggttttgaagaagggtgggttatttgaaccaaggcttttaagttgaagggtttaattaacaaaccaattacttaacccaattgcttaacccttgcttgattaacttggggtttttcccttgttgaattgttatttttaattaatcaaagaaggaaggcttaaccgtaagaactgccgcccggcttcgtggtcccgaatgccttgattattaagaaggcaccaacaaaagggaaaggcattaaccggttgaccccccgattttttgcttaaaatacttgccggtgaacggcaaattccaaatcaaggccaggaaccg

SEQ ID NO: 56320 - DNA, 539 bp, Triticum aestivum
  Clone ID: PAT_TA_56320
attccgggggaacgcacgggcactaacttaaacttggaaatatatgagttcaaaaatggaaaaacaaaaaatgccatgtcctaggggaaaaaaaaaaacgggcatatccaaaagccgagcataaccaaaaaaaaaaaccccctccatccggaattacttggcgcaaaaaaagttacaaaaggatgtatctaaaacaaaaatatgtctaaaaacaaccatttgcccaaaaagtttttgcgggcggggggagtttcaaatttaaaggacacccgttccaaaaacactagttggaccaaaaacaaatttcctgaacgcaaataaaaaggggggcatgcaaaccttataaaaacaaaccggaaaaaaaaacattgggttgccccatctacttcacccctgggggaaaactaatgggggttgtcccccgccccgcggtaaaagcggttgtaggcggccccccccacaagggaaataccaaaggcgacgatggcgatgcctaaccccggaggggcggggcgcaactggttccccaccatgggggg

SEQ ID NO: 56321 - DNA, 577 bp, Triticum aestivum
  Clone ID: PAT_TA_56321
gatctcattgtttatttccttcaaaacaaagggcacagggccaggcccaagcaacaggcggacagtcgcggccgccatgtttctggacaccatggaggttgcaaaccgagggacctggaacgaggcctcagcgcccacactgacgacccaggcgccacggaaaccccgggaaaaggagggagtcggcaaatacggcaagggcagcatttattgtggcccaagtcgaactcatacttttaggcttaaccagactcctctgaactggtggcaaaaaggacggaaacttgcccaccggcccgaaaggcatgaggcccaaagccacggactgggtcaaaccccctaggaaccttgcttctgagcttccgcgcctatgttgaccacatggctggggatgataaccccaacttttggaagaaagccagtgaggaatcccacacccctaaaatcccctgggcttaaaacctgcttcggaaacataaaccacatcctgtcttaaaggatgccatggccccccatggatgggaaggagaagatcccccacattggaaggggacccacgcctgtaatgtacatacgg

SEQ ID NO: 56322 - DNA, 542 bp, Triticum aestivum
  Clone ID: PAT_TA_56322
gggcccaaaaaccccgggtgggggtaaaaaaacatgggccaaaggcttgttttcacaaaacgaaaagggtaatctccaaaaaaaaaaaaggggactccctttcggggggttccagccaagggacagtttttccttggacaatcccaagggataattggggattcatttattaagggaattcattggaggagcgaaaacctttttggggagattctggagggggccttttaggggggctacaggcccactaccaggtggtctggtgcagggccccgtaatattaatgccggtgggggggtccatgctttaaacaggtggggaggagcgaaaacctttctcgggaaattctgcggggggcctttttggggggctacagtcccactaccagttggtctgttgcagggccctgtaatattaaagccggtgggggggtccatgctttaaacagcctcgggaagaaactgggggaccatttccttttactggcgggggtacagatataatggggccgtttcggtgggcaagggaaatttaacaggggc

SEQ ID NO: 56323 - DNA, 584 bp, Triticum aestivum
  Clone ID: PAT_TA_56323
gggtaaagcaaacattctaagggggaaaaaaagcagggcttttgctgggggcccgattggaacaaaaaaacccgaatcccgcccgcttttaggggccccaaaaaaacaaagcccaaaaacttttaaagggcataataaaacaggggggggggggacaacagtttgagccctaaaaccaaaaccgacttccattgcccccaacaaggcacaaacgggtattttaattcaccccactggccggctccaaattttttgggagcgggggcttccttaatctaaaaaacggcatcctcatgggggggggagggccaaaaaggcaaattggcacccaggagccgcatgaaaaaagggcgggccttggaggattccccgcctaaactggccagctttgataaaaccccgaaaaaggcttgttttgcaagggtgcaggcccgggcaggggagttcaaaatctcatagtaaaacacaaaaaagttgagggcaagcccaaccctgagggggggggttggagccaaatctactagggggaaatcctgagcagttttgtacgcgttcatggggctctgggggggttccttcctttc

SEQ ID NO: 56324 - DNA, 520 bp, Triticum aestivum
  Clone ID: PAT_TA_56324
ccgacccaaaaaacccggtttttttaataaaacaggggcccatgatttgaaatatgaaaggggggagcgaccaatcgataaacctacgggccaaatggacggaacaacatcagtttgggttggcccgaccaggatcaaatcgataaaacatttaatcatcttaaggggataaccggttgggggggctgccctctaagttgggacatgtccagcgccgggtccagttccttgtccacctaacccaccacgcttatgttgccccccctgatgatgaacagcccgaggacaagctggtgaaccccctcctaaggggagaaaaccctctcggggaactcgccaaggataatgttgggggcctggccaaacccccaaaaagcccccacaatgttgcggccgccgttggtaataacggaaaacacctggtcaacaagggacttaagcgtgggccccacggaccccatccccttttcctcctttcctcctggggcttgggggggggggctggtcaaatcaaataaag

SEQ ID NO: 56325 - DNA, 236 bp, Triticum aestivum
  Clone ID: PAT_TA_56325
cccgccccaaaaaattaaacagcacatcagaaaacaggtgggctccagagtttacccccccgaagggtgggaaatcctaataaggggctcacgggctcaacagattaacaggccgaacaacaaaacccgaattcggcactacctcctaggggttcatggccagctagtccccatagttcgggggggggggggccccatagcctcctccattgggagggggaggacctgccccccct

SEQ ID NO: 56326 - DNA, 539 bp, Triticum aestivum
  Clone ID: PAT_TA_56326
acggaacattggggcaggccccgttactatttttcgagatccaaaaacatagcgatgcgatttttacacgaaaacacggccacaaacacacccaaacagttaactacgaaacttaggggggggggaacttggggacagccttggggccctcggaaacggggtgcttggcaagctccccggggaggacaaggcaggcaccgttactatttttcgaaatccaaaaacatagcgatgcgatttttacacaaaaacacggccacaaacacacccaaacagttaactacgaaactcaggaggaggggaacttggggacagccttggggccctcggaaacggggtgcttggcaagctccccggggaggacaaggcggacggaggtctggatctcccgggacgggaaggggggctttttgttgtacctcgccagcttaacggcctcgccggcgagctttttaaaaatgtcgttgatgaaggagttcatgatggacatggccttggaggaaatacccatgtcggggtgcacctgcttcagcaccttg

SEQ ID NO: 56327 - DNA, 553 bp, Triticum aestivum
  Clone ID: PAT_TA_56327
gggggggaaccaaggcatcaactcattatcaaaggggggaaaaaatccagaaatagctaaccaaggaacccggggataaatcaaaaaactagggggaggccttaataaaatataggccactcatttggtaaccagaatgggtggtcctttttcctaaagacgggtcccgggggcatacaaaaaacaaccagatccttatttggggaacgcttattcactcgacttggaaggggcaaccaaacaaaaaaactttaaaaacgggggaaaagccatgcaaaaggggggaaaaccaaactttgtccatgtggaacaccgggtccccgcacttatgctgggcccatccctccaaaggaagaaaaaaccccgggaagcgccaagcgctaataacccttcttggaagccagtttttgcaaaaaagaacattctggaggggtttaggcaccctcatcgccggagtcgtcgagaatgggcaaccctccttgggcgttatttttggggggaactgtgagtacgggaaaaaccgggttcctttcggccccctgagctgttcggg

SEQ ID NO: 56328 - DNA, 683 bp, Triticum aestivum
  Clone ID: PAT_TA_56328
catacattatgtttcacagactaactacgaaaaaagaaacattaggtgatgagaaaaaggagcctcaacactaagtttcaggcatggcatgtcagcaggaaaaggtacataatattcataacaagaaaccaatgcgccatccgcccgccggtccccatctaccgtccaggagaatgcgcacccaccggcatccggttgccatcttacagcagacaagcgtttccgaaacaaactaactgggcgcccaatgcccccaatctagcatgtatgtttctgagtctctattaggcacccagaatcctcctagtgatgaaaagtaatatccaggaatggcggtctacagtataacagcaacttcatttgcgttgcttaaacttgtcgtcgccctcgtaatccgaaccctcatcgtcatcgtctgactcctccacctgcttaggcactgcttcgctattgggttcctcgccaccaccgcttggtttggcccgcttttcattcttacgctgcttcttcttttggcgcttcaggcgcttcttggatgttcgctcctcggctgctttcagcctttcgtccctccgcagattgaactcggccacctgcttcctcttttcgtaatcagtctccatcctcgttatacggtcctgttcccttctcctcatttgccgatactgggtggaagtcgccag

SEQ ID NO: 56329 - DNA, 761 bp, Triticum aestivum
  Clone ID: PAT_TA_56329
gaaaggcaaactgacatatgattgatagatagatagatagatatagtacatataaatgcaacaacataaatataatacatcattcacaggaatgagaacccagatactatatagcgagttagccacctactagtactactacatacctaatcctccttcattctctttctttctacaaccaagaataataataatcgcgctacgaccgcatccaacacgagccatctactcactccaccctaccctacttgaagaagatgcccttcttccttcctttgctcttctcgacggccttcattctgaagagccgcagtatgagcacgatgctatcccgtgacggggagttctctccaggcttgagattatactcggcaccatccgcagactggatcgagaactcggttggatgtccatacgggatattgatcgctgtagcttgctggaatttctctgtgataacaacgccacgctgtccattacacttgatgctgtagccttccctctttattgccaatactgcaggttcccacatatctataaatctaacaggtagtagaacttcatatgacacatgtccagcggaaagaattttcttgatgagctccttcatttcaggatcacaagtaatctttttctgctcattagcgtaaaccttcacgatctccccctttcttttccggtcatctagaggctggacctctatggctagtaaagagtccacatcatcagcagtaaccaaatatgtgggctgctttgcacct

SEQ ID NO: 56330 - DNA, 505 bp, Triticum aestivum
  Clone ID: PAT_TA_56330
aaagattaaagaaaaccgggcaaatgcccccagcctttacacacacaatcaaaatacaacaaatgtttggcatgggtgcgatttccatcccccacatttaagggaacaacaattcacgatggggtttgcactacaaatcacggacccgggaacagggcattatcgggggttattttggacccccagggataaaactttttttttttttcactgccggggaaatgtaactgtaagggacatcagttggacaaaaacaggtttcttatctgggggatctggcttctgctagttgggacggttaaaaaccataaacttgcactggtcacttatcgcctggagctgggcatcctttttgtcaaccatggcacgtaacctcacattttcctccatcaccttttggacttaaacttttttttgggccttctaaatctcgagctggttggtccttgcaactagcctgtaaaaaagcttctccattggctcaaattgcttctccaatgaaaaa

SEQ ID NO: 56331 - DNA, 688 bp, Triticum aestivum
  unsure (1)..(688): unsure at all n locations
  Clone ID: PAT_TA_56331
ttttnnntttttttttttttttnttttttttttttttttttttttttttttttttttttttttttttttttttttttttttttttttttttttaaaaaaagaagcgggggggcgggacttgcattcatttggcagggggggatttacattcgaaaaagatttggcaagcctgttttgggtaaaaagggaagtccattacaggaaacctatcagcagtttggattgacctaaacacttggatttggaggtgccaacaccaatttggggtcaaaagttccctttggtttggctttaaagcgttcgccctgaaagcggaagttctttcttttccttgctctgaaacgggtggggttctaagggtgtttttaatatggggagacccttacctttttcctgggggggccatatttctaaaacttgacaaggccttcaatcaaggaaaagagggggggatccttgcccattccaacattatttccaggataaaccttggggcccccctggcggatgaaaatggccccgggcttggcaagctggtccccgaaaattttgaccccgaggggctggcccttggagtccctgccgtttttggggctcccggccccctttttgggcgccatttggatgggcaacccgcgcgccggaagggtcgccacccccacccccccggtggcgcttccggggagcg

SEQ ID NO: 56332 - DNA, 609 bp, Triticum aestivum
  Clone ID: PAT_TA_56332
aaatcaaggaacagctcctcctcgtatttcctacagatggcaagctttgcggtccaagcttaagctccatatccgagtggaccctttggcacaggcaaatgccttgaaactttgaaatcgtcaaagcatgcagggctggacctacttttacctgtacctaacggcaggtcgatggttaaccctatttttggtacaagctgcaagaatgctttcgtatatacccatgggggtgagttttacaacatggctatctctcacccgtctactgttgaatggacgatacttgcacgatgtgcatccagaacgagtgtccctgatagaggtagactactccaacacatgctttataatggtgcactcagaatactgcatagaaataatcatgtgtactacctgtgacgaaacattcacctctccaacacgctgtatcctacaccatctaggccttagaattgctggcgtaacctagaaaaatggacgccatgaagccccatgcttaacaatattttgaatgactgaatataagcacatctctctggtcaggaccccagttttatatctcctaactaacagacgaccccatattccaatgctgatattggaggggaa

SEQ ID NO: 56333 - DNA, 510 bp, Triticum aestivum
  Clone ID: PAT_TA_56333
agcttgcattgatcttatggagcagaaaactattcttctttgcctttttgtgcttttgctgctaggaaattctactcatgctggtacgaaattgtcatccctatccccatgtatgattcctttccgatgccacccagagtaaatcaatattgtcagctgaactgcatggattcctttgaactttctcaatttggacttcttttaattctgtatattcgtgtctacagaaatgcactgtgaactgcacgttcctttttatggcgctacttgcgatgaattagcatgccagaatgcctgccgaggatcctggggagctcacacaaagaaagcttattgtgcacctgtccacggttccctttggggttgtcattgcatagtatgcgatttctagaatttgtctactccatcatgttgaacaatgtacagtgatgtgacccagtaataaaatatgcgtggaagatgcatgtgagaatatatattgagcataaattttggtgcacttgtgatttc

SEQ ID NO: 56334 - DNA, 328 bp, Triticum aestivum
  Clone ID: PAT_TA_56334
aggcatcgccacaggcgagaattcggattccttgtagcagtaactctactcttgatgtactatgtaaactgcaaagttacactgatgcaaaatactactagtacgagcacgaaccatccttcctatcacgacatcagagggaccttctcttgcccctggccgtctgattcgctcaagcaaggtggtctcgccgccttgtagtagaagaaggctatcatcctcgccaacacctgggccgaccggacagctttgtgtcggtgcaggatcttccctgcgttggggaagagcagctgagggaaaccgggcaccttgggagctggcacgaggg

SEQ ID NO: 56335 - DNA, 726 bp, Triticum aestivum
  Clone ID: PAT_TA_56335
ggcagggcaacaactattttcaataaacaaagatacaccagaaaatagagttaaagaccaaaataaaagagggttgccctagcaacatgcgggttcaatcccagtgtaatacaaaaaggagactcttcaccttgtgttgtaactcttttacagttggtactgcattgatgtacacaagtaaacttgaccggctttatcaaataaaagtttgcactttgaacaaaatctagcacacccagttttgcagctttcgctatctgtgaaaactgaactatgcccaccagttggtccacaaattcaagcgaggcaactgaataatgaagaagtgcccatgatacacgtcaaattaactattcatgtcatgtcaatcatctcatcaagacctctttaactttgtagtcctccactaattagaacctgatattttgcttagcatcacaatggcaatttatttttcaacctcagcccttgctgtctgcctcaactcaccttgacaacaaacgacaagcatgatagaatagctcaatgagcacacaacagataaaagagaaaggttttaaaatgactaaccacgagcatgatgaggggcttggttagttatgtgtggtaattgcctataaactttgaagacacacgcatgaaagatgaaagccatgaattggaacaagtactcctacatggtaggatacacatgtttgatgtcgtagccaatggaaaaatgaaggc

SEQ ID NO: 56336 - DNA, 756 bp, Triticum aestivum
  unsure (1)..(756): unsure at all n locations
  Clone ID: PAT_TA_56336
gtgtattcctaatagctctgaacgacacatgggtcaaacagggagcatccacacaacacataaataagaggaatccgtgacaatccggatatactagtgtataagggaaaaaggtaggtccaattggtcagtctgtgacagtttttgtgacggtatatcaatgttcgtcatcaagaggtcaatgtttttatgctcatttgcgtcttgctgatcggtgacggatacggtgacgtatttcccattcgtcaccagaaatccgtcatggatcaacagatttcttgtagtgcttgaagtatgaatatatcatatccaagtgcaacgtctgcagctggggtgcaacattcagaccgtggaccagttgaagaactccattatcggaatttggtttcttaagagacgagacagttagtccacaagtcatatgcctcaaatgcataaacatgccacatggtcttggtgccagcttctgcagctgttcataagcaggtatttgagcctgcaccatttaccaccttcactcccaaaatgattggaactacagtgaatacatgnggtcagtccattgttgccttcaaacattattgtggccttctctaactttgagcgaccatgaagtacttnagggatctcttttnctttgtactcaaaataggcaagattagcagcatgagactcaaccatctcgacagccattttgtcaattagcaaaatgttgagtttatcaagttggtggcggtatgcttaaaattggttaca

SEQ ID NO: 56337 - DNA, 801 bp, Triticum aestivum
  unsure (1)..(801): unsure at all n locations
  Clone ID: PAT_TA_56337
cccacgcgtccgcccacgcgtccgcccacgcgtccggcgactcccaaattaccacctcgcccccaatcgtcttcggctcagatcggcgtcgcgaggcgtaccagtcccagatcgtcggagcaccgggttcgcggcgagccgacggcaaagattatggagacgccgccgccgttccaggaatccgcccactgcgacgtctgccgctgcaccttctccactttccgccgccgccaccactgccgcagctgcgggaggacgctctgccacgagcactcttcgtaccacatggccctgccgcagtacgggatttacacggacgccagggtctgctatgagtgcttcaacaaatcatcatccagacgcgggggtgttgataatgcgagttctgccgggagcgtttctggtgctgcagactccttttcagggctaaatttggataaagatgatgattcgttgcccacgaaaagttcggcggttcagagtccagctgccattatcgagtgcaaatgcgggatgccattgtgcatatgcgaggcaccaaaaccagaacctgcgcctgtaaagaatatcagtgccgcttcgtcagctgcgcaatcaaacccaaagcctaaaaaaccttctagcaaccagcagtcagctgaattaagcttgaagaaggcttcagctacttccagcagcaactcaagctcattcttaaatcttggcctgatgagcaacgatagncatgataagactccgtctgactatgaagttactggagagggactgagagaagcgattaagggtggngatattaaagct

SEQ ID NO: 56338 - DNA, 99 bp, Triticum aestivum; identical to SEQ ID NO: 54321
  Clone ID: PAT_TA_56338

SEQ ID NO: 56339 - DNA, 258 bp, Triticum aestivum
  Clone ID: PAT_TA_56339
aaacaaactaagggcccggaaggacccccaagctgctttgtttaaaaaggggcagtccacaggggttttacatcaggaccctgaacgaaaaaggaaaacactaaccggcccctggcttttacaaaaaggaccccaaaaaattgatgaaaaaagcaatcgggtccctggcaactccagcctgaaacttgacttgttttcaccggggacggcaccccttgggggggggagccctccttggcccccccccccgaactccgg

SEQ ID NO: 56340 - DNA, 603 bp, Triticum aestivum
  unsure (1)..(603): unsure at all n locations
  Clone ID: PAT_TA_56340
tttttnnttttttttttttttttttttttttttttttttttttttttttttttttttttttttttttttttttttttttttttggggggggaaagatgtttctcattaattacccaaatacataggcgacagattggacttaaaaaattatgggcgggggcatatacaaagccatcggggggattcaaaaacgaacatgctttttcgagtcatggggggaacatggacatacacatatttttattttaggaacaaacaagaaagataaatgggaaaggaaaacccaaagcaatggcagagttgacaaaaccgcaatgggactttatatggggcccggggggagggagctgtttaggccttgccggactccttgcaacccggggggttgaaggggaaaaaactgacccactggacctggggcatgttggcgaatccgatgatgcggacatacgcgggaggggactcctttttgacctcctccaccttgttgataacctggggggggggggggcacccgaacatagggaggttccacattggccagtaccggccatcgtagtacccaggggatgggttgggctcacggaaaataaacccaacctt

SEQ ID NO: 56341 - DNA, 700 bp, Triticum aestivum
  Clone ID: PAT_TA_56341
ctcaaacaaaatgtttcacttttaacgattataatataagaccaaaatccaacaatcttcatgcacaaccaagtccctgcgtccgtattattacacactaaaaacaaacaaataagcagtctactataattctaatatattataaacagatcggctctcccagcctcacgcagaaaacccatcgaaccacacggcctacaggccgctgctcgacgcctccatcatgccggtgcggatctggtcgccgatgtccttgacgtggcccgggccgtgggggatgaacaccgtggtggtcttcgaattgtccccgagctccttgatggtgtcgaagtactgggtgaccatgatcaggtccatcacctccttggcgctcgtgcccgacaccgagtgcgagaagttgaggatgttctcccgcaggccgtccgtgatagcctgccgctgcttggcgatgccgacgcctgacaggtacttagcctcggcctccccttccgccttcttcaccagatggatcttctccgcttctcctttgtagacactcgcaagctggagccgttgggctgcatttatgtcgttcatggctctgcggacagcagcatcagggatgatgtcaaccatgagaatgtgctcaatgctgtaaccataatctgacatcaccttttcaagctcctcaagtacagcctttgcaacatcattcttttgc

SEQ ID NO: 56342 - DNA, 487 bp, Triticum aestivum
  Clone ID: PAT_TA_56342
ggacggggggaagggcccccccttgccatgggagatatattacccatgtttatggaggggacactacgtacgttttcacgttaaacattggagaacacgggaatgacgtacagggggcccaaacccccccccatagaatatgacgacgaaggggctttgtttaccgaaggcacggggcccgtccaatccggagccatggatcgatcgcaggaaaaaggtccctaggggggggaaacacctcgggttgaatgcccccccgggcgggcccacgtacccggttggtgggtcccttgctgcaaggcaaaacgggtgtgtctttccaaaagcaaacccgatcgccgggctgtttgccttttaaacgggggtcgggggggaggggcttgttgggggccggcttcaacatgggggaaaccgccccctggaaggcctcgcgggaggggttccggagcaaatcgagggccaccctcctcgccggaatttttggggg

SEQ ID NO: 56343 - DNA, 497 bp, Triticum aestivum
  Clone ID: PAT_TA_56343
ggggaaaaaaaagattttacattacccaccagccccttttggggggggggccgaccccggggggcaacaaaatggggccgggatccttggggggtttcccagggtaagggatccaaaggggggggttgttttgggccctttaattttttaaaaggaacggggcgggaaacaccacccggccaattaagggtgggagcgcgatcccggcccaaggggcaagtaggtgggggctccccgggggggggaccggccgacccggcccaagggccaactacgagttttttaacgggaaaaacttaaatttcccctttgggggggggaattaccgggggggggggccccaaactggccctccaaggggtcccggttagggggtttaaatgggcctctttccaattaccaaacactaaggggcccggttttgtttttttttggcaccccccccccgggtgaggggtgggtaatttgccggcccggggccttctttggtggggggg

SEQ ID NO: 56344 - DNA, 350 bp, Triticum aestivum
  unsure (1)..(350): unsure at all n locations
  Clone ID: PAT_TA_56344
gtaaaaggaaccatgctttacattgcaaaaccaccggccagaaccctaaatccaaaatcaccccatttttatccaaaccctaggggggggggggaaccacaccgaaaccaaagcacaaaacagaaccccgggaaatcaaaggagaggatgcgaaataaaatcacgcgaagggggggtttttaaataccaaaaattctgaacaggctgggaaacggatcaatccactacttggcaaccatgcgggggatgaagtcgtcgaaccggatggggccgtccggggggacttgtacctcggggatccactcgtggaactcatggggctcgagctcctcaccgntggaggggaggac

SEQ ID NO: 56345 - DNA, 509 bp, Triticum aestivum
  Clone ID: PAT_TA_56345
gaggccccgggacttttatgggccttaaaggcccccaggggggggcgaaacaaaatacggaaacaaagggggggcccccccccccccgggcggggggggggggcccccccccccatggggggcctcaggggggggcccccattttatttagcggcaaaaacaagcaggaaaaatggggcgaacacaggtttcccccgaagccaaccctacggaaggcagcaaacccctttgcgggccaagaggggtaaagggaccaaaccccaagtttgggggcccccagggcattgagtttgtctgaggggcggcccaaaaaggggagggggggccccccccggaagccgaaagaccttatgggaaacggggccccgtagggcccaaacggatcggaagccctggcagggacaaatttaaggggggggacaaatttgccatcgctggggcccaaaacagggaaaaggggcccgtcttaaccaaaggtaatcacgggggggtaaccgggcggggagccc

SEQ ID NO: 56346 - DNA, 639 bp, Triticum aestivum
  Clone ID: PAT_TA_56346
cgcaagcatacgtccacgggttattgtctcggcagttaaacctttgaaacatgcattttcagagcggatcgtgttcggcggtgtaaacggaagtagtggttcacgatcaggaagaagtttacgacaatggtagttgaacttgctgacccgagggggtatttggcagtcttgttcttgtgaaagtagtcgttcacgttcgttcaaagagttacttgatgactccaagcccttcacggtccacggtagtcgtacacgggtcttcggtgatggtaggcgtgcacacgttgtagtcgaacttgatgcttgcgttacacgtgtcttcgtcgacagtagtggtacactagtcggagagggacttggcgtcggacttgcagcgttgtggtacacgtttcgaagaggaaattgaccgattcgaatcccttcagggttgtcgtggtacttggggtcttcggacttgccggtctcgtcaattcgaagaggtacttggcgttcttggcgattccaaggatggcggtagatgtacttggtgtcttcgggtacttgacgattccggacggggcaacaaaacatagtcgaccttgacgttttagtgctgtagtggaatgaacatccgtgtagtcttgccggtgtaggtacttg

SEQ ID NO: 56347 - DNA, 531 bp, Triticum aestivum
  unsure (1)..(531): unsure at all n locations
  Clone ID: PAT_TA_56347
tttttnttttttttttttttttttttttttttttttttttttttttttttttttaaaaaaaaaaagcctttttataaggggggaccacttttccccaaacaggttgcccattgggggcgaccccgcaaaccccctagaggcaataggttattcaggggggaaaagcccggccgggtggtttaccggtacccaaccgccaaaggcaaaccggccggggaaattccccagaccggacctttggcaggaaaatacttggacaggaccccgcccttcttcaaagaaaccccccctccccctgccaggggggtggggagcttggccttcttggcccgggggggggtttccccaggctcgggccctaagccgggggaaaagggcccgggggacccgggaaaaacaggaacccttttgttcgggggaaaactctgggtgatgggggccccccccccggggggcccccggtccacaacggtggtggagtcgtttgccccgggggcgagccttttgccccagggggggggatgggcccgg

SEQ ID NO: 56348 - DNA, 545 bp, Triticum aestivum
  Clone ID: PAT_TA_56348
atgggcacaggggggggggggaataggggggcaagggaacttacaaacaggggccaggaaaagggacaacccctttttggtccagggggggggggggggttttggggggcggccaaaccccctaagggggatttaacactttccaggatcgggttacgggaaaaaaaatgacccagggccgatggggggcccccaaacaaaaaaatttgggacgggggctgcaacaaaaccggggggattaaacaggcatttgaagtagggtaccccacccaggacgggtgtttccaggtttggggccgatatggccccaaaatgactccaaaaaccctttggtgccgaaattgtttggggccatatgggctgggggacatcggaggggtttggagtttcaccccaaatgcaaacctttccacccaaaaccaatttttggggggctgaggcgtttattcctgcaaggggctcggaagggtaaactttttcccagggaacataaaaaggaaaaagggcccaaacccctggggtactcattaaacatttaaaaccct

SEQ ID NO: 56349 - DNA, 480 bp, Triticum aestivum
  Clone ID: PAT_TA_56349
ccaacaacacatgcgaataactttggtccacgattcagttcgagctacagaggaaatagcgaactaaacaagtcagggtctcatcaggcttttggaatctgcaggcggcgacaacgagcgacgaccgtcggccggacggccctagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgaggccggagatgcgctttacgccgcccctccgcgccaggcgccggatcgccggcttggtgatgccctggatgttgtcgcgcaaaaccttcctgtggcgcttggcgccgcccttgccgagacccttgcctcccttgccgcgcccggacatggctgtggaatgggactgggaggaagg

SEQ ID NO: 56350 - DNA, 496 bp, Triticum aestivum
  Clone ID: PAT_TA_56350
aaaagaaagggggggtcccccccttttttatcgccggggggaaaaggccccggacaacaacattggaaaaacagttggcttcgttaaggaaacccggccccaaaacaggagaaatccccccctgaaccgaaaaggggggtttgccacaaccaatctacagggggggagggagcagcttcactcttttggggccccgggcatcttcacaggaaatccttaactttttcccacaatattcagcaaacccttaactatttaactggccactgccggtttgcactttcaactaattcggggggagcttgaaaatgacggaaaatatcaggaagggggggggcctggccctccacatccgggaaatttcccattttccggggggattcgatgctatccaggagcgtttcctccaaggccctcgggttccaacccaaattactaatttttccccacgaaatcggggggaaacaaaagttctgctgcccatcccccttgcatt

SEQ ID NO: 56351 - DNA, 488 bp, Triticum aestivum
  Clone ID: PAT_TA_56351
gggctgttccaaccttatcggaggcgccacacaccccaacccaacccaccggagcagacgaaggacggtgcatgcggggacctcatttgctgacgatggaaatgactaccgactgggggtttctggtgtgggagctggagaagaaaaacatctgttttttgatcatgctgttcctcatcagcaacgactaggcggaggtcatcagggcagcccaacaacctactacaatggacactcctacaatgtgctctgactcgggcaacaggaacaccctggcggtccatgcatgaccaggacaggacaatggtggcatactttgcacgaccaaatgcaataagcataacacctctgcctagctccagtacacgactctgatgcgcaaggagttccgcaagatggccaagtctgtcaagaaccgatcctgcgacaactactacaggtgtgatctgacctatccgacccttgcaaggctgacttccttgtaccga

SEQ ID NO: 56352 - DNA, 228 bp, Triticum aestivum
  Clone ID: PAT_TA_56352
gctcctcctccggtgggccgcgctgccgtgggtgctgagcggaggcctccggtcgatccgtcctgcggagcaccgatcgcgcttcgatttccggccgtcttgttgggggccaagcgaagcgagcaaggaagtagcctggaggtgggttgagaaggggaagcagaggaaccaaagcactgtacagtgatggtgctgctgcaattgcactagtcaatggggtgaaagcta

SEQ ID NO: 56353 - DNA, 436 bp, Triticum aestivum
  Clone ID: PAT_TA_56353
acacagcggcccaggctcaatcttgacccagaccggaatggcaggggcggcacagataattcttgccaggtcccccggtgacacaactgggggggggggacaccactggctggttcacctctcgaccgaaccctagcgaagcgcgatcacccggacgggccgcacaaaacgggggggggcgctggaacacggaggcctgggggtcgctcttgaagaccccctcggggaggccgagcggtatgaaccccgtgaggccccccgccttagggcgggcccatcgctcactctgcccacacccgcgggtcccaggcggtcggggggcgcctggagggcggggggcgggggggccgggctgggtgggggggggtgcgcggggggtcgaggcgccggccttggttgcgggggggggtgggctgtggggggcggggggtttggt

SEQ ID NO: 56354 - DNA, 593 bp, Triticum aestivum
  Clone ID: PAT_TA_56354
aggaaaataaacatttcaaacatagataatatatttgtctcacatttgtccccatacgagaagctaaaagagtgacatcaataactattacatgaaagcaaatagggcagttacaaattcttcatggctacgcaagactaatccaacacacatcttcaagaattgggatatacacgacaactgatgtttactaagatactagagccatgccaagtattgcgagcctttagtgaccatctgatgtccattccacaaaagagggagtgtaaggtaggccttccaagaaatctccagtagcacagataatatgcacttcctgattatccatatcatatgacaatgtcttctccttattgtcagtaagaaaaatcaaattacattctggatgaattgcaaacatcgagtaggactcgtaatatttgcgacaatcccttccaaacagtttggaacagctaacagtacactttagggtccactctccgctgtcataattttcaagaacccaaatagacagttggtaatcaccttgatcctttatatgccaagcaaacaagcgtacctgggacttgccgatggaaacatcaccatattca

SEQ ID NO: 56355 - DNA, 686 bp, Triticum aestivum
  Clone ID: PAT_TA_56355
actcaaagttcggtcggtattataatctcgtccaataattttcacaacctcttctgatccaaagcctagccaaaccacagttcggcactacaaactaccaaaagtagccatagaatgactagcattattacagttttgacgagtgtgactaatacaagaatctctttcctccatactatcaatgatctccttgactatgaacgcatgcttttatttgttgccaactccttccttgatcgtcgagatagcctccgaacaatcggattcgacatcaacgggtaagtaagtccattgcagtgctaatgaaattccttcttttatagttaatagctctgcttctaatgcatcagcgcatgtgaatacatgtctgcatgaactaagaattactgagccttcagaatccctgagaatgatgcctgcacccctttgttttcaaggtaagaaccatctggattgagttttactctgcccaccctcggtttagtccacgagctggccatggtctgcttagcatcctgtgagagttgcttgcattggtggctcaggtctgacactgctttgcctttacgggtatcaacttggggcacattatcgatggtttttcgttgggtgggactagtctcagtgagactcatccaaatctcagtacagtgacataacatgtaagaaaaaggaataaagaaaaa

SEQ ID NO: 56356 - DNA, 708 bp, Triticum aestivum
  unsure (1)..(708): unsure at all n locations
  Clone ID: PAT_TA_56356
acatatcaatcgttcctgataattttcacctgacaagagtacattgatacggtatacaacaaccaaaatggcttgcgtaaatgcatatgctagacggacagcactgtggagttccagtatgacggcgcctcaggccgttagcctgcacaaagcggttgcagtcttggagcctgacggccggtcgaggtgcttgcagatgtagtcgccagcgtccatgagtttgccgaggtcgacgttggtctctatccccaggccgtggagcatgtacaccacgtcctccgtcgcgacattgcccgtggcgcccttggcgtacgggcaccctccaaggcctgacacagacgagtccactacgccgatccccatctggagagagactaggatgttggcaagggcctggccgtatgtatcgtggaagtgaacggccagcttgtctgccggaaccacggtcatcacggcctccagcataggaactaccctgcctggcgtaccgacaccaatcgtgtcaccgagtgaaatctccgcgcaacccatgtcgtaaagctccttggcaacatatgctacttttgatggatgcacgacgccttccacggngcagcccaccacacatgaaacatacccgcggatacgtattccatgttttttggcagcagaagtaacatcacggtaccgagcaaggctttcctcgatggtacagntgatgttcgactt

SEQ ID NO: 56357 - DNA, 336 bp, Triticum aestivum
  unsure (1)..(336): unsure at all n locations
  Clone ID: PAT_TA_56357
ataaaaataagtatggattgatgatagatacatggttcgtgatgatacatgtttccaaagaagctgacgaacgatcatttacaagttatgcgcaaggcatgcggataggcagagatacgatagatagatctatcgctggacatttagaacgattctctgaggcaactcttcatagctgctattcttcatggtagacagatagatcagaaattccttcgatgtcatcgtcagtctccaataatagtggtttgtttgctagagatcatattcagactgtggntgnacagctaagacggccaggagcatatgtgacctgggatgaacatgattgagatt

SEQ ID NO: 56358 - DNA, 351 bp, Triticum aestivum
  unsure (1)..(351): unsure at all n locations
  Clone ID: PAT_TA_56358
gggggggggggggggcgcagcnancacnggcannggcggcaaccannnaaacggaggncaaacagaggannccaacancacancccaanccaggacagaaggganggcggcancaccgacgaacacgaccgaccgaccgacggaaaggaaacacagggggggggggccgcgcgnaaccagcccnaannaaccccggacagagcgacacncgggcncgcgancaaaaacaccacaggaccgaacgacacacacgacncaggacgggcgggcacaggggcacggcggcggcggcgcgggagggggcgggggggcgagggcggcgggggggggggnggggggggggcggggggg

SEQ ID NO: 56359 - DNA, 395 bp, Triticum aestivum
  Clone ID: PAT_TA_56359
gaccatcaagcacactccttacaattaacaggcagaacatagggcgggtgaagcggatgtcgttcatcgtccacgtctcaccatactggactacacggttcacagtgaccctcgacctgagtcaagatgctttacaactaactggaacctaaacatttttgttgagatgcgctctaccccggtacacaggctttaggcctttgcgcatttgtttctccacatccagggttgcaacatttattactttctattatgcaggtcaactcgtgaaattccgatttcagggcagacacctaacttatgctgtgagattcagtgcacctgtggggggacatacatgccggcccgacatccggtccggtttgtcctcaaagcaggagtcatggtaccagttg

SEQ ID NO: 56360 - DNA, 563 bp, Triticum aestivum
  unsure (1)..(563): unsure at all n locations
  Clone ID: PAT_TA_56360
gggggggggggggggcgagaaaaacagnaccacgaggagggaannnncacaggggcnancagggcagnacaccagagcaggagcanccacnanaacnnaacagggggancaaagggacananacnnagcagggacannagaagggnngngncggaggggggggggggcaaccncggnngggcaacaaaggggaaggaaganacaaggnncagcngggannancgcaanncgcgggcggaccacagaaggcggannaacgaggcaccagannaancggcgggcgggggacgccnagagggcaaccnngccnnncaganggaacgccgagagcngnggcngaacanacaggccggggcangngggcgggngacngggagcaaggggggcngggggggagggggccaagggcaggggnggggggnggggagcgnggggcggggnnggggggggnggggggcaggccggggagggggggggggggggggggggggggggggggggggggggggggggggggcggcggccgggggggggggggngggggccggggggggggggggggg

SEQ ID NO: 56361 - DNA, 586 bp, Triticum aestivum
  unsure (1)..(586): unsure at all n locations
  Clone ID: PAT_TA_56361
agggaacagaggnggnnnccccgcccncggggccnagaccanacaacacaccagcanannncncagnnaanccgccgaagnacgacnccnngagcngggggggggggggcgcggngagcagagaancggagccggccngagggcagancccgacccgcncgacgncgagcagcncagcgagcnggggcagcccgccggggaggcnanggcagaancncancaagggggggagggcgnagancacggggaagnaaanccggaggagggcgaagaanccggagcggggggccggcaggggggagccggggagcaggnggggcagggggccgggggcggggccgggggggaaggggacccaggggggggggggggggggggcggcggggggggcangggcggggggggggngcgggcggggcgggccccngggggggggggggggcgaggggggcgccggggcccggggccggggcgccgggggggggggggggcgccgggggggggggggngggggggggggggcggcgcggggggggggggcggggcgcggcggggggggnggggggggggggggggggcggggggg

SEQ ID NO: 56362 - DNA, 460 bp, Triticum aestivum
  Clone ID: PAT_TA_56362
gggaaaaaaccactcaattttttgggggtttaatttatggccgcctcaggggtccctctggtggaaatcgcccagtcttttcccccccgttccacatttcttcagcccccctgttccctgcgggtaacattaaccaaaccggcctctaccctgggaccgatcccataatcaagtttccctagggccagccaaccatcctgaaagtcccccccccaacccaaatgccggaagccccaaccccaaagcacgtccctccggtccgggactgcttaaaaccctctgggcttggcgaccatgggggagtgcctggggatggggaggctgaaccggccccccttctcagtcgtgtcaagcttgtcccggcccggcgggggcgtgagccccaatttctggaccaggcgccccttggcgatcccccggatggccccccccgggtttttccccgtggcctcccccgcgg

SEQ ID NO: 56363 - DNA, 579 bp, Triticum aestivum
  unsure (1)..(579): unsure at all n locations
  Clone ID: PAT_TA_56363
cccacgcgtccgctcacccaaccctagcgagcagatcgccgatggatcagggctgggcgagctggttcggcgccggcgtcacctccgccttcttcgcctcgctcgagcgctgctcctgcatcaacctctccaccgacgacgacgacgacgaggaagaggccaacgaccgccccctcatgctcgccgccccctccgaccagccccagctcgacgccgcccccgcccccgccgtcgccgccggcaaggaggaggagcaggagcaggggcctcccctcccgcccgtgtgacccgctccctcctcccatccatcgcttgcgtacggcttactcctccccccgtccgcgtcctctgctctagatctgatgatgaactgctgctcgtcgctcgtggccgactaataaatctcgccgattttgttgctggcctgccatgtttaaattaattgaattagtagtatgcctatctgtgtgtgtgtgtgtgtgtgtatgccatgccatggattcctgttgttgtgttcatgtgaatatcatcatgccgtcgtgtggtnaaaaaaaaaaaaaaaaanaaaaaanannanna

SEQ ID NO: 56364 - DNA, 810 bp, Triticum aestivum
  unsure (1)..(810): unsure at all n locations
  Clone ID: PAT_TA_56364
ttctcggcggaggcggaggcgaaggaggaaccctagccgcgcgaggaagaaggagcgcccagatccccaaggccggagacgatgtcggcggttcgatgcgcggcgaggaggctcggtggctccctgctccagcgagcgcaggcggaggagcgacgccggctcgtgccaagcaggctcatgcgctcccgccaccttaccaccgaggcgcaagagatccagcggaaggaggcgctgtatgacgcgctttcttatgcggagcttaagctgaaggagttcaatgatgccttagttaaggcgggggatcctactggcgagaagcatctttctgctctttctgcgccacggaccggctatgagcgccttaagatgtatggattaagagctctgggtgtgatagagttaacttccaagacggccgtcttcgtggtgtttgctctttccttcgttactctcagcagcatgaagaccgaagagttgacctcaggggaaaccatcactgaagtgaaggccgcaaattgacaagcccaacatggatcgcgccccagcttgttcttcagtctctaatcatcacctgcagtttggctacctagcactatgctatctttctgatggtgcgtgacgtcgcatgctactatatctctatatatctgnttgttcggaccagaccgcaccggtgatgtgaacatatatgcatgcattgttgctggcgttactgccttattttagtagaggatcacattccagtcatcttaaaaggttgagtatctctagcaaaatgtatggcgcccttttgcgatccattcactttga

SEQ ID NO: 56365 - DNA, 623 bp, Triticum aestivum
  unsure (1)..(623): unsure at all n locations
  Clone ID: PAT_TA_56365
catccctcaacaatctgtccgactccggccatctctccggcaaccaccgtatccgcgcgtccacccttcgtagcgacgagaagatgagttctgccggcagcgggaggggcaagggcaaggcggtgtccaagaccgtctcgcggtcttccaaggccggcctccagttccccgtcggccgcatcgccaggtacctcaagatcggcaagtacgcccagcgcgtcggtgccggcgcccctgtctacctctccgccgtcctcgagtacctcgccgctgaggtcctggagctcgccggcaatgctgcgcgcgacaacaagaagacccggatcgtgccgcgccacatccagctggcggtccgcaacgatgaggagctgagccggcttctgggcgcggtcaccatcgccgccggtggtgtgctgcccaacatccacaccacgctgctccccaagaaggtcggcaagggcaagggcgacatcggctccgcgtcccaggagttctagaacctcgcagatcaaactagaactaatctaacaacgttctgggtcaatctggttcttgttattattcatcgtgatatgtcaacgtgaaaacatcttattgatgtctaaaaaaaaaaaaccannnna

SEQ ID NO: 56366 - DNA, 734 bp, Triticum aestivum
  Clone ID: PAT_TA_56366
gtttatatgttttcatgtacaaaccgaggcgtgcgggcaccatgtgtttctattgcagaggttgatcaccgtgtgtatggcttgctggttgcgccagtagagtttctcagaatgttgtttgtccagtctttgttaataatgtgatcatcacagaactaaaagacaatgtttggtactgaattgcagttcgctttgttaatttctgcgacaccatttcatatttacatttgaattgtacttacttagtttgtaaggccttatagtttcaatgctttatttgcttgtggaactacggctctgttacattttgatgattgtatatttttgtatatgaaatttgtagaacaaaagtaaaaaaatggagggcctagcttactttggtattaagggacaaggagctgtagcgtcatggattggagcgaaggggaggtcctgacgactgaagatggtgtgtaggggaggagctcgaagcggcactcccatggagggatggctgatgtcaaggtgctaaaatcttatgtgtcaagggcattgtgatggcgcgatccatgtctcctgctagcgctcgacgtcccgtagccccaaagaggagggctccaaggttggacaacaagcttcactggatgaaagcatttcccttctaaaacagagtgctgctgatatgaatgcacaagttagtcttgatactaagatggtcatggaattgcttgatctatactaggtcaacatgtcag

SEQ ID NO: 56367 - DNA, 829 bp, Triticum aestivum
  Clone ID: PAT_TA_56367
ccccgcgtccggcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcaccgacgcattatattatacaatatgtcgactatttaccgttttatgggtaccaatggg

SEQ ID NO: 56368 - DNA, 128 bp, Triticum aestivum
  Clone ID: PAT_TA_56368
gtttttattgtttaatgatgcatgatgcatgcgtgtttctgatccctaacgggatggtccaccctattggggctgtggttggatcatgaaaatcaacgtgaagtcatcagacgatatggacccacctc

SEQ ID NO: 56369 - DNA, 496 bp, Triticum aestivum
  unsure (1)..(496): unsure at all n locations
  Clone ID: PAT_TA_56369
acacaacttcatttctttgctcaacagccgcgctgatatttttacagagatgatttgggtttaacggatgaagagtttctcctgtaagagtatacacctagtccgcgcttttttccaagtcgtccggcatcgacatattggacaagaagagggcaagggctgtacttgttatctcctagcccgttgtggagcaccctaagtactgaatggcaaacatctaaccctatgaagtcagcaagctgcacaggccccattggttgattcgtgccgagcttcatccctgtgtcgatgtcctctttggttgctaccccagggtaaagtgcccaaaatgcttcattaatcatcggttttttgatgcggnttacaatgaaatcttttttatcttgtgagcatataacgggcttcccaattctttcagagaaagatttattttttgagaaaaccttttcggaagtatcaacctcctcgcattattttaaccagcttcattatagga

SEQ ID NO: 56370 - DNA, 109 bp, Triticum aestivum
  unsure (1)..(109): unsure at all n locations
  Clone ID: PAT_TA_56370
ttaaaacagatacaacagtgggtatatannattaaaatatgtataatncttgcagtattgaaataacagagatttnttttgngaacagtgacagatcaaaangcacaaa

SEQ ID NO: 56371 - DNA, 275 bp, Triticum aestivum
  unsure (1)..(275): unsure at all n locations
  Clone ID: PAT_TA_56371
agcagcaacagcaatctggtgcgccattcaacaccacaattctacaaatccagggggtttacaatcctctgttttactcttgaagtacaaaattacattggcaaactacacctagcaatcatccgccgaaaagggtggngatggggggagggatcacactgcgagtgaaccatgctggatacacgcacaactgtaggcatatttactatataaatnttgcgggcggnacagnacgacactatacgccgggntgttgggggattttggtagaagaa

SEQ ID NO: 56372 - DNA, 374 bp, Triticum aestivum
  unsure (1)..(374): unsure at all n locations
  Clone ID: PAT_TA_56372
ggtgtttgttttttttttttttttttttttttttttgtttttttttttttttttttttttttttttttttttttttttggcagggaaagggattnnaaaaattttttttcccaccttcaaaaaagggggagggaaaaaaaagggttcttaaaaaaagaaaggggggaacagaaaaaaggtnccaggggtaaaagaactacaaacgaaggaaaaaaaactaggtggggggttattaggtcgggagaggaatcaaancttcggggccaccattggatctttattggggcacaggngggggcaccgaaggggaagtcgtccaaacaccataaatatgggntggccgccggtaggggggtttatttttttttgaaaaa

SEQ ID NO: 56373 - DNA, 622 bp, Triticum aestivum
  Clone ID: PAT_TA_56373
caccaacatttatctttattaattattaaatagccacaagttacatgcaccacgatacgacgttgaaacatcatctgtcttatatggatagagtgcagtagaagtctctgaaacacaaggaccgggacaaaccttgaggtaggtaattacagcagtagatgtgacaagtcacaaatgccggcaacgagacggtatcaaaggtaaacggataggtcagcaaagcaacgtgcgtcgtcaatttcaggcagcatacttgacagcgatgtcagcgaggcagcgcgccagctcggtcggcgtcgagagcaacgccatgtggtccgcgccgtcgatttccatcacctcatccacggggtagttgtgcagcatccaccgctggaacccctcgacaatggcgtggtcgtccttgaagacgacgtacgccttgcgcaccgacccgtagcgggcctccgtgtacggcggctgcagcctcaggtcgtccacgaacatggagctgaccctcatcagggatcttcccagcggcaggtcctccggcgagcacagctgggaagaactttgcttcgagtgaccagcggccccgaacagcatggaagtaggcagcttgccctcgggatcttgaggcttg

SEQ ID NO: 56374 - DNA, 134 bp, Triticum aestivum
  unsure (1)..(134): unsure at all n locations
  Clone ID: PAT_TA_56374
aagaagttactgcagtgaggggatcaaaattacaaagggtggggggtggcatgcgtatacaggcccggtacagaacagaccacacacgancggganggagaagnaacacgaagggtagacacacacaacagccg

SEQ ID NO: 56375 - DNA, 409 bp, Triticum aestivum
  Clone ID: PAT_TA_56375
ggaccgcgtccttcggccgtgcatgggggggcttttccgggcggttttccacctttcccttttaaggggcttatttgtttcttggggaaaattggtttccggtttaattttggctaaaattgcgtcccggaaccatttacgaaaaaacttggggggccaaatgagggggttaacccccgtgggtcccgttggggtcactccccctttttatttggggaaacctgtttgccccttttcattaaggaaaccccccccccccggggggatttgtgattcgtttttggcgcgggggggggtttttttttttttgggggcccgggggttttttttttttcctttaggggctggcctttgttggtttcccttacccccccccccctgttttgcttttttaagcgaaaaccctttt

SEQ ID NO: 56376 - DNA, 204 bp, Triticum aestivum
  unsure (1)..(204): unsure at all n locations
  Clone ID: PAT_TA_56376
ggggggtggggggttttttttttttcgnaaataaactggagcggcgtgccttcataaaaggaattaacatacaaaggcacgccccattaaaccgcgggcaanacaaaaggaagggaaagtacaacagggagnacngaaacncgcttacnggaacagggggggggggggacgggcacacacaccgaggagaggaggaacagttcg

SEQ ID NO: 56377 - DNA, 281 bp, Triticum aestivum
  Clone ID: PAT_TA_56377
gaagctacgtaattatgtactgccaagtactcagtagatacttaatgtgttggacggagatgtccattaactagcatgaaataacatcttccactatatctctttcacaatgaagactgaatggacattcaggtgaaaagcagaaaactcacttgccatgtgtgtgcacccataacaaggactcaatagaagtaggaaagaaggccttaaagtgttggttattacatcagaacagtaaaaatatcaagatacaaggcacacaaggttgcaaagcaaatgat

SEQ ID NO: 56378 - DNA, 380 bp, Triticum aestivum
  unsure (1)..(380): unsure at all n locations
  Clone ID: PAT_TA_56378
ggggggggggggtttttttttttttttgcagctgaccttggatcactctggatgggaaacagaaaagctcaaagagctaaaactcaagagtagcgaccagatataaataagggtattattncccataaaaagagggctggacacaacctccaaagggggggggtggggattttttttcagggctcaggcactcgcactcgccataccaagcagctncagcatgggccgagcctccttgaatctctcaaggaccggcccctttacaagctccggctnctcggcattcgagcccttcactgggatcccccaacaaacaaaaactgcggggcggaacccgcccgggtgggaaaggggaggagcggngaacgggccggagggaa

SEQ ID NO: 56379 - DNA, 356 bp, Triticum aestivum
  unsure (1)..(356): unsure at all n locations
  Clone ID: PAT_TA_56379
ggggaaaaacgggcctttcacattacagaacggtttttcaacaaccaacaggggggggaaattgggggggggactttgcaaatacatgttggcttgggcgcattatgcccctccccaaaattttaaggggacgggttcgaacaacaaaaacggggggaagccaacttctccttgggaacttcagaccaaacaaacgggttggctttccattccaaaaaacccagcaattccaggtccaaagttttttatgttctaagcaatntttggaaaaccacaattacagggcttaaaaagggggttttttgcatttaaagaaccgttttacccacaaccacggccggttttggtggcacctt

SEQ ID NO: 56380 - DNA, 486 bp, Triticum aestivum
  unsure (1)..(486): unsure at all n locations
  Clone ID: PAT_TA_56380
gggttgttttttttttatccatgcttcagcgtagcattaccaattagccaggagcatagcatgtctttattaaactggtctcaacactcggaagttttaactgacacagtacggcaggagacacacgctgtccaatacatccatagttcatcatagggggggggattttcgacagatttaaggaccaataggcatcaagagcgtccgaactttgtagtatatgttcatgccctcttgaacagaacaactaggatgaccgccatggcaagagccatgaaagatccaccagccgccatctccgcgaacgaaggctttttagaggatgagcccggtccagcctcggcttctgccgggttgtggaacaggtcttggaaaaagntggttatgttgtcaaccatctncatcatcggnttttttgnattgtncacaaagtccgacaaaggtgaggcagtgggtagtgcatattntggggatgccttttnaaat

SEQ ID NO: 56381 - DNA, 345 bp, Triticum aestivum
  Clone ID: PAT_TA_56381
aggagaccacaatcaaatccaacccataaccacctaacattcattcatactgaatccaacataaccaagggaggcacacaaacgattcagggttcagatgccaactccagccaacatattcacaagcattcgtagattctagagcgcatacagggcggagtcccccgtttattcaattcttctcctaccgaaaagaagacggggcttagttctacgggatcagcagcacggaccccgaggtcttccgggcctcgaggacggcgtgcgcgcggaccgcctacgacagggggtaggtgagcttgacgcgggtgtgcgacacccgggggggtgcggggggggggacac

SEQ ID NO: 56382 - DNA, 544 bp, Triticum aestivum
  Clone ID: PAT_TA_56382
gaaggaaaatcatcttattccaaatacacgcctataataacacatacggttgttcgtttgcacactatcctgatctgccctgcctttcatagaccgagtgtacaagaaatgcgcatgtaaacacaacacttagattaattattgggtacaaacaatacatgacttgaaatgcatacctataggcagtagtagtaggaaaattaccacgtactgtacgattgcaagcgatttagcagcggcgtatggatgatgacctcgcagtcgcagcgattagaaggccacttccgcgttggcaaactcctctctcttctggctcacgtccgccaccatctcgccgaacctgcagggtgggctgaccaccggcaccgtgccccgcgcgcactgtccaccacgcccgttgcgaaatccattcgcatgcatgtggctggacttctgcgcgatgatgacagagttcaccacgtggtcatcggggtgacacacggggagcacctggaacccagctgtggcgatgtgctggggatcgactatcgggtgcagtaaccca

SEQ ID NO: 56383 - DNA, 155 bp, Triticum aestivum
  Clone ID: PAT_TA_56383
ggggggttttttttactgaaaacatcgctcacatagggatgttcgcaacatgtaccatgcacatgactgagctgaaccaaccaacgtgtggcggccatgggccaggcttactagagctgaggagggtgggggggcgggcgcgcattgtcgacgca

SEQ ID NO: 56384 - DNA, 378 bp, Triticum aestivum
  Clone ID: PAT_TA_56384
gtcggtagaactgagcaactccttcgtgtccatgattctatacagtagatagttcgacgaatatctggatagactcgccgatgtttcatacggtacatcgtttggtcaagtacataactgatcagatgccataaaacaacatccctgataacagatctgttcttggtagtcgggcgcgcggggtttgctgtggagttcctcggcggaatttgtattgcatcatgcccaaaattctagtttttgcccaatcttgcattattctgagatgtccggagtatagtaaggaactgtgtacctgtgttgatacctgcttgaaaggtgcactcttgttggacccatgcttgggcttggtcatgtggttgaaggcctagacacacc

SEQ ID NO: 56385 - DNA, 144 bp, Triticum aestivum
  Clone ID: PAT_TA_56385
aggaatagtaaacactcatattcaagcacactcagatcgcctacgtacataggtgcgcatgcggcacacgaacgcgtgcataagcggtgccggtttacagcttgcagggctaacagccttactgttgcttgttgcgtgggtggg

SEQ ID NO: 56386 - DNA, 521 bp, Triticum aestivum
  Clone ID: PAT_TA_56386
gatagataatttccattgcatgcccaacatccaccaacatattttttttcatccattgatccagctagaaacctgattcatcttgcaagtacgcgacagttataccagtttggcacacttgcctttgcaattagtcttggccaactgtatcatactttccaggatttacccgtggacaccgcgaacaccttaagccttccatagagcatgaccaagactagcagaaactttcctccgtcactccaccatctagaaaagctgtatggcatgtcctggcagatgatctctgggtgcagctgatgcagcctagaacaactgtaaccagtggatagcccaacgttgccgtatgcactgatgacctcaaatatcatgttcaaggtggagaagttgagtggatcgcttctgagccttctcctttcagtgatgcaggcaactatcacaaagatgatgttacacccagagcggagagaatgccaaattgtgcaccaacaacccagtcttgccttaaccttagaagaagt

SEQ ID NO: 56387 - DNA, 393 bp, Triticum aestivum
  Clone ID: PAT_TA_56387
gggcaaaacacaaatcttgggggcccctcccatctaaaaataccttcaaaaacaacccctcactgaacaggcattgagagaaactggggggcaagcccaggggcccgctgaaggacccctctaaggggggcctccacttcccccaaccggttctcaaaatattccttggaaggctgcatcgacgatattgcaggcccactatcattaaactttttctcttgcccatttaccaaaagggatcccggctccaaaaaaaaccctttaccaaaggccttggaagggttcgtatccccagggaattgggtaaatccccccaggggaaaataccccccctttttttccttctctttagaccgcctctgagtttggagcctgtttgtctttcccgggggg

SEQ ID NO: 56388 - DNA, 331 bp, Triticum aestivum
  Clone ID: PAT_TA_56388
gagaccgatggccaattatgctttcattgtacaaaggtgatgatgtatatggtgtttagggtgtacaaccgtggcaccccgtggagactcgggactgactcaacaaccaagatttgatccacagtccatccgctgccgtgacattattgcatgtttccatttttcctcgcaagaatcaatcgcacacccactctcgtaaatttcctttttctaggtccaattctgttcatttcaatgtagtaacatcctgtgtgtgtcactaagacaaccgtgttcgtggcgcctagcctgctcttttcaggtgggccatcacaccgaggtcggctaccag

SEQ ID NO: 56389 - DNA, 171 bp, Triticum aestivum
  Clone ID: PAT_TA_56389
tctggggtttttttttttggtcatagtcgaaaacatcaggaccaaatagctccaaacataaagaagtgcatgcatgctaacagcagggatgaagggacaaagtgacgggggggtaacccgtggaagggtgaggcctgtcagctgaggggctgataacaccagggggggggg

SEQ ID NO: 56390 - DNA, 258 bp, Triticum aestivum
  unsure (1)..(258): unsure at all n locations
  Clone ID: PAT_TA_56390
gccccacgcggcgcacgcaccccgtggatcatgcacgagtacaccgccaccgacccaaacccccaatcccaatcccaatcccaatcccaatctgcaggcccccaaaatgatagcttcgtcctctaccgcctgttcaacaagcaggacgaagaggccccagcgcccatttcagaacccccgtccacgtcgtctccaggcaatctgccgctgctagccgtcgncccggttcgcgcctccgtggtgggagagttggcctcg

SEQ ID NO: 56391 - DNA, 130 bp, Triticum aestivum
  Clone ID: PAT_TA_56391
ggggttttgtgttaagagcaatatctggagttcacggattcattacttataacgatactgaggggccagcaacgggtggaaccaacagatgggggactaaaccaacggagggggactgaggcggggatgg

SEQ ID NO: 56392 - DNA, 273 bp, Triticum aestivum
  Clone ID: PAT_TA_56392
gagcaaacaaagtcattactcactttgaataaccatttgatacatacaactatatactgtacaaatcatgggtatgccgccaaactggaattgatgagtgatggaaccctgggtggatcaaaaaaccactatcaactcaattttggacctttaatctgtacacacatcgtcatgctcaacgcatggatcggaattcaatcttgcctaacaaacagtatattcactccatgctgccggtggtgtgtgcgcttgcggatgaactgattcgagcgg

SEQ ID NO: 56393 - DNA, 497 bp, Triticum aestivum
  unsure (1)..(497): unsure at all n locations
  Clone ID: PAT_TA_56393
cacgcaatggcgtcctcctcctcgtctccgctgctcatgttgctgctgctgccgctcctgctcgccacggcaacggcaacggccacgatcacgatcacgaccaggacaccggtggcagcaacagcaccgacgaggacgaggaggatgcggccatgagggaagccaaagtggagaagggcgggtaccagcaagacgtcgaggacaagcccatcttcgcagactccagccccgagctgcacggcgcacccatgtacgactcggagaggatcccggcggcggcgaaggaggtgaagcacaacgacgctccgggggtgcgggtcggtgacattggcggcccggcagcggcgcatgaggtgaaccgcgaggacgccgcgggggtgcggngtcggcgacttcggcggcccggcagcggcgcatgaggtgaagcgcgacgacgccgcgggggagcggctcggcgacttctgcgggcgggcgtcggcgaaagaggtgcancgcga

SEQ ID NO: 56394 - DNA, 579 bp, Triticum aestivum
  unsure (1)..(579): unsure at all n locations
  Clone ID: PAT_TA_56394
gacaagacgatcgtgcagtggggggacacggcggacacgcccgccggaccgagggggcgcccgctcggcacgtacgggtccgcgtcgttcgccgtgaacgcgcagtacttcatcgccaggaacatcaccttcaagaacacggcgccggtgccgaacgcgggggcgacggggaagcaggcggtggcgctgcgggtgtcggcggacaacgcggcgttcgtggggtgccggttcctgggcgcgcaggacacgctctacgaccagtcggggcgccactactacaaggactgctacatcgaggggtccatcgacttcatcttcggcaacgcgctctccctctacgaggtacgtgctcgccctcctcttcttccttgatgcctaaagctccattgccagaccttccatgcaatactgcgcacgcagagagagaaaaacagagcatgtacgacacaaaaagagagccgggcaacatctgtggcacgcaatgccaggaattttgtgtccgggccggntgcagtcgcaatctttggcgtcttcgaccgactcgtcacagcgggctgaattattgcatgcacacggcct

SEQ ID NO: 56395 - DNA, 459 bp, Triticum aestivum
  unsure (1)..(459): unsure at all n locations
  Clone ID: PAT_TA_56395
cggacgcgtgggcgacgggtacctcccggactcggggatgcaggtgaccatcgcgttcaatcacttcggcgtgcagctggtgcagcggatgccgcgctgccgccggggatacttccacatcgtcaacaacgactacacggcgtgggagatgtacgccatcggcggcagcgccagccccaccatcaacagccagngcaaccgctacatcgcccccgcaaaccccaacgccaaggaggtgacgaagcgcgtggacacggaggaagggcagtggaacgggtggaacctgcggacggagggggacatgatggtgaacggcgccttcttcgtgccctccggggaagggatggagaacatctacgacaaggcctccagcggcgtcgaccccaagtcgtcggcgctcgtcgaccagctcaccatgggcgccggggtcctcggggggccaaggacaacggctaagcg

SEQ ID NO: 56396 - DNA, 502 bp, Triticum aestivum
  unsure (1)..(502): unsure at all n locations
  Clone ID: PAT_TA_56396
atccatgcgtgttaccattctttttatgtctgtacaaatattattatggagcccaacttctaattgttatatcccagtcataacctctagtcgaaagaggatttgtttctgaattttgataaatattaaagtgcattttcatttgcagtataatggtacatgttattttcttgtgatcccccaattaagtattaagtaacttttaaaaacgtcggctaaaggggtaagagtccctccttttgactgtgcgttagatagaaatgagccttccctgcagattgaacgagggtgggcgagcttacgcccgtaagctctagctgaccgagctagtgcttggttctccatttaaaataacttatattgccgatgtttgttttcctactattaccaaaagaagaaagttattgctggcaggatatctttcaatctgtttagttgagttccgtatggaactgttcatttgatgattgatcatgggttancctgtgttcctctattttgg

SEQ ID NO: 56397 - DNA, 485 bp, Triticum aestivum
  unsure (1)..(485): unsure at all n locations
  Clone ID: PAT_TA_56397
ctcctcccccctcgtcttattttaccgagcgatccccccagcgagctaaaccctagatcctccgcccaaccgctaaaaccctagcaggccaagagctgctgcgtcggggacgataggatggccgagccctccagggtgatccacatccggaacgtcgggcatgagatctccgagactgacctgctccaggtggtgcagccgtttggngcggtcgccaagctcgtcatgctgcgcaccaagaaccaggcccttgtccagatggaggacctgtctgcttcaatcagcgccatccaatactacactacaattcaacctagcgtgaggggaagaaacgtatacttgcagtactcatctcaccaggaactgactactgatcagagctctcatggacggaatcctgatcagagttttcaagcccttatacaggttcagtcacgccagagtgcaatacaagcagctggtgctttgcatggacggaacattta

SEQ ID NO: 56398 - DNA, 377 bp, Triticum aestivum
  Clone ID: PAT_TA_56398
agaattttgaagcagaaccatcagactgtcagggcacaactagaatagtcttgtttttctgctcccagcttacctgacatataaaatactaaagtgactaaactgttttacttctgacagcactaatttaactcttggagcattgctcaaacaagcagtgcaatacgacatactcccttccgttcaaattcttgtcttgggatttgtctagatacggaggtatctagtattaaaatgagtctagatacatctgtatctagacaaatccaagacaagtaattcggaacggagggagtatttatcagtacacagcttgctccaaactcccagagttagagataaactgactgcattaagtactatccgaagagagatac

SEQ ID NO: 56399 - DNA, 221 bp, Triticum aestivum
  Clone ID: PAT_TA_56399
aagggcacctgcatcagctcagatcttgtcatggaggttaacgaccaggtcgtgcgcgtcgtccagcagcctccacacgtccagctgcccggccatccgtgccgggatcgggaggaccacctgggggaagataaggctgcatgccccgccgaccgacgacctgctgctctacgccatctcggcctgcggcctggctacgaggaagctgcttctccagaagc

SEQ ID NO: 56400 - DNA, 281 bp, Triticum aestivum
  Clone ID: PAT_TA_56400
gcgtcatcttccagaatcctgtctcttggaaaattgggattagcatctttcaggattgggggtccaaatgtgaagacagattgggtctatgctgataatcttgttcttgcactgatattggcaagtatgggacttttagatgacattcctggcaggaagggaactcctgtagcagctggtcaagcatacttcatatgtgatggagcgcctattaataggtttgattttatcatcagtcccttgtttcgaagtttgggctatcctgtacctcgagctacact

SEQ ID NO: 56401 - DNA, 531 bp, Triticum aestivum
  Clone ID: PAT_TA_56401
atcgactttacagaccggcgagcatgcgacggcggcttcgtcaacgatgtccacgccatatgcatgagagaaaacatacgactttctagcgctacgccgcgcactgtttaacccgtacggacttctccctgtagcggcgtcatacgcaatgaatccgttcataccctgtagagctcgaatattgcgcagggctggagacgtaagaaaaaaactctgtgtgctcattatggttcgagcaagcttcataggttctaggggtttacctgaagacatatcaggatatgtcttactgaatatactcaggaacatgaagataacgttggatgctgccgctatcttctggtctgacgcactattaccttgcttggcatgaggctgccggcaggctctatgataaaagactacgtgtaaaccccgagcattcacaattgaagaaggcatatttttgggttggaaaaacttctaaagaagacccagcgcgctgaagaaaatgctgctaaaagcaagcttcgcgtgggctgttgaggacta

SEQ ID NO: 56402 - DNA, 408 bp, Triticum aestivum
  Clone ID: PAT_TA_56402
cctcccccaatctcgtctccgccctccgccctccgcccccgaaccccccgactccccgacccgaagatctctgctcctcccgctccgctccggccccagatcgcggcggcggtgggggtgctggcgtggatgtacaagtacctgtcgcacggggcgtcctcgccgccgggggccgacacggtggaccacgcgggcgcgaagctggactccaaggcgcacgaggtgaagaactgggcgcagcatcgcctcgaccaggcacgaacgccgtagacgtgtcgtcatttgccctcctatgcgtcaccagtgtgtgtggatcgacgcctctatatgtacggacgtgcccgcgagcggtgctacttaccaccgatgaataataagctgcgtatcttctctggaagagggagtgtt

SEQ ID NO: 56403 - DNA, 482 bp, Triticum aestivum
  unsure (1)..(482): unsure at all n locations
  Clone ID: PAT_TA_56403
cttaagcagcaagagataacatgttccgccttgacgtatctccggtcttcctcgtccaaaggaccaggttgaggtagtacttgacactgaacttgttgtttatggacgaggaagaccggagatacttcaagcagcaagagataaacatgttccgccttgacgaaactccacagccttcataaactttaaccgctgngaacctggcctgaatggtgttgcaagaattaacaatttggcatcctgttatgctgtatataactctccaggagagcgtgcagtgcagttccaatgtaccgtggcgctgtcacttgttacgcctttttcatagcaatctgggtagatacaatcactgaaatgctggattgctgacttttgaccatattttcatttcggccctcttgtgagacatttttttctttatacgcttgtgaagcatcttgagataaccaaatgtatttgatattttgcttcatcctcctccc

SEQ ID NO: 56404 - DNA, 600 bp, Triticum aestivum
  unsure (1)..(600): unsure at all n locations
  Clone ID: PAT_TA_56404
gccgccatgtcgacggcggcgcagcaggcggtcgcggatcagaagcgcgcggtgcggtccgacgtgcgcagggcgctcaaggccctctcccccgatcagcgcaccagcgaagatctggctattcaaaacaatattttgaactcttcttggttcaaagcaagcaaacggttgtgtgcctatataagctgtgcgcaattacgagaagtggatacatcaaaaataatagcagaagttctatcctcagatcctgaacatgatggacaagcaaaggatatctatgttcctcgagtggaagataaaaaccgcaatatgcggatgttcaaaatcacaaccatggatgatttagttaaaaattcaatgaacattctggaaccgtcaccattggatgctagtgggaatgcttgtgaaaatgtgttgtcagcctcatcccctgtcgatctttnttgtgttgcctggacaagcttttgacagaactggccgaagatatgacgtggtggagggtactatgacactttcttgatgagataccaagaacttgctaaagagaaaggggtggagtcagcctcttctagttgcactttcatactcggtgcaaattct

SEQ ID NO: 56405 - DNA, 648 bp, Triticum aestivum
  Clone ID: PAT_TA_56405
cttcaaatagcgggataatgaaatttgcaaagaaacaactgacttgcctcggatgcaaagcagttataagtggtcccaaccaaacactttgctcacattgcaagggaagggaagcagagttatactgcaaaacagtagcaaatgtttctgatctggagatgctctttgggaagctatggacgcagtgccaggagtgccaaggctccctacaccaggacgttctggcaccagtcgggactgccctattttctaccggcggaggaaggcacagaaggacatggctgaagctagggtgcagcttgatcgttgggacttctgagtcctctcaatgctctgagaacttgcatttttctccctccgccaacttgtgagggtgttatcgcgaatggctcgctgccgctaagatcacgtgattgcatcatgatgcatgatgggccagggctacggtggaagatcggtagcgtttgaggtaggcttgttgtatggttaatgcgggtgtctgcttagtttgtcgggagtagccagtatcaaccatgacagatgggtgattgctgcctccctaattgtgccggactgctgatgcgtaagtagaagtagaaaaactcatcttgtaaggttggtcagaattttatagtagcaatggctatc

SEQ ID NO: 56406 - DNA, 386 bp, Triticum aestivum
  Clone ID: PAT_TA_56406
gagaagaaaagcgcacgaaaaagaaaacagaagagaaatgaaaactgccctgcttgcttgctgaggtcggcctcctggcgaatgagcccccgccgccgtcccccgctgctccttcctcgccgccgtcgccgtcgcctgcgcctgcgccgccgcccgcccctgcgcgggcctcgtccgccttggcgccggcttctttcttgacgcccccgcgcgcttcgggccccgggtgaccggcgaagggatatgcgggtcgctgcgcgccgcggagcccgccgacgcgtgcgcgcccgtccggggcgcccccggcgggaacggcgggaaggcgttcgtgcttatcgcgcgcgggaactggagcttcaaggcaaggggcgggcggcgcaacgggc

SEQ ID NO: 56407 - DNA, 584 bp, Triticum aestivum
  Clone ID: PAT_TA_56407
cgcgaggaaaaaaaacagcgagcaggggtcccatgaaaatatctcctctcccctcccctcccctctctcccgtgctctccatcccccgatcccctcattccctcccgttgcaccgccgccggttccatgcggccttctctccctggcgctcgaggcccctccttccctcccatcgtgccgccggctccacgcggcggccgatgcgaccttctctccccggcgctcgagatcccctccttcccttccgccgcgccaccggttccacgcggcacccgtgctctgccgctcatccatggctccatccatcctccttgtccgatggagtcgaccgggatcgctccatctcgagctgctccaggagagagaaagaggagagggaggtgtgcccgcggacgggagagggtcaccggctgccgccggcctgcgcggacgaagtcgggcgtgaccccgcgggctatggcgggtcaatctgctcctggatcgggcgagggccacgccaaaggtggtggatctgctgctcgaccgcgatccggagggccggcgtcgaggaccagtgggggaagcacgtgcctgctggagtagct

SEQ ID NO: 56408 - DNA, 521 bp, Triticum aestivum
  Clone ID: PAT_TA_56408
agcgtgcaccttcctcagcgccgccggccgtgtcctccattagcgccaccgcccctcgaagctcgcctgctccaccgccttcaccttccaactcgaccttgccggtcacccaacagcacctaaatccaccgcttcaagtggagcaaccgccgccgccttgcccttacggcgaccacctattcgccggagtaattagtggtgagaatgggacactcgcgtcagctcgtgacgaacggtgagctcgtgacgagccctagcttcatggctccccttgccgggcgggattcctccaccttgctactccgatgagggggggtcgacctcaggtccattccgggccgccctatcagtaggctgtgcagcgacagtttgacaagcggatctacattcctttacctgactcgcaagcaatgcagcataagtttaaggtccatctttggggatacagcacacagctcatgggaaagagattttgagggcttgggtcgtgggacagaaggattttttggtttcgacatcgc

SEQ ID NO: 56409 - DNA, 480 bp, Triticum aestivum
  Clone ID: PAT_TA_56409
gtctcagctaccctccccccgtccccgtcggcccggcccccaaaacccttcgcggcggccaccgcatccctccaccgctcgccgttgccgccgccgccgcgcgatgcccttgggcatctgattcatgtctcacccccacgcctccgcccccaagcgggccttcttcttcttcttggccttccccggcttccccgcgccggcggacatgaagaagggtaagcttcccggcttcggcttcttcttcttcttcttcggcgggcccaccgagaagagcgggcttcaccttgacccgggcggcggcggcggcgttaggggcggtggccgcaccaacggcgaggaagatgcggagatgctggtcgccgaacaagacaaacttcgcgcccccaacgcattgggcccaaggggggggcacgggccacctctttcggaaggaaggccagcttccggaagcttctggcggcggcggcaaccggaaggccc

SEQ ID NO: 56410 - DNA, 503 bp, Triticum aestivum
  Clone ID: PAT_TA_56410
ccggcacccacgacactggcggccacggccgccaggtgggatacggtgccactggcacgggcacccacgacgctggggggtttggaggctctggaattgcccctcggcacgacaccaccggcactgggcttcacgacgccggtgggttgggcacgcggcatgccgccaccggtacccacggcacaggccagaccgccgggctcggcggcacaggcacagggatgaccgggacccatggcgcaggccacaccgccgggctcggcggcacaggcacagggatgaccgggacccatggcgcaggccacaccgccgggctcggcggcaccggcacagggatgaccgggacccatggcacgggccacaccgccgggctcggcggcaccggcacagggatcaccgggacccatggcacaggccacaccggcgggtatgacgccaccggtactcatggcacagggcacacgggccgggtacggggcgaccgggactgggatcactggaac

SEQ ID NO: 56411 - DNA, 447 bp, Triticum aestivum
  Clone ID: PAT_TA_56411
cggacgcgtgggctgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaagggtcccttcgttcccatctctgggttcgagggggacaacatgattgagaggtccaccaaccttgactggtacaagggccccacccttcttgaggccctggaccagatcaatgagcccaagagggcctccgacaagcccctgtcgtttccccttcaggacgtctacaagatttggggcattggaa

SEQ ID NO: 56412 - DNA, 571 bp, Triticum aestivum
  Clone ID: PAT_TA_56412
gcatcaagcaatcaaacaaaagacctttctgatgataggcctctcttggctacagaggttgaatctattctcaaagacctgtgggaaaaggaagccaggttctgcatgttactatgcgactttcagcagaatttatgtgtatcagaaaagaggaggggctatgagatgtttttcttgaagagtatgcttgtgccaccaaatagattccgtccctcaactaactctagccttggaattatggaacatccacaaaatgttatgctaagtaaagtgcaagaggccaatcttgcgctacagcatgacaatcctaatcacatggatattcttacaagatggagggatctgcaaacaagtgtaaatttattttacgatagtagtaaaggccttgtaaaaagcgataaagatggtcatggtgtacggcaattggtggataagaaaaccgggattgttcgacagaaaataatgggcaaaagagttaatcattcctgccggacagttatatctccgggatccggtttttgcctggtaacgaaattggcattcctcctgctgctgcttcaaagctgactta

SEQ ID NO: 56413 - DNA, 441 bp, Triticum aestivum
  Clone ID: PAT_TA_56413
ctcacgctcgagagctaatcagtgcgtactgataccgtggatagccaggtgagcttcagcgcttgttttctttcttatgttcctgatttagtgactacggcctgctctggcgacgtttctatcagatattggcgtagttccaaatcacctatgatatgagcgtgtaggagcatgacgaagggagcctaaaaggggttgttggctgcggaggatgcctcttttgccgacttccacaccccaagatttcggccactgcgcacggctgtgttcaaaggtgcgtgaatgtgctataagaacttctcgcgctgatcgccccaatagcactggggcgagggaatgctgagaaggacccttacgtcggggccagagcttgaggcaatggttttcctattctcttgcgttttgtgcacctcgccccaccacagttcactggttcatgga

SEQ ID NO: 56414 - DNA, 669 bp, Triticum aestivum
  Clone ID: PAT_TA_56414
tgctgaccatactcagtcaagtcaggcctcagtccaaagattacagcaagcagcaaggctgcggcggtggcggcggcccctccgggaggaaacgcctcatggctgccattggagcagtatccgcccgtatcatgcgcaaggacggtaaggacgacaagcagcaaggtggcagtacctcccagacaacagaagatctcaaggggcagttggccaactacttgaaggaaaaaagttacttgctcttagttgatgatgtgtggtctacatcaatgtgggagaagataaagaattcattgcctaaaagtaagaaaggcagaagagtaatagttaccacgcggtttcaagctgttgctagtctgtgtggaagagataaagaagatcacattcataaagtggtcgtacttgacaaggacaagtctaaagatttgttcatgatcgagtccgaaattagcaaagaaaccaagaacaaaattccagagatactctggcaaatgtgcggggggtctgccattggccatagttaccatggccgggcacgctgcctgcaacacagacaagctggcaagctaagtggggtgaaagttcacaatgcactgggtaccagactccgggaaagctcttggcctggacggagtcactaggatactcaatcactgctacaatgatatg

SEQ ID NO: 56415 - DNA, 604 bp, Triticum aestivum
  Clone ID: PAT_TA_56415
gtgcgtctgccccctctgccgccctcgtgcacggccgcaggctgcacacgttgcagcagccagaatcgctacctcgtgtacgatccggccctgtcgccgcactacgaggtgttcttgatccctaacattcccttcacgcttccgacggggcatatctgtatgcacatttgtcgtgatgatgagtcggtgtctgcgatggaatggccaccctcgccttacatcgtgcacgtcttctcctcaaagaccggttgctggaaggaaagatcgcttctccgggaaggggaggccgcaggaacggttgccgatgtgaaagcggtttatgatactgtatcatttttcctctacgccgcctattggaaggacgcgctctatgttcgttgcgaagaggaatttcttctgaggcagtactatatatctgcccccatcttaggcaccagatacaattggatgttcagtttatttcccccaccaatatccgtataattttgcttattataatgtttattattggtgatttggttcttgcagaataaacttgttgcatgatacctatcgagtgatcaagtttccagatggaaataaaggatatactgtgcctcgcata

SEQ ID NO: 56416 - DNA, 451 bp, Triticum aestivum
  unsure (1)..(451): unsure at all n locations
  Clone ID: PAT_TA_56416
agcatttctgggagatttgctacaacagccttcctgttgtcattctcagattcctcatgcacattcaggtgtcagtggtagagtaatgaatgttgngtggaggtcaagcatttagaagtggaatgaatatgggtggtaccattcaagggtcaatgctgcaagtggaagacgaaatgtgcaaggatccatgatgaatggccttattctgcaaggtatgcctgatggagcgattgggttgatgctgaagctgatatactcccctaagttgctccaatcgggaatgcagatatacttccgtgagttgctccccaaaaccaatcccttgctcttctttgcaccaatcggacaagagatgcgagccatcctttttactagatgttctcttgatcgnttcttcctatggattttgtggntgccagatgttctctcactgtggattgggatgaagggt

SEQ ID NO: 56417 - DNA, 570 bp, Triticum aestivum
  Clone ID: PAT_TA_56417
caaaattaaggtcctctaatggtcaagcatctgaaagtggaatacaaaacttccagttgactggggttattgctaatgacaagtcagtaaacatcgaggaatcaccaaattttgatgatgctgagttagcactgataattgatgggaactcccttgtgtatattctagagaaagatcttgaatcagagttatttgacttggcaacctcctgtaaagttgtcatctgctgccgtgttgctcctctgcaaaaggctggaatcgtcgatctgattaaaagcaggacgagtgacatgaccttggcaatcggtgatggggcaaatgatgtttcaatgatacagatggctgatgttggtgttggtatatgtggtcaagaaggtcgtcaagcggggatggcttcagatttgcttggggcagttccgctttttgaaaagaatgcttcttgtacatgggcactggaattatcaacgtatggcaacatgattctctacaacttctatcggaaggctggctttgtgctaatgctcttctggtatatcttgcacactgcatattccgcaacgcttgcgctac

SEQ ID NO: 56418 - DNA, 382 bp, Triticum aestivum
  Clone ID: PAT_TA_56418
gtcccccacactacaccgctctttactcacctgctccactccccaccgccgcggccaaccaccccccaccgcccccggccccgccgacgccgcgctgctcaccgggaagcagcagcaacaagagcggccggagcatggcgcgctgatcccttccctgctgctcgcgcggagtggcttagcttggaacatggggcggcattgggccggcgtcctgctcctcgccctgcactgcggggtggcgggcgctgctccccccctgcttcgcgggctcggcttcgcccctggcccctcccatcggcggcgacgcgtcggcgctgctggccttcaacgggcggtgatcgaagacccgcacgcggcgctggccgactggacggacgccgac

SEQ ID NO: 56419 - DNA, 210 bp, Triticum aestivum
  unsure (1)..(210): unsure at all n locations
  Clone ID: PAT_TA_56419
ctagttaacaatggcgacagagccgagaacatccctctcctcttcctcctggcacaagccttctcttcgccgcggctgtttcggcctcccatgacgaggaggaggacaggcngcggtgaacacacactgaaagaangaggaagaaagaaggcgataccatggggatagcttccggagtgattgacaggggacacctgagctcgttcgggg

SEQ ID NO: 56420 - DNA, 331 bp, Triticum aestivum
  Clone ID: PAT_TA_56420
gtagaacatgtacatagcttccctagatgaggattgcctacgttttctggtatgaagcatatcaggcaatcacacctgaatagaaaatttagggttcctttgtacctctactatacaccatatgtctatgcttattactagctatgacttgctttagccttatacctgttgtctgaaatgcacctctgtgcatatatctttctagaggattgtatgatcaatagttatgatatagtttcatatatcccttttagtaaagctagtttcatatatccctttttgcaagcccagtagaatatcataagtagtgggtgctattggaagaggtatg

SEQ ID NO: 56421 - DNA, 467 bp, Triticum aestivum
  unsure (1)..(467): unsure at all n locations
  Clone ID: PAT_TA_56421
ggcacctgcaaagtggtgatgaggaaggagtcttgcaggaggaagtttcagagctagatggtctagcatccacgttgatttatgaaaatagtaagtatcaatcgaacttgactgtgtatgttctgaaagatgcaaatgttgaccaccatgttggtttatgactatttatgttctgaaagatgcaaatgttgaccaccacgttgatttatgaaaatagtaagtatcaatcgaactttactgtttatgttctgaaagatgcaaatgttgaccaccacattcttttagtttcatgccagcactgaaataatcgtgatgatcttgtagaatttccgagcagntatgtcatttggattcatttattagtttatttaaggggggggngggggcacaccctgtgtggcaaggaatattatatgtctncctcaagctgcgtgcaatctaatttactgagcccttgttttaataaa

SEQ ID NO: 56422 - DNA, 260 bp, Triticum aestivum
  Clone ID: PAT_TA_56422
tctactttatcatgaagattgtcgacaaggattgataagagataattgcttactaattgctcgtgtgtttttcatctcagtgcttctcggtgcccttcataaagaactttctccccggattgtctatcaaatctccagttggaaatatcagtctacaggcccgtctgataaaattaacctttaacaaccaactggatgattagctggtccatcatgctacatacgcctctttgttgagtggttttccccgctttcttgga

SEQ ID NO: 56423 - DNA, 331 bp, Triticum aestivum
  unsure (1)..(331): unsure at all n locations
  Clone ID: PAT_TA_56423
ccccatagtcccgtccccatatcacctccaagcgatcccagcgccgccgatctcccgtgccgccaccacctccgccgcctcctggacaagaggccaccaccattgagcaccacttcggcgcgcctggttgccaccgcgactctggccttggaaggtcgtcctactgtcctggatcggggaggaggcacgatttggatctgggcggcgacggctaagcaagggcacctgtgctatcgaggtacatctcttcccactctccccgcctccctctctcttccccgccggggtcgccgngagcccgtgaccgttgactgggggggaatggggagcc

SEQ ID NO: 56424 - DNA, 175 bp, Triticum aestivum
  Clone ID: PAT_TA_56424
cttcctgcgccttccggcgctccaggaggaagtgtgcgaactaactatcacccgagagctcatctcaaagttcatagaacaccggtattggaaacttccctttatgtgtcatgagcttgacctgcctataaatcatcacttgggccacatggatgattatttctttatggccata

SEQ ID NO: 56425 - DNA, 463 bp, Triticum aestivum
  Clone ID: PAT_TA_56425
gtaccttgtatattatgtacactattgtattttcgatcttttgtactcaatctatactgactgtgatggcctagtgtgctttactcatctactgcaacacatttccatattattagtgttagtatattttgatgcaattgcatgttcattgcctttgtaaactactcattttactcagcctttatagacacaggttttgggcgactccactgagcttgttgggttaggaatataactgcgctagtacaattttctagttaatcatatcctttaataatggtggattaaacgtaggaacactattccatgaatggttagaaacaaaaattgaaacgaaaagctgggttctctttacagcattgacggcaatgccccaattatcataagcgttaaagctataaaagggaagctaggatttggcctcctctcttggaaatggctctggtagaatattggctatgga

SEQ ID NO: 56426 - DNA, 173 bp, Triticum aestivum
  Clone ID: PAT_TA_56426
ccactcgtactgataccaacatcgagacatgaagtccacggtagaagatcgcatggctagcgctaggcctcgcctctcctgtgctgtcctctgagtgtgagggtgattcgggcggagccgctgactgatccctttactgttgcgctggcgcagtagctgatctaggaatgggg

SEQ ID NO: 56427 - DNA, 487 bp, Triticum aestivum
  unsure (1)..(487): unsure at all n locations
  Clone ID: PAT_TA_56427
gcaaggttttgtgctttaggtgcttcagaatggaagagcaacttaacgaacaaaacctcaaggacatactccctgggattgcaactttaggttgtttcaatatttctaccagccaaacattcttaattttgaccatcactgtgaaacgttttgcaaccattgataacatgaacttgatattatatatcagttaccaaatatacttttgtaatgtcttctttatattgtttgaagtagcatattttcttagaaattgatggccacagtttcaccttggaaaatgtgtcaatgctcagaacgacctaaatttgtagtcagatagagtacatcataaactatgtttagctgttggtgttaagntatctgtcaacaatcaatatccttttctcttcaatcctttgctcaccaattctcttaatgcatgttctgngntattattgntatttgngcatacaacaaattcctgtcaatcatgatagtaggtttt

SEQ ID NO: 56428 - DNA, 266 bp, Triticum aestivum
  Clone ID: PAT_TA_56428
ctcgtacgaaaacgatacgatgaagtccgcagaagataccatggctagcgcagccatcgtgctctccctctgcctctccctctcgttcgcagggggtaatgccgagcgtaggtggggaaccaacaacatggggccggaggaggaggcagcaccggcagcggcggtggcaaactaactagagaaggagagagcacgctggtagctgcgaatcggaagggctgggacctgggatgagttgccaggggatcaggggcgcggatcagatt

SEQ ID NO: 56429 - DNA, 312 bp, Triticum aestivum
  unsure (1)..(312): unsure at all n locations
  Clone ID: PAT_TA_56429
ccgccacgccgcgcggcccatcccctgacgacgacggccatggcggcggcgatgtcggtgtcggccgtggtcctgccggcggcggcgggtggcgcgcgcgcggacnctgctctgcgtacccgccacggcgcgcgcgccgcgggagatggcggcggaggtggctgccgcagccgctctcggggccgacctggctgaactccgcctcgaccgactagcctggttcggcccgcgccgtgacctgtccgcgctcctcggcaagacttgcacgctccccgcccttgtacatactaggccaagtgggaaggtggtgat

SEQ ID NO: 56430 - DNA, 238 bp, Triticum aestivum
  unsure (1)..(238): unsure at all n locations
  Clone ID: PAT_TA_56430
aaaacccctcgcgcagacagcggccatagcgatggcgtcgccgccagcctgctccctcctcctcccggccattccctccgcgccggcctacgctagtgtcccacgagcaccccggttcctcacctgcccccgcgctgtaacagcccaccgaccctttcccacgggctcctctcctaaggtcgcggcgcccgccgccgtcgagatcccanaagagtacgtgggtgatgtcgaagcgggg

SEQ ID NO: 56431 - DNA, 526 bp, Triticum aestivum
  unsure (1)..(526): unsure at all n locations
  Clone ID: PAT_TA_56431
caacatcacatacataagagcaacatccgactacggagaaacataaacagaaactcaaacgaaatccaccctgctagcccaggctgccgagctgggacctatcccctgatcgaagaagaagcagaagaagaactcaacgcaagcaagcatcgctctcgcgtcatgaccatcgcataaacctgtacctgcaactgttgttgtagtaatctgtgagccacgaggactcagcaatctcattaccatgggtatcaagactagcaaagcttaatgggaaaggaagggataaagtggggagggtgcagcagcgactaagcatatatggtggctaacatacgcaaataagagcgagaagagagcaagcggagcgggcatgaagctagcaatgatcaagaagtgatcctgaactcctacttacggcaaacataacccagaaaccgggtgcactttccggactctggcgaaaagagacatcccgggttcccacgcgggtggtgcggtgttacttgggatctggggnggggggttg

SEQ ID NO: 56432 - DNA, 270 bp, Triticum aestivum
  unsure (1)..(270): unsure at all n locations
  Clone ID: PAT_TA_56432
cttcacatgtagaacttgaacctggccataatttttctattggaacatttaattgatcatgtaggaaggagaacagaaagcaatgacgacaaaaaaaaacatgccgatgtaaagagatgtctctctttgttctgacgatataaagctccagtttacatctcctgtatggcagtgatgggaatgatttttattttcttnnttttgacaantnctgcgttcattctctcntaagctttttaacgattacgtggattggtgggtgcttgcggt

SEQ ID NO: 56433 - DNA, 411 bp, Triticum aestivum
  Clone ID: PAT_TA_56433
aagtgattagccatggacacggatgtgattagcggccgggacgcgatggcgccggcggccggggacggcggcgcgcgaggcaaggcgggcagccggaagcacctctcctccatcgccaactacgtcctccaccaatgctccctgacgctgcacaagagcgtcgacgatctactcgccgacttcgagtcgggcctgaagaatgccgcattggacaactactcaagaagactagttgagtactgcagccttcaggctctgcaatctctaacatctcctgatctaggagacacgcttcatgagggatcccttggtcgggtcacgtttgatatgatgctagcctgggagacgcccacttcttctgatcaacaaattaccatggggaggatagccaaagagagagaaaatcggaag

SEQ ID NO: 56434 - DNA, 121 bp, Triticum aestivum
  Clone ID: PAT_TA_56434
gtcgaccacgcgtccgctgatgcccagagtggcaagggcaagaaaggctcagcatggcatcggatgaagtggactggttcgatggttaagcttttgattatcgtattgtcttacacgggtg

SEQ ID NO: 56435 - DNA, 331 bp, Triticum aestivum
  Clone ID: PAT_TA_56435
ggactatgaggctgaggtctgggccttcaagtaccggattgacctgtcagcactgaaggcgtccctaccgcttgatctaagggtgagatgtttacgcaagattgctgtgctcgacaagcatgagttgctcattgagcttgatgctgggcatcttgtgcactgtgatattgatggcaagtttctgggacacgtgaaatgcagtgagtgtgaggaaagccgtgtgcacattacaccttatcgctttcaggagaatatcattccacttccgctcttggagatgcaagatgattatgtgataccagaagcagaagatgatgatgagatccattac

SEQ ID NO: 56436 - DNA, 136 bp, Triticum aestivum
  Clone ID: PAT_TA_56436
gccgacgccaaactcgccaaccaatcggaggctcgggaggagcgacgatggtccgccgctgcggctgctacggtgccatgctactcttcctctcccttgccgtactcctcgccgccttggcgcgggccgggggccc

SEQ ID NO: 56437 - DNA, 192 bp, Triticum aestivum
  unsure (1)..(192): unsure at all n locations
  Clone ID: PAT_TA_56437
tggaattcttaattaagcgagcaaacggagggaggtagagcgccaattcctcagctacacatcgctggtagcctgtcccgtcgatcccatccggcgcttcgatctgcgtgttggggattgcttgntggggtggcccgcttgatttatgcgtgcatgatggctgtgggtcagtaataaatacaaggcgggggg

SEQ ID NO: 56438 - DNA, 593 bp, Triticum aestivum
  Clone ID: PAT_TA_56438
gtgcaaccgcaacagacaaggcacgccgcgtaagctttccccgctgcaaaagctcaccgtgccgcataaacaactgacctcgcaggcgaaaaagaaagcgcgtgcgtacgccctcctcacccggggcgtcgacagcgaggccgccgacctccccggggggaaatatcccggtcgaccacggccactgtagacgcatcgcatcacgagggctcgccacgcggccagccaacttggcgcgctttccgcgcggaggcggcggtcaatggccgcccggtcccgcccggctggcgcaaagcgacgccggcaacctgcaataagataagcggctacttgttcgacccttccagaaccatcgcccccctccgggcctttcagaacgctcccccgccacgtcacaggataagcccctcggatggttccaatccttccagaaccgtctcgatctttcggaattggaagcccgggtgggggttggtacgggctgtataaatggggcggggaccgtgcgcctcttctgacgagctcgctcaagcgcctcaagtacgaagcctagagggatagtactgtacttttctctcccttctttttcgtct

SEQ ID NO: 56439 - DNA, 159 bp, Triticum aestivum
  Clone ID: PAT_TA_56439
atctctgcacgtgagaggagaagcatcatcgctgttgcttgagcgcagctggataggatggtctgcggcgcggacgcttgacggctagcgcaggatcggggtggccatggactactcgcggagcagtaagcgggcgctggagagggcccagctgaacct

SEQ ID NO: 56440 - DNA, 636 bp, Triticum aestivum
  Clone ID: PAT_TA_56440
ggagtaccacctccatgtcaagaagggtcatgttgatgagtagatttaggtttttattatgtttaagctagtatgaactctgttgaattttggcgatgtatgtggcgcgaactagtagtttaaattatgcggtatgtgtttaccggatctgttatttcgtgccgtccatggtaccgcaaattcggtttacagtatcctgtaaacgaaatttgcggtaccacgatctgcgggatctgctagagatgctcttaagtgttaaccttatggttccaatgctttgatagaatgtgtatggttagtttctgtaattaaatcataattgtctttggctcattggtttgacaatctgggttatgtgtatgtgcagcgcagaacaactataatacaaagcatcttgcaaagatcttgatccatttggtttgggtgtttgcaagagtgcacatcggcttcttctgtctcttctagcgtctatagaaaggctatcaatgctggctatatatcatccatatttctcaagttcattattgagaatgcccaggcggataattgggaggagctatgcctttgcatcgacaaggatgaaaaggggctggaaaaatttccttctgaccaaggggggagtattttctgatgaag

SEQ ID NO: 56441 - DNA, 381 bp, Triticum aestivum
  Clone ID: PAT_TA_56441
ctcaacacaagcaaaaagagctcgctagctgtgggagcaaaggaggagccatggcccaagccatcgtggagagggcatgcgcgaagctcagatccgccataggagatgaagccgtggtgcgtttgaactttaccactgacctgcatgatttgttggaggcgctggaggacatccagccgtttctggacaaagccgtgatgcggccgttccgggatagctggctgtcgctttggctggggggggccttgaacgccgcctacaagaccatagacactgtggatgagctgcaggacgcgagatctgcaacgatgacgagaaggatgaagaatgccttggccatccaggtgcaggaggggaaaaaactagtgatgtgggcatatg

SEQ ID NO: 56442 - DNA, 163 bp, Triticum aestivum
  Clone ID: PAT_TA_56442
tccggacctgagcaaagcgttgcaagcggagggagctgagcatggggaagattctgcacgccattgtactagcctggcatgttccagaataatagaagacaaggctctctagccttgaatgagcatgctcgtactgagagcaggtctgatgacctgcgatgag

SEQ ID NO: 56443 - DNA, 163 bp, Triticum aestivum
  Clone ID: PAT_TA_56443
atcgcacagatgcgagccaaggaagagacctatatgcaggacagagcagctgttatcatgcggatcgactgaaagcatttggccggatcaccccagcagcaggtgctgcttcagctacacagagatgagtaccctagggagcctacaaaggcagtaggtctgg

SEQ ID NO: 56444 - DNA, 411 bp, Triticum aestivum
  Clone ID: PAT_TA_56444
cgcgctcgagattgaggggatcgtgaagcagctgtccacggcgggggagcacgacaagattgcggccgtgatcggtctgctcacaaacgatttccatactccccccaggcgaaccaccggaagggcggattgattgggctcgcggcagttactgtaggcctcaccagtgaggctgctcagcacctcgagctaattggaccttccgtgcttaattcttttctggaccaagatagcagagtgcgctactatgcctgtgaagcgctatataacatagcaaagggtgtaagaggggattttattatctacttcaacaagatttttgatgcgctatgccaactgtctgcagactctgatgcaaatgtgcagagtgcagctcatcttcttgacagggttgtcaagggtattgttact

SEQ ID NO: 56445 - DNA, 539 bp, Triticum aestivum
  Clone ID: PAT_TA_56445
ctcgccgttaacaattagagttggctgcagatgaccatgttctgattggtatgtttcactctggttttgcttctgacccttgtcactacttttctctgctattgtaatcacaggaaccgagctgggcatgcacatagacaacttgtatcatcatggttccaaaacaagagggaaacccatccaacattattacgaggcaagagtagaacaaggattacttaccgacaattgcgacagcgtagaagggaagctgatgaacatccttcgctagttccgagcaaagacggggaggagatcaccaccacacatgactagctagaggagtgcaagtgaagcaaccaaccatgagaagtccttcatgttgtcgcagcagtgcagttgacttgcagcagtgcgtttgttgtggctgtgcagctcgggcgtgcagtccactgtttgacttttttgttttgtgttttggaggtggtcacgggccgtggggtatatgggcgtgcagtacgccgctgggggtgtgatctagtgcagctcggctagcccac

SEQ ID NO: 56446 - DNA, 472 bp, Triticum aestivum
  Clone ID: PAT_TA_56446
acttgcagatagaaatttaaacaataaattaatctccatatatgactagaatagccttcttcgctaatcttacgataatctaggattcatatctaggcatctaaaagtcaagcgtacaagctagtagtatttcacaaagggccgcctattatgccccaacagaccatttccaacgggggggagagcccatcattctaaggtgcatgaacacccacaaagggaaaatcgaccccccacaaaaaaccccgcagcaatggccggaagagggagccccaaagcttttgctatcattgatgccaacaaaaaagggggattcacccctggatggatcaaggaaaggtatcatcccctgcccatcaaaggcacaggttttgggatcctgcttttgcatctgagagaaactggtgaaagcgaatgacacgttgcccttttccccgaggccggtggacgaccctccatagtaaaggggggg

SEQ ID NO: 56447 - DNA, 210 bp, Triticum aestivum
  Clone ID: PAT_TA_56447
cactcccgcaaagcgttgacttcgaaggagacttgcagaaggaagactctcaagtacttagactagcatcgccggtccagaatacagtagcctgtgtcgatccggctagactgagcatgctcttgctgagacgagtctatgatcagctgcgatagcatccagtagagactgtgagacgtcccgccagtggccacgagaagagagggtgga

SEQ ID NO: 56448 - DNA, 114 bp, Triticum aestivum
  Clone ID: PAT_TA_56448
gaggctgtgatgaaagagacaaagaagttgcaggagctcggagggcgcgtgtccgaactggagaatgtgcaccattcactcgctgaggagctccagaagcgctacatatgcccc

SEQ ID NO: 56449 - DNA, 326 bp, Triticum aestivum
  Clone ID: PAT_TA_56449
cggacgcgtgggcggacgcgtggggccgcggcgagggcgccgagctcgagctcgccatgagcctccacgtcgccgccgcgatccactgcggcctcggccggcacgccgacgccgtccccgtgctcgagcgcgccgtcgccgtcgtcaccccgccggcccccgcggccgagggcgaggaggtgccgcagccggaggaggagcaggtggtggatgagcgcaagggggaggagtgggcgctcgccgccttcttcgggtggatgcagctcggggacacccacgccatgctctgccgcatggacgagtccatcgcctgctatcggaagggc

SEQ ID NO: 56450 - DNA, 232 bp, Triticum aestivum
  Clone ID: PAT_TA_56450
gaggcctgctacagtggagaggataggagagagcggcagccagcagcaacagagggcggccatggcaatgcccaccttccatctcgcccccgacctgccgccagtctcccgcctctgcctcggtccggccccacatccatccatcctctacctcctgcctccgcccacgcttctgcggtgaccagacctcgtcgtcgcagggaccatgacgatgggggagcaaagcgggccg

SEQ ID NO: 56451 - DNA, 569 bp, Triticum aestivum
  unsure (1)..(569): unsure at all n locations
  Clone ID: PAT_TA_56451
catcgacgggacgctactccgccgccggcgatggaggacctcgaggacgtgctgggaccggccggntntccggcggcggagctcctcccgggctccgcctacccctctccactgtcgccgtcaagcccaagcgcaggtcgtccaagctcgtgcagacgcagccccagcccgatgcccggatcccaggcacccaggtaccaccaccgccatcggctgatcctcttaccacacgcgtgttgacgtgttgccttcgttccatgcttgatctgatttgcttcctgatactcgtggtatctgtgttgcagacgatatacgtcaagacattcgggtgctcacataaccagagtgacagtgagtacatgttcgggcagctctcggcgtttggatatgcaattactgaagagcctgaaggagctgatttggggctaattaacacatgcactgtgaaaaatccaagtcaatctgccatgtcaacttttatatnnnaatgcagtacggntnacaagccactggttgtagctggctttgttcccccaggaagcccggatctgaaggagctttgaggggtg

SEQ ID NO: 56452 - DNA, 183 bp, Triticum aestivum
  Clone ID: PAT_TA_56452
gccacgcgtccgccgcgatgtcgtcgggcccgcgcccgctccgcctcccggaggagctcgaggccgactctctcctcgcgaccatagaagaagagctgaagatgactcgcgacgtgtgaaaaagtatttaagtcttggagcattggtcaaacaagcagtgctatacgacatacttcctccgtt

SEQ ID NO: 56453 - DNA, 171 bp, Triticum aestivum
  Clone ID: PAT_TA_56453
caatacattgtccttcgctttgcaatgtgattcgatatgttttttttacaatcatggtggtttagttagtttcttaacaggtgcttcagttgggagtaatagttgatagtgatcgacaagattgaattctatagaggacaatacaattttgtataattggtggtttagtta

SEQ ID NO: 56454 - DNA, 202 bp, Triticum aestivum
  Clone ID: PAT_TA_56454
tgagatcggtgcgctttctggctcggtctttgctgtacctggaatatgttggacaaatgagaatggcatcgttgggcttaggcccagtgcataatccaccgctaatgtgcattgatattccttgttgacctgcaggcaaaaccatatccgtgaagaggccaaatgcaagggcgccagccaagccacaccaagttggcagaga

SEQ ID NO: 56455 - DNA, 232 bp, Triticum aestivum
  Clone ID: PAT_TA_56455
gcctctctgctaacatgctagatagacacgtccttgattctaatgagtgtcagggctagtcagggcttgaaggttcgcgtcttccagcgctgggacatcgaactctcggcgctcaggcatgacccgtgcgcattcgaaggccggattcaccgatgcggacccgttgggacatagctcaggcgaggaggcgctgacggcgagtcgagaacggctgataagcgggtcctacacc

SEQ ID NO: 56456 - DNA, 214 bp, Triticum aestivum
  Clone ID: PAT_TA_56456
cgtgaggaggaggagggccgtggccgtgggcggcacggcgagggggagcgtgaggagcacggaaagcactagcagggccgtggccggctgcggctagggatatcgtgatgaggagcacggcgatagccgccgctcgtacttgttcggcccgtgcaactttcgtactattatacataccgacctcgtgttcttaaagggccttttttctttctct

SEQ ID NO: 56457 - DNA, 148 bp, Triticum aestivum
  Clone ID: PAT_TA_56457
cggacgccaggtgtagctcagccctgcggggtgcgtccgcgaaccccccgagtgcacgacccgaagatttctgatcctccccctccgctcccgacccaaatcgcaccgatggtgggggtgcctgtcggtgctgtacaaatacctgtgc

SEQ ID NO: 56458 - DNA, 209 bp, Triticum aestivum
  Clone ID: PAT_TA_56458
gcaaagcttcagcccaccgcccgttgggaagggagcttaaaggcaaggacatcacggtcttcaccggcggcacgtacgcgtagtacgccaagacagccgccgagaaggccaaggacaccgggctggcggtcggcaagacgacgggggattacactgaggaggcggcggtgaaaaccaaggacgtgacgctggcgaccgcccatcaagcg

SEQ ID NO: 56459 - DNA, 151 bp, Triticum aestivum
  Clone ID: PAT_TA_56459
ctatggagtccttaatccaatctctgaggctcatgccgaggtcccggaggactcttatcacttgtcagaggcgggagtcgcctgaagccatcggcctgatgataacccacgcatcgatgcccagcaccaagcccttgagcagcgccgaggg

SEQ ID NO: 56460 - DNA, 532 bp, Triticum aestivum
  Clone ID: PAT_TA_56460
atcgtgtccatcttgcagttccaggctgagctgatttcttgagtgctctgccctccctggaattgctcaaacatgtgtaccaggtcaggcatgtggccatcatgtcctattttttccattaatccatgcgaataagtgtcacatgaacacgcccccagggaagacacaccgtaaatctagccagccagccacaagatcactggacgagatcaatacatggatagatgaacaaaaaacaagtactcactctgtactagtactagatgatctcactgaagaaagaaacttgtttttctcttcagatagagaaataaaatactactactaagaagaagcttcagtgcacgagcaagaaaaagtgagggagccttttattcttgtcctcgctagctagtgatatatgtctatacaatatagaaactcatgcatcatgcactcaaaggcacacatgtatacccatcctgcctgctgaataaacaaactcttcaggcatagggatttttatgttgttgctttctttgcttgacattgg

SEQ ID NO: 56461 - DNA, 387 bp, Triticum aestivum
  unsure (1)..(387): unsure at all n locations
  Clone ID: PAT_TA_56461
ggcgacggaggagcccggcgaaagggagcagcgacggcggagaagcctggcaaagtggaggagcaacgacggaggaagacgctcaaatcgggggtagtattgtactttcacactatttcacctggtcagaatgatgcccccaatgacaattatttcggaacggagggagtaattcgtagttgcatgagaatttcattgttcttgatcggcgtcgagacttttgatctcaggttgagcctcaacactcttgtaactaggatggcagttttgcccattgatatgggtaccgtgggaatcctacccgaanaaaaaaaaaaaaaaaaaaaaaaaaaaaaaaaaaaanaaaaaaaaaaaaaaaaaaaaaaaaaaaaaaaaaaaaaaaanaaa

SEQ ID NO: 56462 - DNA, 134 bp, Triticum aestivum
  Clone ID: PAT_TA_56462
cgaccacgcgtccgtagaatttgtaacctttatgaagagagcttagccaagaaaacaacttcttagaacaaactaagcttgcgcttgttattggacaagatgcggccagcagcacaccaataccttgagaaagg

SEQ ID NO: 56463 - DNA, 291 bp, Triticum aestivum
  Clone ID: PAT_TA_56463
cccctcccctacgcggacactattgtccgatgacctacccgagcgccctggctcgagcccacctctcccatggcggatggcctcgacccctccaaggcgccttcgactgtgtcggtgtcctaccttccgcaatatgctgcacagcgcgctagggctgaagcgccccacggcgacacggaacggcgacctttgccacatccaaccccggcgacgagctgcagcactggttcaaggacattcacttcagcagccacatcatgaacgaggacgctatgcccaccttgaggatca

SEQ ID NO: 56464 - DNA, 617 bp, Triticum aestivum
  unsure (1)..(617): unsure at all n locations
  Clone ID: PAT_TA_56464
aaaaatacttacgtccctccgtcccaaattaagtgactcaactttgtagaagttgagttacgaagttgtgtcacttaactcaactttgttgagtcacttaatatgggacggagggagtactagttttatgtcatgcatttttttagaaaaggagttttatgtcatgcatatctcaatatatattctttatgcatgttatgaggtcaaaatcaagcgttggagactgaaaagtcagatgtctatgtcttgtattctgtgagggatggagtatataggactgtttgtctttggatatctaattaagtatagcagaactatctttgtacttgtgcgtttgaattaattgtgtatacatcagctaatctcagcctttctgtgtaaacaccagctgatacgcggcgtgaaggtgagagcgcaacaggatctagccaagcacaagaatgccagtccagagaaaggcggggcgtccgacgtgaaggcgggcggagaagacggcggntgcaaggagaagcccccccacggcgtccggcgatctcgccaggaggccgcctccatgaaccagatggcggggagcatctgaaatgagcaggctcgcccgtccgatccaccattgaaga

SEQ ID NO: 56465 - DNA, 336 bp, Triticum aestivum
  Clone ID: PAT_TA_56465
acgcgtccgtacgactcgttcgacgtcgtgcccgtaggcccgccgccgaaatacctcgacgagagaacgaatccctacaccgctcgccgttgccgccgacgccgcgcgatgcccttgggcatctgattcatgtctcacccccacgcctccgcccccaagcggcccttctcctcctcctcgacctcccccgcctgccccgcgccgccgcacatgaagaaggctaaactccccgcctccgcctgctgctcctgctcctccgccgggcccaccgagaagagcgggctccacctggacccgggcggcagcgggcggcgcgatgggcgggggcggaccaac

SEQ ID NO: 56466 - DNA, 467 bp, Triticum aestivum
  Clone ID: PAT_TA_56466
ccacaccaaccccggcggagaattaaagcgccgtccccgccaagcaacttcggcgaccccagcacccacctcctcctcctccccccgcctccggagatccaggtagcctcgcctgacacgcccgcgcggtcgattcctgtattgtatctcggcacgcgcgcgggattcgctcctgcctgcagaccccgccgtagagatggagcgcgggcgggccgggagggacggccccttcggcgcgggcgacccgttcgccggattcggccgcctggggggcgccccgatgcccggcctcttcggcgggggcagggaccccttcgacgaacccttctttacgcagccctttggggccaggaagggcgggcccggcatggtcggccccggcctgttcgggccgatgggcgggcccggcgccggtcgggcctatgtggggggccgggcatggtctgcggcggtcgggccccggggat

SEQ ID NO: 56467 - DNA, 280 bp, Triticum aestivum
  unsure (1)..(280): unsure at all n locations
  Clone ID: PAT_TA_56467
aagagtcttgccaagatctgaggatgaagggaagaataagaatttaactaaacagttgaagaagataaggtgatttttcttccctttgttcttttattctgatgttaagatttgttatggctagatgagatttgtggtgaaaatttcccattcttttatttacctacagattttgaatgcacgattgatgattttgctggataggttacaaatctaaataataaacatttttaaaatctacattttattcatgtgaaaatttagggtggatttgtgnttt

SEQ ID NO: 56468 - DNA, 522 bp, Triticum aestivum
  unsure (1)..(522): unsure at all n locations
  Clone ID: PAT_TA_56468
gttcctttgtatggatgcacatcagacagagcctttgattgtcaccggtcaccgatttggtcatgtccagatttggaactctaacatgcagaaagtggtcacttcgattaaggcctcatgggatacagtatgcaaagttaaatttattgcacgaaaggggtggattgtggctgtgtcagaagattgcttcgtccatgtgtacaagtatgaaaaggaactcaaaaaggtcacgggtttcaaatctcacgattatgacaataccatgtgctcattagacgttcatccagcccagccgtatgtgctgtcagggtgtgataggcaaataaagctttgggactgggaccaggactgggaattgcatacagacattttgaagaacactcagatgatanttaatgaaagtaaaatttaacccagaggacaccaacagttttgcaagtgcttcaaatgatcgtacgtaaaggtttgggaagccttgatcctcccaatccaagatactcttgatgggcattccgaaagaat

SEQ ID NO: 56469 - DNA, 766 bp, Triticum aestivum
  unsure (1)..(766): unsure at all n locations
  Clone ID: PAT_TA_56469
cgacatcttcattgttggtcctcctcccgcaagccactcctgcgcggtggcggctagggttagcgatgatgagtggctagacggatcgaggcgggatggaggtagcagctgatgcgatagggagatacagaggagcggtgtccatccaatcctcctgatgcgaggtgcacgattggaccggaggtgccgggtcgaggcatggaagtcgatgcgcgcggtgggactgaccggaggagcgagatctgggtcgcccccattctctgtggccgctacccctcgcggcaccgtccttggagcgcacgcaccactgcctcagcttgtattccttgctccaccaattcattaactcgttgaagactcttcgccgnnccgttgtctaaacagtctgacacgatccanctgctcgggccgacagccatgggagggagtacatgggcgaaagcacgaaggcactgagctgcaggcaaaacatgtgagaaacgagtccaggcagcatggccaaaggtgagggcacacatcatctatgccgcaaggcccaatatcttcactaatccaattcacccaacaaacatcaaaccttatnngcgtggcattttataatttaatccnctccctctattcnccctgatgtgggtnagagctttcccaatggggttccgtttttcttgtatataaaaccagattcacatagctttggatatggcagctgcttgcatataccacaagggaatattgtcagngaaccttttgtggccaaagcgtatga

SEQ ID NO: 56470 - DNA, 387 bp, Triticum aestivum
  unsure (1)..(387): unsure at all n locations
  Clone ID: PAT_TA_56470
ggggagaaaacggaaaaacagtctcaagcagctccccgactccctccatcagttttcggtctccccggttccgagctcatccactggtcctgcgacgtcgccgaccgccgctccggaacccccctccttcccgccggcaagcagccgctccgtctctcacagaatggcgctcaacaaggagtacacttacgcggacttggagaaggagcccatactggccattcgagaagctgcggatctcgatcactggagctggtgggttcatagcctcccacattgcanagcgcctcaagggcgaggggcactacatcatcgcctctgacttggagaagaacgaacacatcggagaggatatgttctgccatgagattcaccttgctgatctga

SEQ ID NO: 56471 - DNA, 437 bp, Triticum aestivum
  unsure (1)..(437): unsure at all n locations
  Clone ID: PAT_TA_56471
ggcattccgtcgcaggccaagatttcaaattgctccaaacgataagggatagggtccaatggaggaaagtgatctaagagtcttcggacagtgatgaagacatgccaaccaggtttgctaggatatctaggaagatgcaagagtgttaaggcagcatgaaagaatccaacaaatgaatggtaaccggcaagaagggttcccgtcataagtgtcaaagtgtgcgagggggtgaagtttcaatgccccaattgcaacagtggaacctgaatatttacatgtagttgaaccttacatcattcatatgcaagtccagcagcaggtatggtgaaaaaaaaagagaataaatttgcacccgaataccagaggcacatcatgattgtagtgtgtgtgtgtngngggacaaaaatatatgtgtacatgctgagctgaatacttcc

SEQ ID NO: 56472 - DNA, 520 bp, Triticum aestivum
  Clone ID: PAT_TA_56472
cttatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatcccgcagggccctgccccgtacaccttgaggtgcccacctacagattcttggaagataacaagatgctcataggctaagagcctaaaaccagtacctaccaacatatatttctccacaggagtgaattcctgttgcgcctgtatttttgttttcatgtgggtaggaggtttttgtttcaagactatcgcaacggggatccactgttccctcccaagtatattttcagggcagataaatggttctcctatgttgctactggattggtagagtttgtcctgatttttctgagacccta

SEQ ID NO: 56473 - DNA, 508 bp, Triticum aestivum
  Clone ID: PAT_TA_56473
cttgtctcgcctcgccgccggccggccggccggctggctgatttggagagaagcgagcctcttgccctattcctgctcggccgcgggttgctcggccggcgagctcaagccccaaggtcagtcagtacggctacgtgccatcaccacgtatatgtcatttgaagaaatctgtgcttcaagttcagtagaggagaatgaggctggtgtgtgtaaatggcctgagattcaggcacctcaggcttgcgttcctcgccatctttgcggtggttcttctttggaaatgggacaagggatcactgtacagtcctggtatcctccgacccgagccattggtcttgagtgaggtatccaggccctctcaaattattagcccaggaactaatattctttcaagggccttctcgtgggtcatcttggggcttggttttccaggaaatttctggtggtcactcacaggttggagatcggaataccttcattgaagaagacccccccattatcgatccat

SEQ ID NO: 56474 - DNA, 471 bp, Triticum aestivum
  Clone ID: PAT_TA_56474
gttcaacttactgaacttggggatttggtgctctttgacgctgatggaacactggtttggtctaccaatactacggagaagtctgttgctggcatgaatcttaccagcacaggcaacctggtgctgttaaatcatgcgaatatggagctctggaggtcttttgatcacccaactgacacacttgtcaccgggcaggttctacaagaggggcagaagctcatggcaagcacctcgatgacaaactgggccagtggaaaattttatctcactgcccttcctgaaggcatgcatgcatttgcaggaactgatactcctctatcatactatcagagccccaccgggggaactgtcatgacaaacagggcagcatacgttgcactcaagaaaggcagccgggaggggggcacttgttttcgggatacagaagcaccggattaccagatccaactgcccaaagaagactatgggctg

SEQ ID NO: 56475 - DNA, 132 bp, Triticum aestivum
  Clone ID: PAT_TA_56475
actatatgtatatatgcattcgtatgtatctctgattgagatcatagaaagacttatattgataacggacggagactctgtgatggcggatctacatctttcttgatacactatatctactgtgtactaaat

SEQ ID NO: 56476 - DNA, 705 bp, Triticum aestivum
  unsure (1)..(705): unsure at all n locations
  Clone ID: PAT_TA_56476
caacaacagaagttttcctctgttctggtgaggaagccctagttccaaatcctgtctgccccgccgccgagataatggagggatccttccccgcctcttccttacacccccccgccgtagcacccgccaccacccgctgtgccccatgggttcttcttgacagtagggcctactttgccgtctgcaagaacgccaccaccgctgaagccaccaccagcaccagtcacatggtcaaggtcagtttctgcctctcagatccgccggcaatctcacacttttgcgtctttggccccgagttgaagcacgaagatttcatgatggaacccctggttctcttctcggcgaaggacctcgtactcctccgcctcgccttcaccgtcggtccacgaagcacccataaggattctcgtctcgccgagtactttctctacaaggctggtcgtggcaagccgtcgctcgaaccgatcccggttactccaccaggcaccaggaactcgttcccatctgcgtcctgccgtccgacgacgacgagnggggaaatttgtcatcggcggatctctgcatgacaaatcccccgttcggactacgagncttcatgtctttctcttccaagactggcaagtggaccaccaagcaggttgcgggtacaggcatctcccgtagtaaagaaagaagacctgcctggcccatcacttgacaaggtga

SEQ ID NO: 56477 - DNA, 486 bp, Triticum aestivum
  Clone ID: PAT_TA_56477
cttctccccttctcatcccctttcacttcttcagcttcctcttcctatcaagttgcctttcacttcttcggtttgctcttcttcgccaagttatcatccatcgagttaggcagtttagatcttggagaaaaggagtagctagctaggttccttttccttcccccgagccgggagagagaaaacagagcggagaagagacacacaggaaccggaggttgaccgggctaaagtaggttggagctcctggctgggccttttctcttggcgacgacatggcgaagctccacttcttcctcctcttgctgctggccgccgccgaagctattcacggcgaagatggggcgtacataggcgtcaacatcggcacgggcatgtcatcggtgccggctggcacgcagataaccacgctgtttcgctcgcagaacattcggcacattcggctctacgacgccgacccggggatgctgtcggcgctcgccaacaccg

SEQ ID NO: 56478 - DNA, 611 bp, Triticum aestivum
  Clone ID: PAT_TA_56478
accggccatcctcaccgcctccggccgccatcgctccactccatttgaaacagaagtgcaaaccgggcagtggagtcgaggattctggggagcggaaggcggccgagcgggccctaaaaccctaacccctccggatccacgccgcgccggcccatggaggtggacccgtcgccgtccccgtccccggcggcaatggcgacgccgggctacttcgaccctgagtccttccggcttcgggaggagtaccggcggttcagaaagagactattttttttaaacgacttcccaatggtggggaccttaatcttcaaaattttaaaagccagggccggtgggtgaaggaagcaagattacttagggggcccatggttggcttattattggagaaagtcaaccggaaggttgttgattattccaacgttgagggttggatgggaccgaacctgttgattgtgtggttaaggtagagaaggcggaagaatcaacgttgaatctagtcaagttggaggacgatatgccacgagaaggagaaacaactttaacagcgttggcttcctttcttgattaagcattacaaggatggatgcccttcccggacgtgattttacaat

SEQ ID NO: 56479 - DNA, 506 bp, Triticum aestivum
  Clone ID: PAT_TA_56479
attactgttgcaagaaagaattcgcttaggatattatcatcgggtttgaaggaaagatgttgcatggccctcttgtttcagttatgtcctgatagtgattcagagggcactggcatcgaaggatcgaggcttcttcttgtgagcgaagttgtaccgattgccattggaaggagcggggcacaggattatttggtgtagcaagactgatagagttctaggccggagcaaacaaatggacagggaaatatatgccttatgaaccaaaactaaatactgaaataaggatttttgagagttcagatgagatagtaacatatctggctgagtatatttcacaaggttcagaaatctctgttatagaaagtggatacttcgctattgtcatgtctggagcaccacttgtcagttttggggggtaaagaatttttttctaatcctttgctagctatttgccatattttggtttttgcacacgaatattatacaagggggcattattgcatatg

SEQ ID NO: 56480 - DNA, 548 bp, Triticum aestivum
  Clone ID: PAT_TA_56480
aggtggtgtacttcattcttggagctgacatacatgcctaggtgcataaagtcacaaacgcgctgctacctcttgctgactctccattcggccccgacaagtttgtagtaccttcagcatagaagcagtagtggtctgctcccccaaatatctatagctcgtggatgtggcggtatggggaatagggagtagatgatatgggaataagaggatccaggcacgtgcacaaattcttgctacctgacggctatgctgaggatgcctctgacctatctcaagaagatttgagccgcagaatgacgtgtacagcgcaccaccagttccttcgacaacacagctggtgtactggtagcagcgaccacaacttcccacacaagcgtcgcttgctgggaccggcaatggacctgatgccggatatgcctctccattccggtaggctggtcgaatattcgggtaggtggataccatagaatatcatcttttacttcttgggggtatggaccatctcctggaatcacctgatagaatttcatgaatggtttggcatg

SEQ ID NO: 56481 - DNA, 574 bp, Triticum aestivum
  Clone ID: PAT_TA_56481
caggatgttcaggtcgtgtcagcgccgacggaggacgagcgcaggcctgggagtggacggcaggcggagcaccagcggcggggcggactctagcggtcgagcagaggagatggattgggaggggagggccgccttcacatccgcgtgggtgctccctgtcgatcaccccctagtgcgccgggttcggcctgcgaccaccgaggctcgagctgctgcgctccgagatctcctggtgctttggagcagccggcgggcagagacaccaaggtctagacctccacaaccatacgccgtggctgaagcttcttttgttgacatgcaatttcgagatgttctcgtggagcttcatatctatattggtgaaggcagggcagaaggcattggatttaagctgtctgtaccaataaaccccaaatgataagtcttttttgaggagaatcccttgagctttctaatattctttctcactcagataatggtaaacaaaggaaacagcttgatgcagtcaaaattattccagctcttttatttgcgcacaaatatcaatcttgttacgaacacctacgtatgccag

SEQ ID NO: 56482 - DNA, 462 bp, Triticum aestivum
  Clone ID: PAT_TA_56482
ggcactgccgtcgccgccgccgccgctgctgcaggggagctgctgaccgggagatcataagaggctgctggtccatgcccatgagaatgggaatggccatggccatgtccatgccaatggaggaggagcagaggagctcaaggctgctcctgaggtggagcagaaggaggaggagaagactcctgaagagcccacggttgctcaagaggagcagcagcgtcacaagagtatcttcttcgatccagccaaagttcctgatattattactgagggaagtgccagatatttggtcacgggaacgatgcgatctggtgacgaaaaggaagccgcaggtgaaactccaagtacaaaagacaagcagcttgaagcacatgaaaatggcaatggtcaagaaatcaatcatggcccaagcaacggcgaggtagaaaatggaacacactcaaatgggtcgcatcaggtccc

SEQ ID NO: 56483 - DNA, 477 bp, Triticum aestivum
  Clone ID: PAT_TA_56483
caagagagtacagtttctcattgaaggcctttttgctatcagaaaggccaaatttcagggattcccagccatccggccagaactggatcttgtggagcaggaggaccaatttactcatgatatgtcccttgaaactgaactagaccctgagactaatctaaatgttttcagagtaaacccgaactttgctgaagatgagaaggcctacgagaacctaaagaaaagcatcctgggagaagatgatgaagaggaagaagggtctgatgatgcttctgatggcgaggatgaagaagaatcagatgatgaagaagacgaagagcagatggagataagagatataactgagaccaatcttatcaaccttcgaagaaccatatatttgacaatcatgtccagtggtgattttgaagaagctggtcacaagcttctataaattaaacttgaaccccgggcaagagatggagctgaacatcatgc

SEQ ID NO: 56484 - DNA, 446 bp, Triticum aestivum
  Clone ID: PAT_TA_56484
cttctacagaccaagcatcaaactcgagcaccattgcagtgatacagggggatgcaggtgtttctgagacggcgggagagcctagtaacgcaggttcttcgagaaccctgaggagggggaggagcagcgcgttggcttctttagatgtggatggtgcccccccacagcgcaacaagaggcggaggatgtagaccttctcggtcgcggagtttctttggacttcatgggtctgattccagttattccatttcgtttctttggatgggatctgctgtggtgtagagtaacaaagttttttccctttccatttgtttactagaaagggtctggttagtccccctggggcctgttgtacctcattagtctgtcaaactgttgggcaagccaaatgtggagggggtgttgtggggatgaaaatttccccctgttgagttggatgcgccccc

SEQ ID NO: 56485 - DNA, 505 bp, Triticum aestivum
  unsure (1)..(505): unsure at all n locations
  Clone ID: PAT_TA_56485
ctggcgccccctttatgcgcgggctacgacgcagcagcttggctcgcattgcatccaccaccagagcggcgtgggcgcgtcagtgcagcagcagcatattcggaggagcgagagcggcgccgtactgcaccatggcgggacggtcgggggaggaagcggacgccgcgatggcggggcgtggncaccngnncggcgnggaggaaacgcctacggcgaggacnccgcgccaccgaggaccaagcccggcaccgccgggggcccgnctgcanncgccagggggcccactcccctgctgaggggagcccgcgggacaacaaaggggcgggccctttacggaagaagggagcggggacgcgcacttacctgcgcggggctgctgcccttcggcccattctgccccagggagcttcagggagaagcgggttgggtgcngaacgtgcgggcagctttgagggtcccgcttgnagcgcttatttgtntccttcatggaccctttcaggagaga

SEQ ID NO: 56486 - DNA, 393 bp, Triticum aestivum
  Clone ID: PAT_TA_56486
aagctggatataatccaaactcgacgatgtggaatctaaaggcgctctactatacgacaacttgttccgcttgagtggccttaccaaatgactatcaagatacccgctatatgcgtacagcacagacggcgactatgcactagggggactaatgagaaccattctcacgctttttgaggcaaaaggaggacagaactgggggcatgataatggtaaggctgtggtggcctcttgtacggcgtgactcactctatgcgggggggatgagaatacatagagaggctaggaaatatgacaaccaatagaactggtgatctacgctccgcaggagtagctcaagttttggctggtggacgcggtggctccaatttttttgggtagctcggtgaacta

SEQ ID NO: 56487 - DNA, 695 bp, Triticum aestivum
  unsure (1)..(695): unsure at all n locations
  Clone ID: PAT_TA_56487
aaaggcatgggaggttgatactcttagaggtcacatgaacaatgtctcctgtgtattgttccatgcgaagcaggacatcattgtatccaactcagaagacaagagcctccgtgtctgggaatgccacaaagagaactggtatccagacctttaggcgggagcctgaccgcttctgggtccctggtggtcaccctggaatgaatctttttgcagctgggcatgacagtggcatgattgtggttaaggtggaaaagaaagcgccagcttttggccgttagggggaatccagggtttattgtgaagaaccgtttcccccgtttctataagtccttcacacagaaaggaggcccagggggctccgataagaagcccggggtcagtcagcttgaatcagtcaccaaggacattatcatatagcccaactgagaatgctgtctttgatctgctctgatgtggatggggggctcatacgagctttttcattggtcccaaagattctgctggcaagggctgattatttgcaggatgcaaagaagggatctgggtgggtcttgcangttttcatagccccggaacaggttttgcagtcctgggagaagagcagcaaccaggtttttgggtgaagagtcttaagaatgagattgtgaaagaaaagccctctttcctattggaacctgatggttatttactatgct

SEQ ID NO: 56488 - DNA, 525 bp, Triticum aestivum
  Clone ID: PAT_TA_56488
ctttaggagtaaaaagtgaactaagtgggtatgagttgcctggcttatgtgagaacagctttatcagtagtatggagcctattgtgaaaaaacttcacaccagaactctgaactgcaatgggggccttgcaccttgttctcgacaaaggaaaaagagggattcaagtgaaaaggtgcttgaagaagatggttacaaaaatgatgagggtattccttacccttctaggcaaaagaggaagaagaaaactgcgacggattcgattgaaacagctcttgaagaagatgctccaggacttctacagattcttctggacaaaggaatagtggtcaaagagattaaactttatgacgttgtagaagacgatgaaatgcttccagattgcacagaaagtgactttcaagaccttgaaaatgtgattacaaaattgtttccacaaagaacatccttgttgaagtccgtagccaagcatgggaaggggggaaaggctatttactgcttaacttgcttaaattctctcattgagc

SEQ ID NO: 56489 - DNA, 105 bp, Triticum aestivum
  unsure (1)..(105): unsure at all n locations
  Clone ID: PAT_TA_56489
tgactagatcaggtccattgctngatctcattctggggtctctgcttcctgatctgtcctttaagaggaggattgaaatattggacctccttgctagtgtgggtg

SEQ ID NO: 56490 - DNA, 219 bp, Triticum aestivum
  unsure (1)..(219): unsure at all n locations
  Clone ID: PAT_TA_56490
gcggcgctcgagggcggcgcgcaccagcacggcggcaacaacagcgacgcgctggangaggcgctgctgggcgccggcggcaagaagaaggagatcagcttcgcgacgttcgccacggggatcgtgcacggccttcagccggacgctctcatgatcatcctgccggcgctggccatgccgtcgcgcgctgcggnggcccgccttcctcggcntgttcct

SEQ ID NO: 56491 - DNA, 140 bp, Triticum aestivum
  Clone ID: PAT_TA_56491
gcgtccgcggcgcgtgggcagcacgcccccgcccccgcgtcgacgagtacggcaccctgtgccggccggccacggcgtaccggaccgaagcttgggacttcccggccaggcccacagacgggcacaacccccgcttgaca

SEQ ID NO: 56492 - DNA, 378 bp, Triticum aestivum
  Clone ID: PAT_TA_56492
ggcgtccggggcggccttctcgctcgcggggtgctgtggttggccgacgtggtggttcgggccattctgctgcctcggctgctgtgtctggtcgatccgtacgtatggaggatgctcctgcctctcatcatcggtcgttctgtcggggtggccgttctgtaagatcttctggttctgcatgtggccgctccttgcccgtttctggttctggatgcacggcggattttgcgtcgtgatttgggtcttttctcaccgctcgagctttgggcacgaccagcagaagaagacgaccggccatctgcaacggaagacaaggtgggcagccgcttcaagcaccatatcatgttccaagtgagccgatgttcacggaagcgcgcg

SEQ ID NO: 56493 - DNA, 347 bp, Triticum aestivum
  Clone ID: PAT_TA_56493
accaaccgcaccgcagcgcgcgacgcagagatttgattgagagagaatggcgaccccgccccaacaccgggattctccaagctcacctgcttcgagggcgagcatgccattttcgggaacctggggcggtggaacgggttacgggccattcttgaaaacgggcaaaagtttcgccgccgacgtcaacctggaggatttgggcctaaattaattttggaaaaaaggcaccgaccctgccgacgtggacaagctgccaaattactccagcggggccgtttgaactttccttgagtttttcaagtccgagatcaagggtgaaatgaaagatgctccaggggtgaacgccg

SEQ ID NO: 56494 - DNA, 171 bp, Triticum aestivum
  Clone ID: PAT_TA_56494
gacggcgggggagcagccgcgaactgtgttattgaagtctagcgtcgcccatccgtgcgatgaatagcacagaagcactccatccacaaagtgataaaaccaagatgcactaagcttactagtccccaactacttcttcttctccgggcattggattgcaccggggggcac

SEQ ID NO: 56495 - DNA, 339 bp, Triticum aestivum
  Clone ID: PAT_TA_56495
aaggactacaccgccgagaaggccaaggagaccaacgacagcgtcgcgcacaagacgagcgagaccgcggaggccaccaggaacaagctcggcgaggccaaggactgcaccgtcgagaaggcgacggaggccaaggacaccgtggcgcagaagacgaacgagaccgctgaggctaccaagaacaagctgggagagtacaaggacgccttgtgccgggaagacgcaggaggccaaggacagcaccatgcagaaggcccaccagacgaaggacgccgccgccgagaaagcgaggcaggccaaggacgtgacacagcagaagggcggcgagtacacggacgc

SEQ ID NO: 56496 - DNA, 191 bp, Triticum aestivum
  Clone ID: PAT_TA_56496
gccacggtcccccctgctgagctcccgatgctctgctccggtctgcttcgaggcgtctgcaatggaggggctctggatcgggacgggcgacaccaagctggaggagatgctctttctcgccacttggcttcggttcaaacttggcggcttcggcttcgtcccaaaagttaaagggggcctagcggctgggg

SEQ ID NO: 56497 - DNA, 184 bp, Triticum aestivum
  Clone ID: PAT_TA_56497
caacgacgcgttggccaggctcgcacgcaacgacgtccgctaccgcttcgtcgtcgacgttgccgggagtggctccaggctctagctgtttgtttaaattattggtgatttggacgcatggttcaacgtagattctgggcttctgtcagaaagaaagcatgggtacctgtttcattttcagctc

SEQ ID NO: 56498 - DNA, 258 bp, Triticum aestivum
  unsure (1)..(258): unsure at all n locations
  Clone ID: PAT_TA_56498
ctctgcgcaccttagccagctctcctccttccttccccgcccgcgcgcgctctctcctcgccggcgccgccccgcgccatgtcgtacaacaagaccgcctccatcaccgccgagaccataaaccccaaggtgaagatcttcgactacgagccctgccggggagatcgccaggcacgcagaggtaacagcaacagtgctgcctgcgctcaccccccgccgttcatctgtccatgtatgtatgtatgtatgtatgnatgt

SEQ ID NO: 56499 - DNA, 179 bp, Triticum aestivum
  Clone ID: PAT_TA_56499
gcgtcggagggatctcagctctgatcatagttgatatgccaaaatccacattttcttgtttgctgctgaagttatggaggctgaccgctctagccatcttcccgggccttggccggcccgcgattcggacggaaccggcgtggggggcgggccggggcggggggggggccgtccctctt

SEQ ID NO: 56500 - DNA, 267 bp, Triticum aestivum
  Clone ID: PAT_TA_56500
gcatctgtccacctcccccttcctgatccgccccaagcccctcctcgtctccttgtcacacccacctcatcaccagcgacggccgcgcctaaacgcatgagctagccaaggaaaagcggggtggggcgacgccctggtcaatcggccggccaggagcctgcgtagaggcgggggcggagacgacccttaatgggccaagatttggacagggcgccttaaccttggctttctctttcacctacttactggtagaaagacagcagcagc

SEQ ID NO: 56501 - DNA, 118 bp, Triticum aestivum
  Clone ID: PAT_TA_56501
ccgcgtccggcatgcgacttctcgtgtggagccagtaaagcctttctatgtattgcgttggattgctgattatcgactctatttgcaaactttgcgtaatgccgcggcttctgctctg

SEQ ID NO: 56502 - DNA, 129 bp, Triticum aestivum
  unsure (1)..(129): unsure at all n locations
  Clone ID: PAT_TA_56502
gtcaccacgcgtccgcgagagcagagaagagtctacnntcgccgcgttcgggccgaaagacggtgacctcgctgccccggcgtcacgggggcggctcgcgctggcttccctacgccacttctgtgatcg

SEQ ID NO: 56503 - DNA, 416 bp, Triticum aestivum
  unsure (1)..(416): unsure at all n locations
  Clone ID: PAT_TA_56503
ggagcacctcgggaggcacatggcccccggcgcggcgctcgtggtgcggagcgcgcacggcgcgcgcggcttcctgtacccggtggtggaccccgaggagatccggcgaggcgggttcgaggtgctcaccgtgcaccacccggaggacgaggtgatcaactccgtcatcatcgcgcgcaaggcggcggcgccggcggccgttgccgccgacggcgacgtgcccgtgaacaacggcggcatgccggcgcagtgcgcggnggcggngagcaaaccgtgcctcggctgcgcctgcgagctggggacgagggcgcaccagaagatgaaggagatggccntggaggagatggagggcgtagcatcgggattgccagcagacattggcattcgccagagcacggggatgaattcacccaccc

SEQ ID NO: 56504 - DNA, 159 bp, Triticum aestivum
  Clone ID: PAT_TA_56504
cggagacgttcctacgtgccggttctggatgcgctgctggctcgattgatccaccaccgagcggcgtgggctcttcagtgcagagtcgatattcggaggagcgagagcgggccgtactgaccatggcgggacggtcgggggaggaagcggacgccgcga

SEQ ID NO: 56505 - DNA, 341 bp, Triticum aestivum
  Clone ID: PAT_TA_56505
ctcatatgggcggcgcgtcgccgctggaggccatccagctgcagatcgtggtgatgaacatgctcatgggggcctccaccgtcagcagcatcctctccacctacctctgctggccggccttcttaccaaggccttccagatcgatgactccgtcttcgccgactagccatggccagacaagccaccgctccgttttctgtgtgatgacgatgacaaataatttttgtttttctgcacctcaaagtcgtttgggctgaggccgcatgttttcatgcggaatttcgtccgtcaattctgggcttgtgccattttttttaatcatatgagcggggatttagtcc

SEQ ID NO: 56506 - DNA, 281 bp, Triticum aestivum
  unsure (1)..(281): unsure at all n locations
  Clone ID: PAT_TA_56506
gccccctnctccggcagccgccgcccgcccgccgtcgacatcccccaggggtccgcccggccctccgccgcatcggccatggcgtcgccggcgctcatctccgacaccgaccagtggaaggccctccaggcgcacgtcggcgcgatccacaagacgcacctgcgcgacctcatgacggacgccgatcgatgcaaggcaatgacagccgaattcgagggcgtctttctggactactcgaggcagcaggccaccacggagaccgtcgacaagctcttcaagct

SEQ ID NO: 56507 - DNA, 538 bp, Triticum aestivum
  Clone ID: PAT_TA_56507
atattacaagacggaagtgcggagccaataagtataccattagcactgttacagaacatcaccgagaattttgctgatgagcgaaaaattggtcaaggtggatttggagtcgtttacaagggagttcttcaaaacgggtatgttgctgtgaagaaactcttaaacagccggacaattgatgatggtctattttatcgtgagactaattttctatgagtgtcaagcaccaaaatatagtacgatttctagggtactgtgctaatacagagaatatagccattaaagtggacgcatcaggaaaatgcgggaagtatttgtatccggagattaaagaaagaatgttctgttttgaatatatcagtaaaggaagccttcacaatcatcttactgatgaattaagaggactggaatggcatacccgttatcaaattataaaaggaatttgtgatgggctacaatatctttccaaggaaaaggatattgttcatatgggatcttaaccagagaatatactggtgggtgatctcatgataccaaa

SEQ ID NO: 56508 - DNA, 435 bp, Triticum aestivum
  unsure (1)..(435): unsure at all n locations
  Clone ID: PAT_TA_56508
ctcggggcccctgttcctctccgggcccatcgaccgcggcgcccagctctccggtccgctcgaacgccgccgtgcccttctccggcccgctccccaccaagcccaccaagcgcacctcctcctcgtccagagggctctccagcaggttccggaagccgttattcggcagcctgcggcggagcgtgtcggagaagcaccaaccggcgctcatggtgccactccgccgagacgacggcgtgcaatgggcgcacgggcgcgcacgggaggaccgcgtccacgtgggttgtctccgaggaccaacgttggctgttcgtcggcatttacaatggcttcaacggccctgaggcccccgactttcttgttgncaacctctaccgctttctcctacacgagcttcgtgggatattctaccaagaggcagacagggatagcaag

SEQ ID NO: 56509 - DNA, 472 bp, Triticum aestivum
  unsure (1)..(472): unsure at all n locations
  Clone ID: PAT_TA_56509
gaacttgcgcttatttttaaagaaacaccatgacagaagatagtaactctacaatcccagtgacatcaaatatgtttgtaacttgattctcttgaagtgaatttgcaatatctcactagagaactagcattgaaattggtatccgaaacaatcttcaccatggaagttggattctttattggttaaacttggatgtatctacttactattaaagactgtcatagtgctgcagtacacatttacacatgcattcctgctaagaagacgtttgtgaaattgtcaggctacttcacgtacacacatatttttagctgtcatatgagtcgattatattataccatggagctaattatttaatggggagaaaatatttgattttggacaatcttatcagtcgcacaagaataattnttagtgtataaagtgtgagaatcaataaaagaaaaaaggctcaatccttgcactggaaaaa

SEQ ID NO: 56510 - DNA, 276 bp, Triticum aestivum
  unsure (1)..(276): unsure at all n locations
  Clone ID: PAT_TA_56510
ctncatgtcccgttatgagtacttggganaggaagnctctatgtacctgaagaaggtngantacaaccctgacaaggttcccttcgctcccatctctgggtttgagggtgacaacatgattgagaggtccaccaaccttgactggtacaagggccctacccttcttgaggcttttgaccagaacaatgaggccgagaggccctcagacaagcccctgcgtgttccccttcatgaaggttacaagattcggcggcattggaactgcgcctgttggcc

SEQ ID NO: 56511 - DNA, 336 bp, Triticum aestivum
  unsure (1)..(336): unsure at all n locations
  Clone ID: PAT_TA_56511
caagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgcccagaagntctctgctgtntacttnnactgcgcg

SEQ ID NO: 56512 - DNA, 160 bp, Triticum aestivum
  Clone ID: PAT_TA_56512
atcatctctggcttcaaaaaggtcataccgttatctccgcaaaggacattcctgccggcggaaggaatcttggatccagcttcccggggctaggagatgaaccgctattcggcgatccgggtggtgaattgggggcgcaagtattggggcggggattggt

SEQ ID NO: 56513 - DNA, 623 bp, Triticum aestivum
  unsure (1)..(623): unsure at all n locations
  Clone ID: PAT_TA_56513
cttgaagcttttcgaggtaatggctagcaagagcaagatttactttgttttggagtatgccaaaggncggcgaagcttttcaacaaaataaccaagggaaagttaagcgaggatgctgcaaggaaatacttccatcagctcatcagtgccgtggactactgccatagccgaggtgtttatcatcgcgacttgaagccggagaacctactcctggatgagaatgaaaaccttaaagtctctgatttcggtctaagtgccctggccgagtccacgagacaagatggcctcctccacaccacctgtggaactccagcttatgttgctcctgaagtgcttagcaggagaggctatgatggtgcgaaggctgacatatggtcatgtggagtaattctgtttgtgctggtggctggtttccttcctttccatgacacaaatcttatagagatgtataggaagatctccagggctgaatatagatgccctcgccctttttcagttgagctgagggatctactgtataagattcttgatccagacccaagcactagagcttccgtttcaaggataaagagaagcgcttggtacaggaaacccggtcgatgtaaatggactggagatttaac

SEQ ID NO: 56514 - DNA, 208 bp, Triticum aestivum
  unsure (1)..(208): unsure at all n locations
  Clone ID: PAT_TA_56514
aggatatccaccaccagcagtccagcagcctggagcgcgctgctaagcgcctgcagaggccacagcagcgactcgaaggtcggccgtaatgctgcctgccgtgtcctggagttggagccgggcaatgcggcggggtacctgatgtcgatgggcgtgcccagcgctggcgagacggcagcgcggntgcggnnagctgtgagggagaggg

SEQ ID NO: 56515 - DNA, 385 bp, Triticum aestivum
  Clone ID: PAT_TA_56515
gtatttctgtaacatttagctcctgttcctaaggctgatgcatccactgacatgtcaacatcatgtcctgtgtgttctttctccaagatgtagtgcaggggttcttatttgatgttcttatatacgctatgttatcatgcaggtggccgttgggcctatctgaagagcaacaatgtaacgcttttgagcttaggtacaagaagtcgtatttgaaaggggacgagatgatgttcatcaaaatgaaactgaaaagggtgggctatcatctcttagttatacatcacatttagttatgcgccaatttatttttagacaacatgagcatggagaaacatatatgtgaaagggtgggctatttgaagagcaacaatgtaacgctttttag

SEQ ID NO: 56516 - DNA, 452 bp, Triticum aestivum
  Clone ID: PAT_TA_56516
gggcggcttcggcgagcgagatggacatctcgtcgttcttcacgtcgcttctgacgtccttcctcatcttcgccgtgctggtcctggtgttcacgtggctctcgcgccgcccggggaacgcgccggtgtactacccgagcgtgctgctgcgggggctcgacccgtgggaggggcgcgggcggggcacgcgcagccccgtcggctggatccgccaagcgttcgcggcgtccgaggccgacgtcgttgccgccagcggagtcgacgccgccgtctacctcgtcttcctctcatccgtgttggcaatccttgcgttttccgcgattgtgttgcttccagttctgttaccagttgctggaactgatcatgccctggaggattctactggcagagtgccgcggaacgtcacagattttgaaagattagcattgggcaatgttcaagaccgaagtgcg

SEQ ID NO: 56517 - DNA, 360 bp, Triticum aestivum
  Clone ID: PAT_TA_56517
cggacgcgtgggccgccgcacccgctggcgcgcttcgcgcccacgctgtgcgtgctcaggctcggcggctgccggttccccggcccggccgcgccgccgcctccgagctttccgcgcctcaagcagatcatgctgttcaatgttggcatctcggaggacactctgcaaagcgtcatctccggctgcgctgttctccaaagcatctcactgcacaacatgagcttcggtcgcctgtgcatcagctcgccgaccctcaggagcatcagcgtcgaaggtgtcttcaccttccgggagctggtcattgacgacgccccttgccttgagaggctgctgccgatttacccagacgatggggcgggg

SEQ ID NO: 56518 - DNA, 138 bp, Triticum aestivum
  Clone ID: PAT_TA_56518
tcgatgcgcgcggtgggactgactcgatgagctacatctgggtcgcccccattctctgtggccgataccccttcgggaaccgtccttggagcgcacgcaccactgactcagcgttgtattccattgctccaccaattc

SEQ ID NO: 56519 - DNA, 465 bp, Triticum aestivum
  unsure (1)..(465): unsure at all n locations
  Clone ID: PAT_TA_56519
accagatcttggctatgatatatgctgctgatttggctatcaactgctaaatctacgaatcattcaaaatgttttgcctaactgcacaagccttgcatatgaccactgggccatgtcttttgattttactactgctatggacaaaagaaggctaaagctgggacagacaacaatgtcaggagccaaccgagaattttactactgctatggacaaaagaaggctaaagctgggaaagacaacaatgtcaggagccaaccgaggattttactactgctatggacaaaagaaggctcaagctaggaaagacaacaatgtcaggagccaaccgagatccgaaatgccgagaagcagggtttattttctctcatcaccataacaaaggggagactccagggagagagagganagctgtgcaagtgcccctggaagcgaggcagctcggcggcgtcgtggaagaggagcta

SEQ ID NO: 56520 - DNA, 138 bp, Triticum aestivum
  Clone ID: PAT_TA_56520
gatgattcctggggaagcgtgctatctagacttgcatgaaaatactcttatatgctatgagtgaacggtctgcagatcaccagcgacgttgcgtatttagcgtgcgagcagaggagatggattgtgagggctatggcc

SEQ ID NO: 56521 - DNA, 151 bp, Triticum aestivum
  Clone ID: PAT_TA_56521
gccgagggcgtggaggtagacgcagatggcgtagctacaataacaaccataacaactccctataacgctattgatccttcccatgaaaatggaaatgtatatgaacatgtccattccaattgacgacgaccagaggagctcaaatcttctc

SEQ ID NO: 56522 - DNA, 322 bp, Triticum aestivum
  unsure (1)..(322): unsure at all n locations
  Clone ID: PAT_TA_56522
ncacatggccaggcttccatcaattgacccaaacacccgtactatcttgatttgtgggtatccaaatgttgggaagagctctttatgaacaggttcaagggctgatgtggacgtacagccttatgctttcacaacaaaatccctttttgttggccatgcagattacaagtatctgcggtaccaagtgattgacactcctgggatccttgatcggccttttgaggacaggaacatcatagaaatgtgcagtatcaccgctctcgcccacttgagggctgctgtgctgttcttnttggacatntctgggtttctggggtacact

SEQ ID NO: 56523 - DNA, 443 bp, Triticum aestivum
  unsure (1)..(443): unsure at all n locations
  Clone ID: PAT_TA_56523
gatcagaacattcttctagaccagaaccatgtcgccaaaatcggcagctacaatattccaatcctaggagaggctgcaaaatctgagggaggggctggaagcaggcaccaaactgacagcacgatgctcggcgacaagatcgacatatttgatttcggggtgatcctgcttgagcttgtgtccggaaagccgatcacatccatatatgaggtggagatcatgaaggaactgctgctgtgggcaatggccgaggaggacagggccaggaggaggagcttcgtggaccccgcggtgagcaagagctgttcagaggaatcactgaggaccgtcatggagatctgcctgaggtgccttgccaaggaggcggtgcaccggccgtcggtcgaggacgtgctctggaacctncagttcgccacccangtgcaggatgactgggaggggga

SEQ ID NO: 56524 - DNA, 569 bp, Triticum aestivum
  Clone ID: PAT_TA_56524
gatagccatgatgatggtgcaagtcaatctgatggagaagattcgccaatacaagttgaaaaggatttagcaagccaagttggaaacaatgttgaggtaacaagtgatggtagtttggtgaaccgtagatctgaacgggttaggcaagccaagaaggtcaaggaggtcaccagcctttacaattgacaagttaagcggcatgggagcaaaagagcttttggtttgatgaagactaacgggtggataaacaggaagtccgaagtgaaggtctctgttcgactcaatacttttggtgcaagactgaagagttgaagaacaggaagtctgaattgaactttctgtttgtattttggggtcggcataattgaacttcgaatgccgtgttaaattcatcatggactgtaattctgaactgttatgggtgttcgtttcgactctcggtagaactattaagtcgcgtgttgcttttctaatagttgatgctctctgaattgatccactatgctattgactgaatggctgcaactggagtggtgatgttcagcctgatatggagggatttgaggaat

SEQ ID NO: 56525 - DNA, 761 bp, Triticum aestivum
  Clone ID: PAT_TA_56525
taagattcgccccattcctttgtcctgattcatgtgttgtgccatcaaattgccatgaaagcgtatattttgtgctttgctgtcgtttgatgcggataaaaggcgatgcttctataattagccgtgaaaagttgctcaaggcgccaactttaaggccattcaatacagtacggatggaatgctcttctttgaatggttattacttccatagctgcaagccatttcttctttctgaattgtaataacaaacaaaatagcattattctttgcgatgctagcttccaaaggtgccgactttggggatttatactagtttggttagtactcgtttggacgaaacggtcttggcgcgtataatttaatgaacattgtgaatgagctgagctagttattgcattttggtgattacagaataagtaaaataacggttggaggggtgaaaggaagccataatgaaagccttgaccaattacggctatcttttattgggaggtttgcttactgacgtggacaggaattgggaaaagtggcaagtactttgtctggaagatggttaacgaagaaagcaagttgtacgcgatcttgtgtttgtacaatttggcaggaactatcctttacacacatcaaccatgataggtttattaaaagacataatgaatgttaaccactcatgggttcatctattttttccccttcatcattgcatatttcttctcttgcccagctactagtttactcacccttttctctacatctgcttc

SEQ ID NO: 56526 - DNA, 476 bp, Triticum aestivum
  Clone ID: PAT_TA_56526
ggccatggtagcacctaccgtatacttactccgtcccaaaacaagggtctcaactttagtactaatgttactaaagttgaaacatttttgggacggagggagtatgttttatgtgtgtttcgaagagacgacctgttggttgaatttgtgcacgcattgcgtaaattcaactttgcaataaagtaaattcagcttagcatataaaaaaaaaaaaaaaaaaaaaaaaaaaaaaaaaaaaaaaaggaaaaaaaaaaaaaaaaaaagggcatgcgcctctagaagatctaatataacgtaccctagcttgcgaccactgaccttttttttacagcgacctaaatggaataacctgggcgtggcccaacatagtcgccatggagaaaaccctgctttcgccaaatttagtagtctcgaagaggaccccccttatcgcccttgccatcagatggacaagctgaatgccgatcggccttccc

SEQ ID NO: 56527 - DNA, 798 bp, Triticum aestivum
  unsure (1)..(798): unsure at all n locations
  Clone ID: PAT_TA_56527
gtccctcctcccgtgtgcggcgccgccgctgcgcacaggacagcgagcgcttccaccccatctcctcgccctcgtccacttctccggccaagccgctcacttctcctcgccctcgtctacttctccggccaagccgctcacttccaccacttctcctcgccctcgtccactcctctcgacctcacgagtcctcaccagatctgaagctcgtaggcagcagggctccctagactgcagcatggtgctcggcggctgcggcaacggagctgatggagcacgatccgaccagttcaacggaggcagtagcacggggcagcggcagcagcatggagggcctccgcttgactgggaagatgcgatagcgaagatattagatccaaagagtgctctttcagccattgatgaagttagtaagtttagggagtgccaaggaaggtttgggaccagattagcacaagaagctgcggcgagaatggagccaacccaatggtggtttcaatttggaggggatgttcctgcattgcagaagtgtgcaatgagaatttgctcacaatgtgtctcatctagtgggtgtgagaggaactggagcgcctttgctttggtgcacacaaagcaaagaaatcgccttttatatgacaagctccacaagctagtttctgtccgctacaacctaaagatacgtgctgaagaagatcaagagaaagagagagatatagataaagaggttgatccaagtgcattgctgatagatacaacaatgttcgatgagacanatcnncatatggagtggctgaatga

SEQ ID NO: 56528 - DNA, 616 bp, Triticum aestivum
  unsure (1)..(616): unsure at all n locations
  Clone ID: PAT_TA_56528
ggggggggtacctgatccgcttgttgatacatgttgtgttgtcacattacctcattcaacttgttgaaccactttgcagggaccacatctcatctgattcaaagagataagcgcatgtggtagacaccgcagcaagttgaagaaccaacactagcaagtagcaacatgtgaagaagaaacagtatatggcactctgaacacttaactgttcaaggcatcattacatccactccgaaccgctgacctttctcgaatgtcttatttctccatgaagttatggggataataccatttcattcatgtaccgacgacgaccttatttgttagtatgcccatagctgtttccttttctttttgaaaaacaaggtatatacagagcagagcaagattatttcatgcagttagccattggtctgtctgaatggtgagctatttcagaaacaatgaacaatggtagagcacaccgtgtcaaactcttaaaaaaaaaaaaaaaaaaaaaaaaaaaaaaaaaaaaaaaaaaaaaaaaaaaaaaaaaaaannnanaaaaaaaaaaanaaaannannnaaaaaaaaaaaaaaaaaaaaaaaaaaaaaaaagggggggccgttttaaagg

SEQ ID NO: 56529 - DNA, 787 bp, Triticum aestivum
  Clone ID: PAT_TA_56529
aaagaaagatacatagggtgtatgatctggcgcatattagataatcaaagttgatgcattgtgcaccaatctggttgatgtttacataatccaagcagatttaccaatttgaagagccatgtattattgtagcttcctctctacatcaagtacacataaatataatgccgaagaatgtagtttattttattgttctacagatcttccctgcgaggcgctacagatcagatgggcgctgttgtgaaggccgcaaaggcgtggcaggtggcatgggttagcatgtgggtggtaccaccatgctgctctggacgtgcattgtggtgctgctcgtggcggctttcggagggagacagagtgcagaacataaagaatttgggagctacttgggtttggatcagcaagccatgtccgtttggtttggcaaaggaaggccttttatcctttttctataatgccatgaacatctctgaatttttacactggttccagccgatgcttaatatttttccaacatttttgtgactggagcccacacatacatagtcatggatctgattttgatttttggaccttgctatttcactgatttggaacatttatatgcagttctaggcttctagctagatggattaatagatatgttggacctatgcattttatattacccgcatggatctatgtttattatttgatgctcctctttatcctggagaagatttttgcaaagagttgtcatttttggagaatgggatttgttgtcacttcagcagtatgctttcagtgctac

SEQ ID NO: 56530 - DNA, 724 bp, Triticum aestivum
  unsure (1)..(724): unsure at all n locations
  Clone ID: PAT_TA_56530
ctctagtgccatcgtccagccactccagcgccgcctccctccccatcgaccagcgcctcactgcccgtccagcgccgccaccacgcctccaacgccagtctcccaccccaccgagcgccgagccctcgccatccagcaccgcccacctccccatcaagcgccgccgagattccgggagagacccccgccgcgatgccgagaaggtggcaggtctggggccggcccgacagtagccaagtctgggtccccgcccccgcccccgacgcgccgcccccgccgccgcccgccgcggccccgcctcttcctccgccggggcacgccgcttcattcgaggacgcgccggtcaaagacttgactggcccctctcctgcgtcgtcgtttctccgatccgaaaccctaggccggggcgctgccgacggatgccgcgtcgagtccatcgccgacctcctcgtccaagctgaggaacctcctgtgggctacttccaagcatgatgtgtacgtgatgcagaactattctgtgaggcactggtggtccttactccggagaggaaaagaagtgctcaacgtggcatgcccaaatcaggatatgcaggggaggtcggcccttgtacagggntgaagatcagcaccatgacggtgaaagacaacctcctggcggctgggtgggttccatggggagctgatctgcaatgcatcccaccgccgatccatatccagatcagct

SEQ ID NO: 56531 - DNA, 554 bp, Triticum aestivum
  unsure (1)..(554): unsure at all n locations
  Clone ID: PAT_TA_56531
ctgttggacaatggccgatgggacttggtaagagaaaaacatggacttggtaagtccttctcccttctttgataatattgggattccgttgctatttgatggagagcagccaccaaaaattcctctcttgagcaacgctccctccctccctccctctcgaatctgattcatcacaagaatatcaacaggcaacatcctacctccagaatgtttggggcccctaggtatttgactgaatagcacgggctcgcgtgtgtatgtcaccatgacagtactgcacttcaagatttcataagtttaatctttagttctaacattatcttttgtgcagataaggatggcagtagaagagcttgacgacaatgaatgacaaccatatggacatttttttagtagccaatgaatataggccagtgagccatggattttggtttgctccttttctcctttatgtgatgaggcaaggaacatgctaaaggggatattgtcaatgctgcataattatgttgtatgatgtttaccccnnanaaannnnnnnnnnnnnnnnnnnnnnn

SEQ ID NO: 56532 - DNA, 703 bp, Triticum aestivum
  unsure (1)..(703): unsure at all n locations
  Clone ID: PAT_TA_56532
ctaaaaatatatttatttaggaacggaggaagtaatatgtaacgaattttgcagaaacactacccggttcttttccgtggagtcaatggaactgttgcccatgaattcatcattgatctaagagggttcaaggcaactgccggtattgagcccgaggatgtggcgaagcgcttgatggactatggattccatggaccaaccatgtcatggcctgttccaggcacacttatgattgaacccactgagagtgaaagcaaggctgaactagacaggttctgtgatgcccttatctctatcagggaggaaattgcacaggtagaaaatggcaaagcagatgcgcacaacaatgtcctgaagggcgctcctcacccaccccaactcctgatgggtgacgcatggactaagccatactctagggagtatgctgcgttcccggcggcgtggcttcggggtgccaagttctggccaacgacatgtcgtgtggacaacgtgtacggngatcgcaacctgatctgcactctgcagcaggcatcccaggtggcggaggaagctgcagctgccaccgcgtaatcttctgatgatgacgatcctggtgtgtgaaacagtgtaaagaagntatcatgcttcctgtangaagggaagcatgcttgcttctaaatccctcatgtactgtatatattctcctcaaatgccaccttctcct

SEQ ID NO: 56533 - DNA, 728 bp, Triticum aestivum
  Clone ID: PAT_TA_56533
atggatcaagacgtggtcgtcgtgggggcctggatcatcaagtacgcaagcggcgtcgggggcggtgcaatgccagctgctggacatacttcaccctgggttggtgctgatgcacaaggtgaatttcgatgccaagacggagtacgacatgatccagaactacaggattctcctggatgtgttcaacaagttgcagataggcaaggtatgggtggtgattctcctggcttaggtctctacccgtggatttatccgtgattgtgtcttgcattttgtcatctgggaaagcaaatgtgatctgtctgtacagtagttcggtttatatatgcggtgtgtggggattcaatctagaacagttgtgtgtgattgatgtcagcatgtggtatagccacaaggtgatttgataactgactaaatttgttgtgcagtattgaagttatgctcattgctgtgtacagtactaaacttgtacaattcttgtcttgtttccacacaacattaagattagagtcgtgctttctgaatgttgagccgatttttatggcctgtgtgctagcaaactgagctaagggtgcttcatctttgtccttcagcttctattcttatgacaattaaatagaggatctattttgctccctgctctgattggtttcaaccgatatttatctcatccagcactctgagtatcaatgtgttggttttaatcctgatgatgacgtggtagtatg

SEQ ID NO: 56534 - DNA, 743 bp, Triticum aestivum
  Clone ID: PAT_TA_56534
cggacgcgtgggcagaaagtcagactaaggtgtcgagagtggagaaaaagaaacgtcagcagcgcagagagagtgagtcctccctagctggctcacgggactcgatcatcttaaggactgctgctcagatgctagcattttgtcaagctggtggggtaaaaaagaagcgaacggtccgagtccgcaggagttcgtatgttcctataatgaatattgagatgaatagggcacaagtactgccacggttatctcagtcatgcctggaggccctgtatgaaagtcctggttttaatttttttaccaagaaacgttcacgaagggtacgacgccattaccacagaccagatggattttttcagcctatagaaaacagaaaattctatcatgatgtttattctgaagcaacagaaaaaagctcacaaaactcacaatataagtcaactccatatatggatttccttcaaagagttgcctcagggctgaaatatcttgatttgaacaccgagcctgtgcatacgaatgagatgtatccatctctgactacatcagctgttgtcccttttggagcaacatgcagcctatcaaattctcttgtaccatttggtagtcagatgatctttccatatgagatgccattgcatttagtcaagaagcagcgccctcgagctaaagttgatttggattttgagacaacaagagtttgggacctcttgatggggaaagcaactgatgtgcctgttgat

SEQ ID NO: 56535 - DNA, 254 bp, Triticum aestivum
  Clone ID: PAT_TA_56535
gagcagcgggaaccgtgccgatgagacggtgtgcgctcggcccggaagggctgttgtagcacctgcactgccatctgggttcccctccaataggtgctgctagatcccatcatcctcacctgagcttgagttaagctagatggatgtaggtagctatctaactgtgttgttgttcttcttgttgcaagatggtagcgagtagcaccccatcatatgttgttgtactggtttctgaagtagatcaggggagggag

SEQ ID NO: 56536 - DNA, 403 bp, Triticum aestivum
  Clone ID: PAT_TA_56536
cgcctcgctctccctccagcagaaacagggggagttcgatctggatctgcagttgcggcggcttgcagaggcacccccaggctgctccgctgctgctccttggctgttggctcgcaccgggaagacgaagagaagaaaagaaagcccagcatggatcaaatggaagtggatcagcaaccgcaacaaccacaccatcaaagtgagaaacaaatattcgatagatgcatgagaaataaagccagagactttcgtgataaaagctatggtactcttattcagccctatgagtttacttgttctcaaaatggagtacttggagaaaaacatggttttatacattattcaaataaagcaatagcttttgctgggaatccggaagaaggatttgtttcaacagaagtgc

SEQ ID NO: 56537 - DNA, 165 bp, Triticum aestivum
  Clone ID: PAT_TA_56537
gtacgaacaacgatacgatgaagtccgcagaagataccatggctagtgctagccatcgtcctctccctctgcctctccctctcgttcgcgtggtgggatgccgaggacgtgggcggcggcaataacggtcctgcggcctatgaatacaaggacggccgtcgagtg

SEQ ID NO: 56538 - DNA, 132 bp, Triticum aestivum
  Clone ID: PAT_TA_56538
gcgtccgatcgtgtagcacaaagtattggaggtcgcgtactcctccggggcgacccgggcggaggccgccccctagcggggctcggctcgtccgtggcctgcacgctgcccatgctagcttggatgctgact

SEQ ID NO: 56539 - DNA, 99 bp, Triticum aestivum
  Clone ID: PAT_TA_56539
atcgcccagcttacctaggtagtaactattcctaactgctgtgccacgcgttcttgtttactttggtgatcaccagaggcaggcggccatgatgccggt

SEQ ID NO: 56540 - DNA, 285 bp, Triticum aestivum
  unsure (1)..(285): unsure at all n locations
  Clone ID: PAT_TA_56540
ggacgtagttgggantgttttgggatttgctgtgccagggtcgcgggggttaggacttcgtctctgggtgtgagttgcagggcggggataccggtggttgagctgtacgcgctgggagggatgattgggactgtttttgagagtgggtgatgctggnttgtggctgaggggaagggggtggggtggcgggtgatggcgatgtggtgctggtgggggtgcggggtctgggtgttggtgtgtggggttggggtgggggtggggtgtgttgggggggggggggggggg

SEQ ID NO: 56541 - DNA, 323 bp, Triticum aestivum
  Clone ID: PAT_TA_56541
gagacctgttcttgatgaggctcctgtctttcatcctactgaggaggaattcaaagacacccttaaatatattgagagcatacggccaacagcagaaccatatgggatttgccgtattgttccaccaccttcgtggaagccgccgtgccttcttaaagagaagagtacgtgggaaaactcaacattctctacacgggtacaaaaggttgacaagcttcaaaaccgtacatcatccaaaaagagcacaagaggtggaatgatgaagaagcggagaaagctttcagagccagaggaagacagttagagattggggtttggggctg

SEQ ID NO: 56542 - DNA, 335 bp, Triticum aestivum
  unsure (1)..(335): unsure at all n locations
  Clone ID: PAT_TA_56542
tcgactgcccctgcaggggtgcggggtgcggtatacctactttntatttaataaanaaataagnagtattgaggtctaaaaaaaatcctgataggggggaggagactaccatctgtttcattaggagtccacattattacatattagagattatttgtttcctgaaaatctattatttgttggctaatctactttgcgttattgagagagatttcgtagatttggctgccgcacgaacagaatctatttttcgttcgctaaagcacattgcattaatgggagagatccgcttgtttgtctaaggtaggaaggaaattattatttgtttgctaagg

SEQ ID NO: 56543 - DNA, 334 bp, Triticum aestivum
  unsure (1)..(334): unsure at all n locations
  Clone ID: PAT_TA_56543
caatgacctgtgactattcagactcacttgaaggacggcgtggtgaactcccattgttggtgatgaatgccagatttgattcatcagcttactgagcctgtcgtgttgttggattagtagagaaacgcttgttagaggattttgactttatccagtgcatgagtgaatgaaattgaacagtttcattcttgatttggagtgcatgaatggatcatcctgatttgcttgagttggcaaatgtgcgggcatcgcagaccaaataaaatcttctatgtttgtgccttttctattggcttattatgcattgcatgggtgtgttgngcgtgtgtgcggg

SEQ ID NO: 56544 - DNA, 291 bp, Triticum aestivum
  Clone ID: PAT_TA_56544
tatgaagttgcctagaaaatggactgtaaaatgtttttttatgtggaggcataaagattaattcactattttgttttcgtaaaacggttgtttactcgccaatttgtatagttaaatccatctattaaggatacatcattgaaaagtattattttttacttcactcaatcatttagtcgggtgataaagtgttgggagactacaaagttcatgctctattcacacatggtggaggcaacccaacaagttgttacggaaccagcagataaagagtcgaggaacccgcatcat

SEQ ID NO: 56545 - DNA, 696 bp, Triticum aestivum
  unsure (1)..(696): unsure at all n locations
  Clone ID: PAT_TA_56545
agacaggacaaggttgattcatggcaggagatcgccgggctctgtgtctggtcgccggcgcgatcctcctctgctcgtgcttttctcgggcgcagtgcggcgacgggcaggagcaggagcgggagattcagaggctcaggtccaaggtcgcgtccctagaggacgaggtcggctggaggaaggaggagacctcgcagctggagagcgtcgtcagggagaggacggcgcagatcgtggcgttggtcagcgggctagaggctatgcaggtgaggaatgtggctgacgatgaatccgtggtgaaggcgagcaccaacagtgcgatgatcgagaagcagattgagaggctgggcagtgatttggaagaccaagttaagaaaggggagctattggaagcccgggctagcgaagcagagaaaagcctgcttgagctcggtcagaagttggatcgtgttgagaagataaacgctgagcagaggaagaaaatcgaggagctggaacgagatcttcagcattcaaaaggtaaactgtctgaagtgcaaagacaagcaaaattgaaggctcaagagttggcaaatgtacatggcatgtggctaccgtaattggntcgcatcgcgctctgtacattgtcaggaactagcatctgccaaatggcatctccacgggaagcctgtgcttgatgctctgagggaaaagggt

SEQ ID NO: 56546 - DNA, 288 bp, Triticum aestivum
  Clone ID: PAT_TA_56546
aggcggcctacccggggaggtggacaacctcaccggcccttcggcgaccgtgtccctggggaaaccggccaagacggggacgggtgcctttgggctgctgcagaatatcgcgctggaggagcgggcggtgatgtaaactcggaccttcctttggcgtggctggtgctcatatcactcggttttggtccaagaatcggctgctgcgtgtccaggcatcagtcgtgtgttttgaacgaactagtcgtgtgaataacatttttgtgcttgcttgctacgggggaagcggtg

SEQ ID NO: 56547 - DNA, 443 bp, Triticum aestivum
  Clone ID: PAT_TA_56547
aaatgtacttggagctgtcatcaaatcctccatctaggattaagatcctacggattggtggatagaactggcatggcgagtttgttaacagctgcatggactggtgaggccgataggaggttttatgcttggctgcttagtagatttagttgggaagacatgagattcacgttccctgacggggaatatagatatttcagcccccgatccatcgttaggactttgggtctgaaaaacagtgggcgccaagtgagtgtggtaaaattacccgcaaaacataggcagaatttaaccctgcgcatcagaaccatactagggatcgagactagaagtcacgccagggacggtgggttaacaatcggagctgtgcatgatgccatcacgcgaatgatggcttcgggaattggcggctgccacccgggggcctgttgggatggcctgct

SEQ ID NO: 56548 - DNA, 288 bp, Triticum aestivum
  Clone ID: PAT_TA_56548
cggactcgtgggctcgagccggatggccgagagcgacagcgctgccatggacaagcccgatcacgatccgtgaccgaggcacaacacacagattttggacctccacagcctctgaaaaccccagatgatgagaagagaagagaaaaaggaaaaattccatggaagctctaggtaggaaccaaataagcaccctccatttccacccatccttttgtttgtgtgccctgtatttttggagtagccggccgtgctgtctttcggacgtgcgtgtgggctgggctctggggt

SEQ ID NO: 56549 - DNA, 212 bp, Triticum aestivum
  Clone ID: PAT_TA_56549
gtttttcgcgccccagtcccgcctggcgccggccacccaaccctgcgcccccggcttccagatctggccggcccgcccaagctggtccagctgctcagtgatccccttgcccgccacccatgggtctgcctcactacccggcgctcgctcagcaccgtttgcccggcgaggtgctgacgcgtggggatcctgatccggcgccgccctggggg

SEQ ID NO: 56550 - DNA, 368 bp, Triticum aestivum
  Clone ID: PAT_TA_56550
aagagctagtagagaaactacttctgaaagacacatcagaagagctagtagagaaactccggcaaaagagagattcagatgaatgcaatgaagatgtaatgaagattagccgcataaggaatgttacagtggaattgagccaaaaaggactttggaaaaggattaggtgatcatcgctattcacaagatcctgggctgtagcatgtcaagcacatgctgatcacttggatcataatctcaatgaaaatctgggctattccttggattgaagacatgtaaggcggtcagctgtgggtcgggttctggaaggcaaatatcagctgtgatgagtgttggtgctgggcgggtgggggtgcgtgggttgtggg

SEQ ID NO: 56551 - DNA, 151 bp, Triticum aestivum
  Clone ID: PAT_TA_56551
ggacaggccggcgaggccaaggacgggccgcggagggcaccaggagcgccggggagaatggttgtggatatgataagttttgctcgatattgtggttggcgcctggtcttttggagcgtgtgttggtgaacgttcaattggtgctgtggtt

SEQ ID NO: 56552 - DNA, 719 bp, Triticum aestivum
  unsure (1)..(719): unsure at all n locations
  Clone ID: PAT_TA_56552
cgaacctctcacccgctcctgcgctctattcctcagctcgccaaccactgaaccgcagcctcaacatcgaacgtcgctgtcctcgtctcagacgccgccgccgccgtcctcgtcccagccgtggtcgtcgccgtccaagtcacagccgccgccgtctccgtccaagtcccagccgccgccgtcgccgtcctcgtccaagccaccgccacggccgtcctcgtcccagtcgccttcgtcaccgtcccgccaccgcagctccatcgtcctccaaccgccgtccgttccccatcaagtcatctcatcctctgcctagtgtaggaagtggtgaggctcgcttggatccagcacagggcgtttccactctactggctggctattaactcagcttagatcttggatctgctagtggactttgggagtttgttagacagcttggtgactccacactttttcactatttcagcaagcctttggaacatgcatggcctcatctttgtgcttattggtgctcaaagacgttcaagtccttcaggaagggagggcaggaatcccgattcaagagtgaaggtgttgctcaaaatcggnggaggttcgcttccatttgtggaggctcgacaaattctggctgagaaatatggacctgagaaggctaccacgctgaatacatatgctgcaatgaaatctggactcaagaattgggatggcagtggtagcaccag

SEQ ID NO: 56553 - DNA, 619 bp, Triticum aestivum
  Clone ID: PAT_TA_56553
ggaaaatatagcaagagtaaaattaggcttgttgtttgagatggttcctttacacgataaataaattggagtgatttcaaactcttaaggcccttgaccggttagagaaagacgggttgaactgaattctggatatgtagtgttatctaatcttgtggtgcttttaactttgatcttgcaactgaacctgcagactacttatttttttggatgtgtaaacctgaatgttggaaagtaaatttgtcgccctgggttcagtggtattcaagtgcgacaggaccatattatgacagggtcataaacatgaaagcatgaaactaactgtgttccctgggtggttctatacattgagattagctaccttgagcatcactctttatttcggcgcaagaggaccatacagtgacatgaagttttatctttgctcctgggcatactgctactttgttgatatatctgaagccgtctgaacctggttcttttcaggcatatttttttatatttatcaatgcattgtacatagtgaaattgtccctaattattctctgttgtagtgcaatgttttttgtttagtttggatagacagtattatctttagtattaactatgttgcctgggt

SEQ ID NO: 56554 - DNA, 671 bp, Triticum aestivum
  unsure (1)..(671): unsure at all n locations
  Clone ID: PAT_TA_56554
aggagcttcaggatggctaaggggcaaggtgaaggctgtgacgtctggagactgccttctcatcatggggagcacgaaggcagagatcccgccagagaagtccatcaccctgtcgtaccttatggccccaaggctggctcgtcgtggtggagtggatgagccatttgcttgggaaagcagggagtatctgaggaaactctgcgtaggaaaggaggtcacatttagagtggattacacagctcctaacatcggacgagaatttggcactgtctaccttggcgacaagaacgttgcctacttggtggttgctgcaggatgggcaagggtgaaggagcaaggccccaaggggggtgaaccactcccaaatgtctctgagcttctaaggttggaggaagttgctaagcaacagggtttaggccgttggagcaaggaacctggtgctgctgaagattcgataagagatcttccaccatcagcaattggcgaactaagtggttttgatgcaaagggttntgcagttgcaaataaaggcaagagtctggaagccattgtcgaacaagttcgcgatggcagtaccattcgtgtttacttgcttccaagtttccaatttgtccagatatatgttgctggagtgcaggctccgtccatggggagacgaccaccgaatccta

SEQ ID NO: 56555 - DNA, 191 bp, Triticum aestivum
  Clone ID: PAT_TA_56555
aagagttccgagttcctcccctaccggccgccctcttatcattcctgccccggcgagagggaatcttgggaatctcctccagcaacccacctcacctcgactctttgaatccaccgcggtcctgccgcttgtatagaactaggttattccctttcgggcgctgcggggtgttgtgtttttttatgcgcccg

SEQ ID NO: 56556 - DNA, 293 bp, Triticum aestivum
  Clone ID: PAT_TA_56556
cggacgcgtgggctgacatgcccggaggcatggacgaggacgcgccggctgccagcggcggtgctggccccaagatcgaggaggtcgactaagttattctctttgatatagtgagaaaatacactatacgccatttgtttcagtcctgggtgccaatcatatcacctgggctggaagttttgttgtacttttggtctgtagcatcacgagacttgtgtgtaccgtaaacaatgcaatgatgcatgttttggctcattgttgatttcagcttaatgcttattgtttggactacc

SEQ ID NO: 56557 - DNA, 557 bp, Triticum aestivum
  unsure (1)..(557): unsure at all n locations
  Clone ID: PAT_TA_56557
gttggagctattgtacattcagtggtctgagcatcacaaaaagctgtccagtttcttaaggttatttttattcctggtccaaaagtatccatattgacaattaaattgagggaagatgcgtttctgattgtacgcaaatcttgatgtttgatgtctataggggtttccatatccactcattatactatatatgtttgtttcttgtttgattccatttgtatttgcaggacaaaagctgaaccagctatttattacatgccggctaaaccaatagttgatgatccggttattgctgagcaaaacaaggaaaaggtattttcttataagtcaatatttttttatgatccgccgaatcaaaacatacctgcatgatctgcacatgttcaacatatttggaagttgaaacacttaaattatgcacggaatgaaaatgtcagcaatagattcaatagtctttgctgctgtgctgttcgtgtctaccttttagattatctaccagtcaaccactagagtgcagcctctgtatgctttgtggngaatactaagcacatcaatga

SEQ ID NO: 56558 - DNA, 765 bp, Triticum aestivum
  unsure (1)..(765): unsure at all n locations
  Clone ID: PAT_TA_56558
gctcaggtgcgtgaccgcaggggaatcggaggcggcgagcagtagctggaggtacccgcgcgcccaaccggacggccccgggcttgcagcgcaaccccttcggtggagcctcatccctacgacgtcgggctccgagtacgaggtcaatgccgccggacgtcacgaccatgggtgcgtcgagtagcggcgtgcccgctgtgcgagggagaagttgcgccacgcaccgcgaaggctgagtcgcatgccatgaaggacaacagtgcggagggcaccgccctttgtgcccgcatcctggcaaagcgacaagcctggacggcgcgtgccctcgcactggagcaaacctgggtagtccgtgccctcgccggactgccccccaaagaggaagaggccggtgacgcatccgaagccccgacaatgagcggatccggctcccgtattgcttcttcgaccgttgcttccgtgacgaagatggcaagggcaagggaaggtcatccatacagtgggacccaaatatgctgtcaagtatcacacagctgcggaaaatgcacttagtcattgctaccggtcatgtttggaactactcattgagaacggccttgaaagcatcgcaatgggttgcatatacacggaagctaaaaactatcctcgtgaaccagctgcccatgtggcaataaggactgttagatgttttctggagaaacaganaggcaagatagctggtgttattttttgtattacatcatcatctgatacagagatatacaa

SEQ ID NO: 56559 - DNA, 155 bp, Triticum aestivum
  Clone ID: PAT_TA_56559
ggcgccaggagaccaacaggcggagccgtgtgagcttgtgatcttctgcttgtgctctggcttgctctgccaggaagtgccgacccgctgcggccatggtgaatttcgccatccttcgacggctgttgtctccccatttttgcacctcctggttt

SEQ ID NO: 56560 - DNA, 672 bp, Triticum aestivum
  Clone ID: PAT_TA_56560
cttaggccttctctaggaaggccaagcatggagaggtgaggaactctgaaatgcttgtcatgccggtgagctagaatcagggtgggcactaggaggatatatagtgtaattcatagatgacatatggatttcattgcctgtggataattggactgccgggtgtgtcctttctgtacctattggatatatttgttattctcctgtagtagaagcaataaaccatttagcgatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccctttaagggaaccaattttaccccccgggggcgcaaaaaaataactttttttaaagggccccctaaataaaattccggggccgggtttttaaaaccggggggggggaaaaccccggggggccccccatttaaggcctttgaaaaaaaacccctttttccccggtggggaaaaaaaaaaaaggcccccaccagacccctttcccaaaaatttgcccccctaatggggaaagggaccccccctttttaccctcctataagggggggggggggggg

SEQ ID NO: 56561 - DNA, 721 bp, Triticum aestivum
  unsure (1)..(721): unsure at all n locations
  Clone ID: PAT_TA_56561
cgctctccttgccattctctcccctcgcgatctcccgaaaccctaggagaaccccggggaggccgggatgctgcacgagctcctcctcgcccttctcggcttcaccggcgacttcgtgctcgacaactcctccggccgccgccgccccgagccggccgaagccggtggcgccggagacggcgacgtgggccccgccttccgcctggcgcccgacctcaccttcctccagccgtcagagaggagtgctattgaaaggctcatatctctgggattttattacagagaactgaatcgttttgcaaccgagtctcgtgatctgagttggattcagtcttctgttgaggtttcatcacctaatgctgatattactctgaagggcaaagtgagaaaagggagtgcataccggagggcaattgccaatggtattgctgagattttatcagtttataggtcagctgttctgcaggttgagcaaaacctgttgtcagatccattgcctatcctggcgacagtaacccatgggctaaataagtttgaggttcttctgcctccactttatgagcttgttatggaaatcgagcagaaagacatcaagggaggacagcttcttaacctgttacataaaagatgccattgtggngttccagaattgcaaagctgcattcagaggtattgcctcaattattcttatatatatggggcgtttgaagaaattaactga

SEQ ID NO: 56562 - DNA, 738 bp, Triticum aestivum
  Clone ID: PAT_TA_56562
caagctccgaatccctcccgtctctacccccaccgagctcgcaagttcttgcttggagcagccgagcccagctcagattccccgcggggtcccgcgagtattcgaggtcttggtgggaggccaagaaatggccgagggggaggagaccaaggtggagggaacgagagaggaagagagagcggatgcaggggcgggagcggaggaggaggaggtagaggtgaagttccggctcttcgacggctctgacatcggccccatccgctgcaacgctactgctaccaccgtcgccgcactcaaggaccgtgtcgttgccgactggcccaaaggtcctaaagattcaatctcttgagctcttgattctcgcacgatgtggtgcgattcttgtggtgtggtgtctctgtgcaagctctagtttgtgcctgtgccatctgcaccagtaaatttgtaaaggaacccaggcttgtctgttccctctgcgtgacgacagtagactggaataaggggtgatgagcaagcttcatgcttctttatatttgcttgtttggtgcctgcaagatttgttgcttgtctgattttgggaaaataggtgtgcttctataactagcaagtgctaggtctcgttaatattctaaagtacggcttaaattagagaggtatcagatgtgtataggagatgtcttcttttacggtattaatccaggatggtctttggtgtctaagcgaacaggggaggagccg

SEQ ID NO: 56563 - DNA, 732 bp, Triticum aestivum
  unsure (1)..(732): unsure at all n locations
  Clone ID: PAT_TA_56563
cccctcctccccccatctcctcgttgccgccatcgacggcgctcccctcgatccctcccaccgccgtctccctcccttagatcgagctccccatcccctctccctcccacctctcgaagctcccgcgtcccaccgccgcgcatcgtgctcctctgcagcttctgcggcgacgcagccgccgctgactactctccttcctccttcctccagcactactctccaacctcgcctctcgcttagccgccccgcgccccgcgctcgccggggccccgtagcgccgctcagtccctcacgctcaggcccaacgaggtcgcgcacgcgctcaccggcacacccgtcttcaccgtctgcaactccaggaacgcgttcgtgttcgtctccgctccctcggcctcctctgcttccgttccgaggacgccgatgccctcctcttcgtccgaggtcgtcggaaccacgacgaccggcgcgcccgtgcgtgaggagatgacgacgaccccgacaagccattcagggccagcaagaaggccaccgccccagcaccaccagcagcagtaccctcaagggacgagaccaccggcgcccaccaggatctccgccgctgcatcttggtaacgatcacgtgagaaagcaccgcaggtgggcggctgcatctgaggctgaggaatttggttcggggtgagcggnggatggcttgatcctagaaaggatctgatgcgctactgcagacatacg

SEQ ID NO: 56564 - DNA, 372 bp, Triticum aestivum
  Clone ID: PAT_TA_56564
cttctacatcacgcgggggccaccgtcgatctcgcatcacggagaacacgtgatggacactggatccggagctgccatgagccgctcgcaggcgagggaaagagggtcgagcagagcaccggccatggcccccgcgtgatgtagaaggccaccgtcgatctcgcatcacggagaacacgtgatggacactggatccggagctgccatgagccgctcgcaggcgagggaaagagggtcgagcagatgctggagctgcagcctccgttcctccaggcgacggggacgcggagcagctgcggcggcgggccgcgctcctcccgttgaggaccgagagggcggggaggaggagacgatgcgacggcgcggcagcga

SEQ ID NO: 56565 - DNA, 665 bp, Triticum aestivum
  Clone ID: PAT_TA_56565
agccatttagcattatagatgaaatactgtaaacctttctttgttggaggggcgatgtgtagctcactggctctgtatattaactaatatcgctgtagtcatcatgcatatatttgagactgatgagcatgaacatgttgccaacctttccccatcaatttgagctttaggtgaactggttggtccctgcaactcaataaggtatcagagtcatgatttctgaagtttgagacctggttatcacaattaaaaaaaatgcaagttttcatacctcttttgatcacggggtatttgcttggaggccaaagttcgtcacaacttgcctaagaaagttaggcaggctagacatggtgtttggttcactaccacaactattgctagtcacacatctaattggccacatttgtcagactctttttttttgctaagggcatatttagcctcacttgtgattccatttttttggcccacaagttacggaagttagccaaaaagttctgcatgcttaggacatatttagttcacaggtacacattgccttaggtgtggcagctgcttgtttcattttgccgcagatgtggcacaccacgctttttcagcagcctgttaggctcatcttttccaaacttgccaaagctgtggtgaccaaccttttggagaatgcc

SEQ ID NO: 56566 - DNA, 598 bp, Triticum aestivum
  Clone ID: PAT_TA_56566
tatccacttcggccagtccggttttattaggggtagaggcattgcggataatttcctccatgccgcggatgtcgttcaaacttgcttcaagaggaaaacacccactatcgttcttaaacttgactttacaaagccttttgactccatcccctgggacgccttgactactattttgcgtgccaaaggcttccccttgcaatgggacaactggatcagatctctgaatgaatctaccaactccgctattttgcttaacggacgccccggcccgtggttcccctgccgttgtggtctgcgacaaggggactccctctccccctacctctttctgattgtcgccgacgttcttcagcgtatgatcttacatgcttctcaatctggcatgctctcgcaccccctagacgataacctcccttgcccggtgctgcagtacgccgacgacacgctgattgtgctgctggcggacgctgcgcagctgcatcatctgaagcaggttgttatgcaattctccgcgggcactgggctctcgattaattggcacaaaagaacggtggctgcaatccatgttgactcggacacctgccattatgttgctacg

SEQ ID NO: 56567 - DNA, 489 bp, Triticum aestivum
  Clone ID: PAT_TA_56567
ggtggtcccccaatgggtggtccatcaccaatccttaatgctccacttcctataatgcatgatccacgtatgcaagatccacgcatgcaagatccccgtaaaatacgaagctatcaagatctcgacgctcctggagatgaagtgaccgttttggactaccggagcctgtaggcgtgtgctgtatgaccttttaatctttgaagccttggacgatacaaccaccgcaacgggaccttgctcatctccattagttttgaccgtggcggaggaacacggctgcggtgctccgtcccgtgagctatgttatactgattggtgcttctaaaaccgaaccacatgaaatcaaagcaactggcgcactgaaagcacggttgtggagtgtgtatttccaacagaaatttttagcttttcaaaatttccaccatctagagagagacagagtagaggtctgtgctgccgtatccagaaatccagaccagatattcctca

SEQ ID NO: 56568 - DNA, 734 bp, Triticum aestivum
  unsure (1)..(734): unsure at all n locations
  Clone ID: PAT_TA_56568
ctgaatttcgaaaatagtttacatgaattctgcaagttcagtagattttgtctatggatttcttttcctagcattagcttttacatgtttatttggtttgtacgcaagcactctagagccatggatgcaagacaataaatttgtgcctggtattccaatatgagtcgtttagagaagtgaaaatgaagactcttaattgcaaaccagtaacataacaagaagaaaattttattgatcccaaatgacatatgatgggtgttattaggataatggatctgctctcagtttctatgagttcatttcattgtgcaagattttccagtactataaatttttagatatagcattgccaatcgtcctatcgcttgtgaacattccaggcagcaccaatattaatgtgcttgaaaaacctcggacagtgaagactgaagaaaactgggggtgcaagggcacatcctgtattcttgatataatggnnaggaagtatgtaaantaagatttttcatagtggcactaacaaagcttcttttttgtagatttttctatttactctgtagttcaaagctggtgcttttgtgaatttaatttgagagtatttgttggntatgtaactgaatttggacctcacaatcagctattaattttctctggaaattttgatagagaagattaatattccaaacgtattcacatggaggtttttatgctcttcatagttctgcagctatctcttc

SEQ ID NO: 56569 - DNA, 311 bp, Triticum aestivum
  Clone ID: PAT_TA_56569
cggacgcgtgggcaccggacaagcagaattgttggttgtagtgcagttcatgtcagaatttgtgcttcttctgctggtacggcgcatgtatagtcagtgaacaaaccaagttaaggcacacttggaccgggcacggcatggcaggaagctgtccaaaccctcaagtttgtacttaactgaatctgaagatatatacgctgtaatgaacaagcacgtattatcatccttttccgtttgaactgtatcaaaagaaagcccttgtgatgtatacaagacacgatggattagcaaatgcacgatcgttccttgct

SEQ ID NO: 56570 - DNA, 768 bp, Triticum aestivum
  Clone ID: PAT_TA_56570
gcggatatgagcgagaggaggaagagagggcgaggagggagaatgaaaggaagcagagggaggaagagcagaggaaacgagaggaagatgatatgggagaggagagaggataaggaaaggaagcagagggaggaggaagagagggcgaggagagagaagtataggaaggagagggaggaggaagaagcagcgaggagggcgactggggagactccacctattaccgcgcgtcctataacctgtagaagcgctaccgtggtcgtaagggcgccgtgttctatatctgttgatcggttgtcttttcttacttgctgtctcctttttttttttttttttttctttttttttttttttttcgttttcttttttgcgtttttttgttttttttttttccttttctttttcttttttttttttttcttttttttttttttttttttttttttttttcttgtttttttgttttttttttgctttttttttgtttttttttttctttttttttttttttttttttttttctttttttgttctttttgtcttttttttttttttttttttttcttttttgtttttccttttttttttttttttttttttttttttttttttcttttttttctttttttgtttttttttttttttttttttgttctttttttttttttttttttgtgtttctcttttttttttttcttttttctttctttttttctctttttttttttctctttttttttttttttgttttttctgtttttttttttt

SEQ ID NO: 56571 - DNA, 205 bp, Triticum aestivum
  Clone ID: PAT_TA_56571
gatggggcacgaggacatggacgcggaggagaccctgcaggcgctccgcgacatcaagtcccgcacgggcgccggtgagcccaaggtgcttgtggttgacctcgtttactagttgatctgtctgtatttgttttttttttttgttgtgtttttttttttttttctgtttttttttttttgtcttttttttctttttgtctttttt

SEQ ID NO: 56572 - DNA, 504 bp, Triticum aestivum
  unsure (1)..(504): unsure at all n locations
  Clone ID: PAT_TA_56572
ggcgaggggggcgtgaggaggagagggccgtgggcgtggccggcacggtcagggagagcgtgaggaggagcatgggccgtggccttgacctgatggntcagngtgctcgtcgtcggtggcgctgtcaaggacgcacccagcgcggtctctgaggagactgctgttgttcctgttgtccccgcggcgccatatgtatggtgatttttgaggtnggcactcctgccttcatattctatgttgttgtagttgccctcttttgctgtgtctgtcttgttgttggtgtttttgtctttggnattgctgtgtgctgtgtttgctgttgtggccctcttctttcttttcatttttgtttttgtctttttgtcgttcttccgcgcgttttctcgtgttttttcttcttttttttctttttttttttttctttttctcttcttttttggtctgttcgcttttgcggtttgctgtttttttttcctccttctttttttcgtttttgtttttttt

SEQ ID NO: 56573 - DNA, 218 bp, Triticum aestivum
  unsure (1)..(218): unsure at all n locations
  Clone ID: PAT_TA_56573
ccattagcgcttgcggcgttgcctcgtggggctggcacattacgtgcccgttgctatcaaggccgactaccggcgccgtgtcccgtccctcgtgtggcttcgaatcgctggattaagagtgcttgcgtgctagtacccgacctacgggaagtggtgcttcggntnnttgttgcgtcgtgctggcgggcgtgggctgggtgtggatcggctgtcctcgc

SEQ ID NO: 56574 - DNA, 307 bp, Triticum aestivum
  unsure (1)..(307): unsure at all n locations
  Clone ID: PAT_TA_56574
cccncgcaaccaccccgcccgcggtttgtgtctctcaatctccaaaggtgaggagagtacctcactttcatgtgtgtaaggagatactcacacccacctgtgctcttataacgctcgattaatgcactgtggcttggctattttgttctcttcgccacacaggctgaagcacttatatgcagcaccggtgagggcgtcttgttatagtatcgagtctctgctgcgcatcctttccctcttattatgcacgctccctggtacggggggtggggttgggccttttctgcgtgcgcgtctcggcgagacg

SEQ ID NO: 56575 - DNA, 532 bp, Triticum aestivum
  Clone ID: PAT_TA_56575
gaagatttgactcctaatgtgggacaatgccagcctttggccatgacttctgaatacaaattatggtgtcaagagcaagttcttcagaagagttgactcctaatgtgggacaatgccagcctttggccatgacttctgaatcagatttaccaagtatggttccaagagaaagtgcttcagaagatttgactcctaatgtgggacaatgccagcaagaggttttgggaaacactgaacataagtcaattaaaagtgcagaggaagttcaggctgcagaagacatattgcccgagagtccacatgatcccctaatggcacaaaaactctatgcccctgaaaacaaattgagcgagccaaatttgaagcatcaagattcttttgatcagttgcctactcttgggaatctttccagaactttagttattccagagcagacttccatctggcaaggtatctttgagggttgcagaactgggatctgttgcggactgtttggtggggattggggccccgcttgggggccctgggcctg

SEQ ID NO: 56576 - DNA, 136 bp, Triticum aestivum
  Clone ID: PAT_TA_56576
ggcttttaccttgctcaatcctgtacctgtgctgttcttatccctgactaccaaggtggctggcccccgtgggacagatagacgattctgaatcttcgctgccggccctgcgcggttcgctcgctgctatctcagc

SEQ ID NO: 56577 - DNA, 604 bp, Triticum aestivum
  Clone ID: PAT_TA_56577
gcggcacaagccaagctcaggcaagcgggcggcacctcagctagccaacagcaaccgacagatggcttcctccggctacctcagagcggccagcggcgccactcgcagccgccacacgctcctcctccggcagcgccccgctgctccggccacaagcgcggcaccgcgcgcgctcgtcgcttcctcagcgacgcggcacgcgtcggcagtccccaacccgccgcccggggcggagcctttgccggaggacgcgccgcggcagacgccgccgaggctcggggaggaggaccccgtgggacctcccacgccgacgcccaaggagaagataaccggcacaccgccgtcggaggaggacgacggtgggctacccggcggagtgccggacacgaccccgccgccggaggtgccgctgccccctgtgtcgcccgatggtagcaccgtctagctcgcgtggtccgtctgtgcgtgcttgctgcgtggcttttgcatacggtgtcagtgtgtacatacatattgcagtggagtacgttctacctttttcactacggagcaccgggtgtactgttgtattctctcgagtcacgaacatgcagctgttggtgcg

SEQ ID NO: 56578 - DNA, 243 bp, Triticum aestivum
  Clone ID: PAT_TA_56578
ggcgcgatccgaaggcgagctgaagcaatggagcggctgcagagaatcttcatcggcgccaccaggatgaggcgggtgtggctcgcccgcaggatcaattgtgatcgtcaagctggatgatcccgtccagcagctcgccttcggcccgcccgcgagggagcttcatgaggtgtttcgcgccaaggatcagccggacgaggtgcttcttcgccgggcccgagctgctgcttgagcatgatctct

SEQ ID NO: 56579 - DNA, 222 bp, Triticum aestivum
  Clone ID: PAT_TA_56579
cgcccgttgggtagggagcttcgaggcggccgaccgtggaacttcggacggaccgagttaagctatgggttggcttcttgtccccttgtttcgcctgggagaatccgacaagtctcttccttcctgaggagagggcaggaggtggatgaggcactagcggccgcgcctacctatgtatctacgccgccggaatggactcggagcactggatctctcgcctgg

SEQ ID NO: 56580 - DNA, 254 bp, Triticum aestivum
  Clone ID: PAT_TA_56580
gcaaaggattagcccaccgcccgttggaggggccgtgccgtttggatggacctgccggctgttgcgcttcggccagctgcgagatggggcggctcttggatggcgggcgactgtcttcttcgtctggcggaggcccccctgcgtgcttctcggcggtcttgcttgcgtcgcctggcctggacccactgaccggctttgttcaccgtcggctctgtctggcgatctgccctctcctgatggtctggcctgtcttg

SEQ ID NO: 56581 - DNA, 464 bp, Triticum aestivum
  Clone ID: PAT_TA_56581
gggagcagcaggcggcgattctggtggtggaaacattgggtgtcctcggccagtgctggttgtcctcgctggcaacctcgccggctccaacccgtccgtagacactaaaagggtgcaggtcgagatgatggtgctgagcacggatgggaatggcgagatgcggatgtgcgtgctgcagcccagcaatttttcaggccaggcaattcaagcttggtgaggttcgttgctggatacgcaatgtctcaattgggcaaggatttggcaatgaaatctgatgatagtgttgtatctcatgctgcacatttgatggttggcatgctaactgggagtctagctcacgtaacatccaatgagtgatcagaatgaaggtgagggggttgcagaggaggaaataagaggagtacaaaattaaggtgacgaatgcaaggatctgtaccggaggggtgggcgtggggcccgtgtgt

SEQ ID NO: 56582 - DNA, 242 bp, Triticum aestivum
  Clone ID: PAT_TA_56582
ggtgagaatatgaggcgtcggaggagcagatacgggagctgagcaggtcgtgctccaggggaggacgcggcgcggggcgggtcggatgcgcagccggaggtccatcagagcgcatgggccccctcatcgtctacggcaccgtcggctccaacatcgtccaggccttccgcaacctgcctggtgtggatgttgccaacgtggcttgcctgcccttgctcgaacttgcccctggtggccacctt

SEQ ID NO: 56583 - DNA, 194 bp, Triticum aestivum
  Clone ID: PAT_TA_56583
ggaccaggaccttgctcctgctctgatacgttggatctatttgatctcctcgcctaccccgaggggctgctccccatgggaatgattgctgattcagagatttcactggcattcctgatcggactgcacagggcaatatcagtggacacaatagcaataacccgatcagcagcctcatggaggaggagggcaac

SEQ ID NO: 56584 - DNA, 166 bp, Triticum aestivum
  Clone ID: PAT_TA_56584
acacaccgcgccaagggaagggaccacgcgcgctccgctacgtacgtgcgtgcgacaaccgtacatgttcaccgaggcgctggtgggcgcaagcgcccctatcgtgggtcgggtcgttcggagggcgcatgcgaactatgctaccttgtattctgacttagaggcg

SEQ ID NO: 56585 - DNA, 243 bp, Triticum aestivum
  Clone ID: PAT_TA_56585
ggttgcagccccagctcgcgactcacgggacaacacctcaccataagcagctgttgggacagggatgagattgtgttcaatagcatggacttgtcacggctacggtctttgacagtgtttgggaagtgggtgccattcctcgtctcggacaagatgaaggtgcttcgggtgcttgatctagagggtactagtaggacatcagatggtactgttagtgtaacagatgatgtgctggacaatatc

SEQ ID NO: 56586 - DNA, 123 bp, Triticum aestivum
  Clone ID: PAT_TA_56586
cgactctgactaatctggataggcactgatcaggatgagacccgagcagctgtgatgctcagatatctgaggcgtcaggtgaacggataccctaccttatcagctctctactctagtggagta

SEQ ID NO: 56587 - DNA, 434 bp, Triticum aestivum
  unsure (1)..(434): unsure at all n locations
  Clone ID: PAT_TA_56587
caagttcacctgtgaaaagaagacaagccagcaaaggatgaaatgacgctgcaatatctgcaaaacatgtttgtggcagcagacaggttcgatctccagcggctcaagttcatctgtgaaaagcgcttgtctgaacacataggtgtgagctcggtgatgtacactcttgctctagccgagcagcaccaatgccagggattgaaggaggcgtgcttgaagtttatgcaagtccagtccccctcgtgcttgcaacaagtaatggcaactaatgggtgggatcatgtagtttcgacctatccctcggttttgaaggagatcattgccaagattgctttgaaccggtgcaagtagtaacactacgtatctggtatgcatcttccttagacctggagtggcgctcttatgcatatatgggatcctaganagatgggggg

SEQ ID NO: 56588 - DNA, 778 bp, Triticum aestivum
  Clone ID: PAT_TA_56588
cctccacccccctccttcagttgcatcaccatgctaaaaggaaaaacagcatagccaaaagcttctacgatcagaaaaccacaaccaggagcaacaggaatgggttcctttgctaatggccagaatggttcggagcttggcatccagatgccggccatggggagcagcgcggtgccggagcctcccacaacatctgtagcagcaagatgtccacggctggacatggccatggtggccaccagagctgcagccctcgtgatggcgctgctctcaatgtcgctcatggtctccgccaagcaacggggtagtctcatcatctttggcatcgagattccactgtatgccaaatggtccctctctgattcgctgaaatccttggttgggctatctgcggcagcagctgcctactctctggcacaacttctgtcgattgcgtacaaggccttgaagaaagtccctgtggttccatccaggcgctatgcctggatgctgttagctggtgatcaggtatgttatgatcattttgatctgattatgcattttctggtaattaccattgttatttgtgctccgacgattagattttatttttttagtcatgttgtttcatactttatttccctgtttgtgatgtctgcataaaagtgacagtttcctctatgttatgtaatactcttatgtattttatgggcgggtcagtagccagtactagtataggcggttggttgagttagttctaagttacgactgaagaaatctcatgctagcaactgtcatc

SEQ ID NO: 56589 - DNA, 212 bp, Triticum aestivum
  Clone ID: PAT_TA_56589
gcgcgctggtacggcgagttcatcgccaagaccaagcccgacatgctcaacgtggtgacccaccacatctacaacctaggggcaggggtggacagggacacacagctgatggacaggatcctcaacccgaaggcgctcgacggcatggcgggcccgttcagggatctccaggggctgctgaaagccgcggggacgtcggccggcgcctgggt

SEQ ID NO: 56590 - DNA, 152 bp, Triticum aestivum
  Clone ID: PAT_TA_56590
gcttttttcctcacatcatatagtacaacagagatagattctgtaccagtgccttgtcctcgactgtctgtacctgcaccgtcctgaagcactgtctcgtggcattgttggtggttgaagcaagcaataaagcccgtgccgtcgttactggt

SEQ ID NO: 56591 - DNA, 418 bp, Triticum aestivum
  unsure (1)..(418): unsure at all n locations
  Clone ID: PAT_TA_56591
gcaccgacgggagcacgtaagccacgtcgggagacgaccacactctcgcactcagtagtaacaacggattcggaagaactgctgcgcgggtgctgtcatccggccttaatttcaaggagtacattatatggcagccagaggattaggtgtctagaatggacagcaccaaccgttcctagggaccatggtaaatgcaaaagtcatgcttcgagctttggtctgtgcatctacatgaagaaagcatgtcttggctaaaggtaaaattgaaacttgtaggtgatcaaatcatatgctttggtctgtataagagtgtaaattaaggattacaaatttcttggcactagattttgaccttgcctgaagttcagattttttgaagntgatatatatcttctgtngatcttttatttttcctttg

SEQ ID NO: 56592 - DNA, 419 bp, Triticum aestivum
  Clone ID: PAT_TA_56592
gggcaaaaacccaaaaggaacataaagagggatcaaacaagcagagggggacagggctttaaaaaaaaacaccacccgacggcgcctgatttagggacaaccctaggggagctgcccgggaaagcacaccccaaaggacaaaaaccttaggattatccatcggtggaaaaaccagccaacaaaaataaagcatcacgggttttattccaaccgagggccggggcagggctaaggcttgaaacttcgaaacaaaccccaaaggtttggccaggggccgaccgaaaaaccataactgggaaaggaacttccgggtgacggactcgtaactggggacggggaaaaaatccccccatgaggccaatggaaggggggaaaaaataattttctgggcaaccgaaaaaaagtcgttcagggggggc

SEQ ID NO: 56593 - DNA, 324 bp, Triticum aestivum
  Clone ID: PAT_TA_56593
ggcaacgccaggtacgtggccgacgtctggagggtgggcgtggaggtcgacggctcgcaccggctggagagagggaggatcaaggccgccattgagaggatgatggagagcggagaggggcgggagatcagggagaggatgaaggggctgaagatggccgcggaggatggcatcaacgagcgtgggtcgtcccacacgcatctcagtgatttggttgctctcatcaactcgttctgaatttgaattccatatatctatctgataatgttgccaccttatatcgatttggtttctctcgtgtggaataaaggaaacctgttttcc

SEQ ID NO: 56594 - DNA, 366 bp, Triticum aestivum
  Clone ID: PAT_TA_56594
ttccggacgtctacacgctccagcaggcgctggacgtcgccccgccgcctcgtcttaacacgacagaagaccgtgcggagcacgttgagcggcagcgccacctcctcgtcgcccaggaggacgagcgggtcatgggggagtggcgccggcgccacccggaggacgtcgcctactgggcaaggcgctgcgaggaggacacgcgaaggcgccacgattcgcggttggacaggcgtcggcggaaggcattggcgaatgcgcagtcggatatcgttgcagcaggtgggaggtcgttcttcacggaaaacgatgatcgttggttggacatatggctcgatacctcggacgacaccgacgaggatgatgatg

SEQ ID NO: 56595 - DNA, 666 bp, Triticum aestivum
  Clone ID: PAT_TA_56595
caagatggctgacaaggctaaggagagagtatttgaagacaggcttccacacaataagacttgaagaggtgccatgtcaaaattttgaagagctaaataatcagagagttctaattacctttaattactttgagaaaagcatcatcgatgttcttgtcacgcgcaaagaaaattttcacacaattggctcagtttggcatggtgtggtttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaatagaagtaaaaaaaaaaaaaaaaaataaaaaaaaggggggggcccttttaaagggaaaaattttgaagtccccggacttaaccgttttgtttttttttttggggcccccaatttccagaacgggggcgggtttttaaaaggggggggttggaaaaacccggggggccccccactttatttggttgtgaaaaatacccctttttttaaggggggggaaaagggaaagggtccccccgaatccccctttcaaaaggttgccgccctcgtaaggggaaaagggccccccctttgtgggggtcttaaacgggggggggggggtggggtcccccc

SEQ ID NO: 56596 - DNA, 384 bp, Triticum aestivum
  Clone ID: PAT_TA_56596
ggaggtggtgcggttacatcactcatttaatgcttctcacagggggaagcgctagtactggtggattgagacaggagccacagctaactgcatgtagcacatttgatgtgtatgcgaaaccattttcgctatgatacatttgtggtattctccactgccttctgtgattctatcatgagtccgggtttaaactatcatgtacagctagttgaaatggcttctccatatatagagctaactttgtattatttgatgctcatattcgaattaaagtgtttgccccctttgaaaaaaaaaaaaaaaaaaaaaaaagacgaacgaatctaaaggatccaagactacaaaacaaaaacatgcaacaaaaatagctcttatataaagaaa

SEQ ID NO: 56597 - DNA, 795 bp, Triticum aestivum
  unsure (1)..(795): unsure at all n locations
  Clone ID: PAT_TA_56597
cgaggagttcggcagcgccgccctgcaaatcgaccagtttcaggtcgtcaggaaggtcatcgttggtaagaaggctgatttcgacgggttcctctccaacctggggttcgccaggctgggggcgccggcggcgagcttcgccgatgactcccaggcctcggcgccaccggctgctggccaggacggtgtaatcggggagagggaaggggctgacagtggtggtgatgctgcacagccaccgcagaagtttgccggccggttgctcaacatcccattgtcgaatgtggagcggctgcggtcaactctgtccacggtttcactgacggagctgattgagtcggttccacagctggttggcagattgtcgacttcagtggatagccatccagacaagaagaagcttttctccgtgcaagacttcttccggtatgcagaaatcgaagggaagcgattctttgaggaattggatagagatggtgatggccaagtcaccctagaagatcttgaagttgctatgagaaagaggcgattgccgcggaggtacgctcgggatttgttacggcgtaccagaagtaacaggttttcaaagtcgattgggtggaaacaatttctgtccttgatggagcagaaggaggcaacaatactccgggcatacaccacattgtgtttgagcaagtctgggacgcttcacaagaatcagattgttgaatcgttaaagggtgcaggcctnccgccaatgaagatatgctgctgccatgctgcgctatctaatgcagatcagaaagatcaatctct

SEQ ID NO: 56598 - DNA, 663 bp, Triticum aestivum
  Clone ID: PAT_TA_56598
ggagaaaatcgatgtccggatgaacggcgagccgaggtgcgctccgtcgccggaaggacacgctttctcggctgatgtcggcggcggtatgacgatcaagacacctttctctgtgtcgttgagcgtaccggcctcgccgtcgagtgacgcgaagcccgatgtccaccaccccgccgtgccgctgaagcaggctcgtcaacagtcgctgccgtccccgacagtaagaggcagcgccgccgaggtgccggccattcggcggagcgacaccgcgcggaagcgggaccggcgattcgaccgcttgaggaccttctccggccgcctcgaccgccagctctccaccctccgcggcctgtcgcaggaactgccggctgctgacctcgagcgcggcagcgccaagatctccgaggaggacaccgacgaggatcacgacgtccccaccgccggccgctacttcgacgccctcgaaggcgccgagctcgacacccttcgctcgacagaggtggcggtgctgcccaaggacgagctgtggcctttcttgcttcggttccccatcagcgcgttcgggatgtgcctcggcgtcagtagccaggcgatgctatggaagacgctcgagtcagagccctccatggcgttccttcgcgtgcgccccgccgccaaccatgc

SEQ ID NO: 56599 - DNA, 716 bp, Triticum aestivum
  unsure (1)..(716): unsure at all n locations
  Clone ID: PAT_TA_56599
ctctccttcctcccgccgtcgtcgcgtcgcgccggctccacctccacgcacccaccaccattagagactccactcgccgccaactagtgctgctacgtacgtacgacgtactgccaccggtcgcaatccccgctcggaattccccaccaccaccaccgccaccgcgagcgcgagcggaaagcggcacctttcctcccttttcgcttatctttcgccccgctccttccgtttctcgctcaagccgctgccgcactaggactggtgctgcagtagtacgtaccactgtaacaaggaagcaaagcgggtgagccagcggccaaggcggccggcttctgatgtcgtcgtcgccgcccgccgcgccgggcccggcctcgccgcctgggaatcgaacggcaccgccaccggcctcggcgccacccgctaccaactcgacgcccccttcgccgccggcgccaccggcctccgcgccgccgccctcctctcccgtgccaccgccgtcgacgcccgccgcgccgcccccgtcctccggcaccacccccgcgacaccctccctcccgcctcccacggnccccggggcgcccgccgcgccgtctcccccgtcgaccacgccgtctccgccgaccgatcgttcgacgccgtccgcccaggcctcgccgccgccgncgagctcggcgctcaacacggccacggtggctgggatcgcggtgggcggcctg

SEQ ID NO: 56600 - DNA, 785 bp, Triticum aestivum
  Clone ID: PAT_TA_56600
cttgcaatgggcatgtcagggacagaagttgctaaagaaagctctgacattataatcttggatgatgacttcacatctgttgtgaaggttgttcgctggggacgctctgtctatgcaaatattcagaaattcatccagttccagcttactgttaatgttgccgcacttgtgattaatgttattgcagctgtgtcatctggtgatgtgcctctaaatgctgttgagcttctctgggtaaaccttatcatggatacactgggagctcttgctttagcaactgaaccaccaacagacaaccttatgaagagacagcctgttggtcgaagggagccacttgtgaccaatattatgtggagaaacttgtttgtccaggccatttaccaaatagcaatccttcttatctttaatttctctggaaaaaagattctacggctgcagaatgaaagtccagataacgccgagaaaatgaagaacacatttatcttcaatacatttgtattttgccaggttggttggatattttctgattctacaactgtaacagggtgttacttaaattctacgttgttctttagatagactaatattggtatttgatttatctaataaatgttcatgttaagggtagtatagtgggcagtggttgccatcttaaataaactgacctaccatgtaaactcaagttactccttataatagtgtaaactgcactctgtaaatattagacttgctgtggagctgacaccatgaatagtgactggctagcttgtatctgacctaacatg

SEQ ID NO: 56601 - DNA, 529 bp, Triticum aestivum
  Clone ID: PAT_TA_56601
gttctagatcgcgagcgccgccctttttttttgttttttttttttgtttttttttggagccattgggaacttacttggtcggcacttaccaactggggagccaacatgctgagaagcagggcacgtttttttttcttttatttttacataaaagaacagggccagtggattgcagaactaacgccaaaagaacctactctggctgcatttgcttcacaggtcctctgaataaaccaacagaccagggggctggaaaaatggaattgggaacaggctctccacgtatatctgagtccaacgatgttattcacaggctcaggcgaaacaaccgagccttttcacccgttgaaccagggacctcccccaacttccaccgctggcatgttggttgccgagcaaagcataaatttccctttgctcccttggatttgttttacacattggcaggtcggaatctccataacaggcgcctttgcatgctggtaccaatccaccctgcattgttggggctcgcaaaggatgccccggg

SEQ ID NO: 56602 - DNA, 749 bp, Triticum aestivum
  unsure (1)..(749): unsure at all n locations
  Clone ID: PAT_TA_56602
cttctctatttcacccgtttactcacatctccctctatctctcttgctttctattacagggaggccgccatggacgcctaggtcctccactccaagcctccgacccacaccccggcggccctgccgacgtcgacgcctaggaagaccaccatgctcgctgcaggagcttcgagccgaccccgcagcatgtagacctccgccgcccgtccgtcgtggggaatcaccagatccggccggtatccgacctgcctcgccatccttcgcccgttcccggcgtatccccgacgccaggagctcaggcgagcgccgccacaagactctgcctcctctgctccggagcccgccatggaggcaaaaaggcggaatggacggttcgtcgacttgtgacggcgactggttttactggagcggaggcgcatttccttttcgtcctcttcgctcgtgggaaggcgcagcaggtcggaggaggaagccgtgagaagttggcgagagaggagatggggaagggcggcgagctgtgggacgactcggcgctggtggacgccttcgaccacgctgtcgccacctacaaggcaatgcatggcaagaacaaccaagctgctccatctgagaaaccagagtcagaagatgtagctgctgctgccgcttctgctgccgcgtacgctgccgctgctgttgcagaagaacctgtctctactgaagtggcagatgagcanacagagaaaaatgacagctgcactaacttaccc

SEQ ID NO: 56603 - DNA, 257 bp, Triticum aestivum
  Clone ID: PAT_TA_56603
cagccaccgcccaaaccctagccccctttcccctcgatccccacaacctctcccgcctctatccctcctcctcgcgtcaccacggcctccgccccggagcctcgccgccgcctgataatactcctccaccatgctagcccctccacctcaccttccttctttttgttatctgcgcccgtcatcgatgcctggttctagatcgggcgcgggttagacgaggtcgatggtggggtgaatgggcaggggaggcggggggc

SEQ ID NO: 56604 - DNA, 406 bp, Triticum aestivum
  Clone ID: PAT_TA_56604
cggacgcgtgggtgcgcgtgcagtgtctttggcgtcgcggcgccgctctcttcttcatccccatgctgccgccagtacctccccatgctgtcgtcggatctgggcgcctccatgcggcgacctccctccccaagcccatcgcgacgcccaaccacgggctcctcttgcctttcctaggacgccgacaggcgggatccctggatcgacgcgctccggcaacaagtagcttcggccccctggttcctgttgcagttcgccagcatgatgatatgcgccctgttggtgctctcgtgcagttcaggtgcaggtggagtcaagatcttcccaccgacccaaccctgtctgcttccacctcccccatcttgctgtgagtctgaggacaagccccgggcgccacagtgcaagt

SEQ ID NO: 56605 - DNA, 184 bp, Triticum aestivum
  Clone ID: PAT_TA_56605
gagagcggtagttcgcgcgcgcgcgcacccattgccggcctttaatcaatctctgcagagcaaagccacagttcgcatttgatcagactagagcctgctgtgctagcacttgcatgatttatccattcgagtgaggaggaaggtctacttgatgcaggctgggctgttacgtctctctctgatg

SEQ ID NO: 56606 - DNA, 453 bp, Triticum aestivum
  Clone ID: PAT_TA_56606
cccagctgcggcgcgcgcacgcgtacggacacacactcgaccccggaggagccggagcgggaggcgccggcggcggagatggtcgacggggagaaggccccggccccggccccggccctgctgcggctggagacgctgctggcgctcggcctcgaccagcgcacggccgagaacgcgctggtcaatagcaaggtcaccgccaacctagccgccgtcgtagccgaggctggtataactggatgcgacaagtccgttgggaatcttctgtatgcagttgccacgaaatacccaaataatgcacttgtccatcgtcctgctctcattaactacatcgtttcgaccaagattaagaaccctgcacagctagatgctgccctgtcgtttcttactaacactggtcctgaatctttggatattgggaagtttgaagaagcctgtggtgtaggtgtgggt

SEQ ID NO: 56607 - DNA, 104 bp, Triticum aestivum
  Clone ID: PAT_TA_56607
gccgggcgcaacgcgtgcgggcagcacgacgaggcccgcgccatcgcgcgcaccatgcgggctttccccgcgactggatgcgccaatgctccgcccccttggcg

SEQ ID NO: 56608 - DNA, 460 bp, Triticum aestivum
  unsure (1)..(460): unsure at all n locations
  Clone ID: PAT_TA_56608
gctcctccgacgtcgccgcccaaatccctagctcctccgactcgtcgcccaaatccccagctcctccgacgtcgccgcccgcatccctctcgcccgcgtcgccgcccgcatccttctcgcccacgtcgccgtagccctcgtcgcctcttccgctcgccccgcgtcacctctcgatggagttaaaggtgccttttttagtcaagccgagaggagcgtgggcaccaacggcggcgaggaccagcgggaggagctatgctgctggctggatctgaagttgttgtatactcagcgggagtatgaagtaggaggccgtcgcccgtcgccgtgagctggagcaggaggagcgcatgcacggcggtctggtcgacgacgacaacatgtcctggccgtgcaaggccagcaagggcatgtgaatgagcaggtcgttctactcgacgactgcggtngnctaacaccggtg

SEQ ID NO: 56609 - DNA, 202 bp, Triticum aestivum
  Clone ID: PAT_TA_56609
cgctcgtacgtgcgtgcgtacgaaaggaagcttgggcgctgcgtcccgtgtgctacaaagccggccgtgatttggtttgttagtccaggttgttatgcgtagatggttaggagtccagatacgatctggtttggccagctatatatataacagagacaaagggcgctcggcgccgcggtttggcgcgcggcctcctgctttg

SEQ ID NO: 56610 - DNA, 559 bp, Triticum aestivum
  Clone ID: PAT_TA_56610
agcgccggccatgctcacggtgtctctcctagacgcgcaactcgctcggtgctcctccgcgcgccatctcctccagattcacggccagttcatcgcctccggcctcctcgccgatgccttcgccgccagccgcctcctcctcttcacctccgctacccgcctcctcccgctccccatccaccattcgttccgcctcctccgactcgtccgctgccccaacgccttctcctgcaacacgctcctcaaggcggccctgctcgctgggacgccgcacctctgcctaccactctacacctccctgccggcgtcccccgacgcctacacccaccccatcctcgccgccgcctgcgcggccaggagggacgtgagtgaaggcaggcaggtgcagtcacacgctatcaggcacgggttcggtgatgatttgtacctcaggaacggcctgatgcatatgtactctgtttgcggctgcctcagggacgcacgcatggtgttcgacgcaggtcccgtgtgggacgctgtttcgtggaacaccatcctggctgcctacgtgcatgctggg

SEQ ID NO: 56611 - DNA, 179 bp, Triticum aestivum
  unsure (1)..(179): unsure at all n locations
  Clone ID: PAT_TA_56611
agcggggctagggtttgnccgaaaattcggggatgggcacatatttgtaggtagaggaagctaggagtgtccaaatgaggtgtagttttcgcccacacgatcgtgatccgacggcggagagcatggaagtgacttagatgggttattgggctgttttggaggggtgttttttttttttt

SEQ ID NO: 56612 - DNA, 682 bp, Triticum aestivum
  Clone ID: PAT_TA_56612
ctcatggcgccggcggctctagagatgagggctgcccagaggaagaggatgcagcatctctcccctttgccatctccagctgccgccaccatatctcccctctgccctctccagctgccttcctcacgagccttatcttcgagccgtcatccttgccttcgactcggccgcagctgacgtagccgagaggggggccgatgagcttggccaccgtgtgctgctccatgaactcgctcatgtgcagctggaccattgcctcctctaagccgcagtagctggttgccagcgccttggccagctccgacttgcccacgcccggcgggctggcgaaattgaagctggccaccggccggctgggggtcctgagcccaacgcgcgcacgggggatggcgcggcctatggccctgacggcctcggcctggccggcgacgcgcccgagcagggtctcctccatcttgaacgactggttggactcgtccacggagaccttctccacggcgacgctggaccgcgatggcacgatgtgattgcatgttcgccttgcgcaccattgcgccagccgacgctaccgactccacctctggctggctgacctcattgctgttgtccaccagcgacatgatccttgaatttttgagctccagcctttggctgcgaagctctccggcctataccattcaga

SEQ ID NO: 56613 - DNA, 300 bp, Triticum aestivum
  Clone ID: PAT_TA_56613
gcgatccgagacgcgcctcgctccggctgcaaacaacatccagaacgcacagacacacagattacgagcgagcgcgcacccgttaatcgcttcatctttccatcccacctagagagcctttcgcgtccacgaacctaatcaacaatgaccgccgtggaggatgagacgctgagggcgttcgaagaggaggaggatgccatgatgaatgagccggacggcgagcccatggacggcctcgacgtcgacgacgaggaggaggccgactccccggcgacgatgaagggcggggaggagaaggag

SEQ ID NO: 56614 - DNA, 246 bp, Triticum aestivum
  unsure (1)..(246): unsure at all n locations
  Clone ID: PAT_TA_56614
gnaaattcaaaggtattctattgatgctgttcaagggattcttcattggaaagtcatcagaaatcagctttggagcatactgacagttctgaaaccactgcagaatccgataacaacgggacccaacaatcaactgctcatatggcgaccattcctgaggctgaccccttaacatcctgcagtctcggggagtcaaaatcagttggtaggcctgactttacgggttgcgcgccggaggtgtgtact

SEQ ID NO: 56615 - DNA, 744 bp, Triticum aestivum
  unsure (1)..(744): unsure at all n locations
  Clone ID: PAT_TA_56615
gagatgttcctgctcttggctctaacccagtggtatggctgtgatcaacaataatatttttgcttattatactggcaatatggtgttctgtttatatttgaactttactaaagatatgttacaattcatgcctggagttcaatatctactacctgaaatccgctttctacctatggttatcgagtacacatataaagtgtgcttttaatgctatattaaattcatgcctatagcccaatatatattgccttaattctgctttctacccatggttattaagtacatacacatgctttattgtttattagattctggactgtaggtctgctacttaatgatgcaccccatgctgataagaaaatttattcggtctgataagatatatactgaatagatgaatggcaggatcagtaagctttcttcttgattttggtttcttctgcattctcaatgttgtatatatctgcctgggaattttgttttgttaatttttatagtatcattgttagagagggtgtcttgccgagtatagttttaaattctggatattttttcatacaagaattccaaatacagtaatggcccttgctgggaacaaggctgtcatataaggggaaactntagaagttcagagaccataatttaaatcatgtgcagcttggtttcttccttggtgntttattgcattagagatatttagaattttgactgtctaanatgcagagcatatattgtgcggcttta

SEQ ID NO: 56616 - DNA, 176 bp, Triticum aestivum
  Clone ID: PAT_TA_56616
cttggattagattcctgtgtagcctatgatgtcttctagtcctcttgtgtcattatgtttgtttgttgtgaactcataagaggttgtatatggtttgacggaggttcttccagatgaaataagagatgcgcaggcttgtcgccaacccccgcatctattcagctccctcttgttgc

SEQ ID NO: 56617 - DNA, 540 bp, Triticum aestivum
  Clone ID: PAT_TA_56617
atccacattcctattgtgcaggatgcttgatgtttctcattagttggaaagagtgctagatgcttgttgtttctctttaaccggaaactgtgctagatgcttgatgtttctccttaaacaaaagtcttgagcttttgtttttatctaaagacattttccgtgttcttcgtatattgatgttcaggccaaatccgactagactctgctctacttcgcaattatcgtgagagaaagtaacaaaaaattgattggttttgtgcattatgttgccatgatccaacatttttacaaaaaataattgagtgccatgttgtgctagatggttgatgtttctctttaatcataaacctttttttcttctaaacatctctctctctctcggctcatgaagaaatggtcttatgtgccttgcttggataggctctcccatccctgatggtctagacgtgatcgctcagggatgaaaataaaggcccactacaatagcatgtcttaccaaaacatttggcatggtgggaatatgactgctatggttttaaa

SEQ ID NO: 56618 - DNA, 177 bp, Triticum aestivum
  Clone ID: PAT_TA_56618
agattgtgggttttgccaaaaaggtgaatccttgcttacattttctcctccaattgtagacactcatcaagtaaatgctgagcttttggttgttccgtggtcaatcagtggtgcttaaaatggtctgttgcctacattgccctccttcacaatttatttatctttgcaacccatgta

SEQ ID NO: 56619 - DNA, 347 bp, Triticum aestivum
  Clone ID: PAT_TA_56619
gccggggactgtgctccctgcttacacacaccgctacggtcggagtcggcaaacgatgtgaagcgctcgccactgctgtcctttggtgatgccgctcgacaatgacgacagcaggagatgattacacgcaagaaaagaaaagctagagctcctagagtacaattcacaagattcctctggatggtagatgacgtaaatatcctctttcttctcggatgaaacaggcggctgaaactttgtaacatttgagcatgtgcgcccatgttatgatagtgtattaactgtccaaaataataaagcgtgcgcatgcggttcgtggagctgcatgcatgagtgtacatgtgacg

SEQ ID NO: 56620 - DNA, 675 bp, Triticum aestivum
  Clone ID: PAT_TA_56620
agaggacgagctgcccgctgggaattgatgacgtgcagcggcaccaggagggaatcgaggagttttctatttttcacgtcgaaagaaggggttgccgtatccaaaacgtacgctgagaggcctgtttggccgttcttttgctggctatgactgtaatagactttaatgttagtgttaccaggtttttgccccacggcatccgtttcgatggcgagcagatgtggtgggtttcttggtaatgcttgaactcgctctaccctctttccctcctcctgtcaacttgaatttgtttgtatttctgttcttagtaatggaaaggggtaaagcccggttcaaaaataaaataaaatcaaacactattttttttaaattaacaaatcacaggatacttacgggatatgtatcgggcagtatcagggcagtatccgagtatcagggcagtatccggctggatacgcgcactttctaaagtatctgtgcaacgtaggggaagaccatgtcatcatttggccagtgcaggtaatgctctctacctgatgcactatttaggtcatcatggtttcgatacttttggctcgccttaatgctaataaggaatgtcaagcttacaagtttcaaccatgtgaagtgattccaaagttatgtaggccagattgtgttattttttactgaaca

SEQ ID NO: 56621 - DNA, 728 bp, Triticum aestivum
  Clone ID: PAT_TA_56621
gaacttactatgaccgaacagaactggagccgaggccgatggtatcgccgagggcaccagcagccaactatcattggagaatggatctattgagccagtgcagtttggtgaactgggggtgaacagacattcatcagcagtgactgatgaaacccatcaggataggcactatgaaaagcaagctagcgcaccgtccagaacatcagatatattggatgctcaggggcagagaaatggtccgattttacaacgttcgatttcctttaagcaaggtattcaacaattcagagtttctgaatgggaggacagggagaaatgggtctggagtccacttagtgagttaagattggcttacaggcaggagcttcaggccggatgtttggaaaaatttgagcttgttaaccgctattcgccatctcatctgccacccttgcacaaacaatctgctgaagaggcgccctctccacggttcgtcgttggtccgggtggcaatgtcttgtctgtatcagaggatgagatatccagcatagtctcccgtgctctcgccatatccgaggaccgtcgccacctgctggattctattgtcgagagtcatgcgtcggacactactagcatgttatccgaatcttcctcttccgcctcttcatcatcctggtcatctgaatcttcggattcagaagcaggcttttttgtccgacgaactgtacaactacgacagctcgctccta

SEQ ID NO: 56622 - DNA, 163 bp, Triticum aestivum
  unsure (1)..(163): unsure at all n locations
  Clone ID: PAT_TA_56622
gttgaagagaatccactgttgtataaaacaaatgctggtggtcttgacagtttacacatttgtttgggggcgcctgtatctggccctgagtggtctggaggctggaattcagggaagtgctaatgctactaacaataaagccttgngtgctgtatgacanact

SEQ ID NO: 56623 - DNA, 102 bp, Triticum aestivum
  Clone ID: PAT_TA_56623
ctcttcttatctggtgcaatcgatattgattctgtacctgtgctttgttctcggctgtctgtacctgcaccgtcctgaggtcctgtctcgcggctttgttgg

SEQ ID NO: 56624 - DNA, 484 bp, Triticum aestivum
  unsure (1)..(484): unsure at all n locations
  Clone ID: PAT_TA_56624
ctggagctctaaatcgcataattgacagagggagcaatgcaataaatttcattcttacggtgacagtgttcaatattgttcccacaatactagagattggtatggtgtcaagtatacttgcctacaagttcggctccacttttgcttggattacttcagtttcagttgctacttatattgttttcactttggctttgacacagtggcggaccaagttcaggacagccatgaataaagctgataatgcttctggtgcggtggcagttgactcccttctgaattacgaggatacgaggattctgcactgaaagcccaaagtagccttgcctacttgaactttgggcaaaatgttatatttagtgtgtcattatccacagcaatggttttgagctcatatggtgtaatgagtggtgctctgactgtcggtgatttggtaatggntaatggacttctattccagctctcaaggcctctgaacttgctt

SEQ ID NO: 56625 - DNA, 298 bp, Triticum aestivum
  unsure (1)..(298): unsure at all n locations
  Clone ID: PAT_TA_56625
ctttcctcaactttgttactgaaggaatagaacagaaggccttactgttacggcaatggtatttgattaagtatatcatcatcatcatgctgctaaattcatagtcttgaactttgattgtttgttatacggtatggaatagtgaagtcaaacagttaattcagcactgctcctccacgttagaattaaccattggggacttttgatagaggtgattttgtttagataattagtctagggagtaaccttttgatcgataaggcacatgtttatttgctttttcgntgaaggatacact

SEQ ID NO: 56626 - DNA, 482 bp, Triticum aestivum
  Clone ID: PAT_TA_56626
cgaggaggacgactccggctacggatccaagccgcagccggcctacggcttccgcccccagcaggaggagcagccggcctacggctccggctacgggtccaagccccagcgctccgaggaggacacctacggatccggctacggccggaagccgcagcagcaggaggagctcgcctacgggtccgggtacggctccggctacgggaggaagccgcaggccgaggagagctacggatctgggtacgggaacgcgacgcagccggaggagggctacggctccggatacgggtccaagccgcaggtggagcagacctacggcggatccgagtatggctctgggtacggaaggaagccgcaggtggaggagagctatgggtcggggtacggaagcaggccccagggagggggagaggagtacggtagcgctgggtatggcgggaggaagactgaggaggagggctatggtggttctgggtatggat

SEQ ID NO: 56627 - DNA, 104 bp, Triticum aestivum
  unsure (1)..(104): unsure at all n locations
  Clone ID: PAT_TA_56627
ncgcataggattcagcccaccgcccgttgggatgggagcttcgaggcggccgaccgcggcacttcggccggaccggcttagccaatggcacgggcccttggggg

SEQ ID NO: 56628 - DNA, 193 bp, Triticum aestivum
  Clone ID: PAT_TA_56628
cttgggggggcaaacattaggaccgggctagggggcagcaaagggccagagcagcgacagccccaggcagaggggccaacgtccgccccgggattgcgaccaagcgggctctaccgcggcccggccccaccaccctggggggcgggccactgcaggcgcggcgggggtgccccccggcggagcagccgggggg

SEQ ID NO: 56629 - DNA, 781 bp, Triticum aestivum
  unsure (1)..(781): unsure at all n locations
  Clone ID: PAT_TA_56629
tatagacaagcatatgtctgaattttcttcatgtggaacgatctaatcttctctatgaggccaatgtttccctgaatctttctttggaacacctgtcattttcgttagctattgttttttcaaggttgaatgatgatcacaagtgcatagttcatatgatcaaataatgattacttgaacaaaaatagtctttcgctcctatctgacaacctttcaacctcagcccttttagctattgttcttttgcaacgtgtagataacaccgcccatattcttaaacactttagtttaatatttttctgtaattaaatcaaactattagacaatttctcttcatgtgggaaaatgaatttgtaatttaggtagaaatttgtttgttttcagggttctttactttgtccgagttcgggtgaacaagtatatgaccgaccaaaatagttttagtttatttgcttcgatttggagcagtgatgaggaaattcacccgaccaaaatagttttagtttatttgcttggatttggagcagtgatgaggaaattcactcagtatgatctttcggatgtgattataaatcgctacgttcttactgagctcctgtctgtttgctatttatatttcttctgtttttatgatatgtaactgatcttttgttgtttcatctttcttgatgttctcttggngtaaatatctcttgatgagagtacaagcagacgggtggtctgtactgatgccatgttgatatgtctgcatcacctgtgctttttcatgtgggttgcatct

SEQ ID NO: 56630 - DNA, 404 bp, Triticum aestivum
  Clone ID: PAT_TA_56630
gtccaggcactggcaagatatactcggagggaggcaacttgcctatcattgacagataaagaagctttgttctctggcaacttcaagtttacgaccgttgtgccaaccgtccccagcccagtgaagcaaccgtccccagcccagtgaagcgacatcgatgagcgttggcattggtagatcagtattccatatgaaggctggctggtatacatggacaaggaagactgaaagtcctatcatcattacaaataataggaaatttccagtatttatttatgcacgaatctcagcattttgggccattttggtggctccacctgcctctagctaggaatctcctttatgtttatcctgtgtgagcattgcattgatgggctgccctctcggaatagagcacacggtgg

SEQ ID NO: 56631 - DNA, 154 bp, Triticum aestivum
  Clone ID: PAT_TA_56631
caggtcgcttcaagccttcaaccgatggggcggctgcgcgcgtgccgccaccatctccgccgcctcctcgagacaaggccgccaccagcgagccccactccggcgcgcctgccgcacctccccacccgcgtgtctcctttctcctcggccgtga

SEQ ID NO: 56632 - DNA, 188 bp, Triticum aestivum
  Clone ID: PAT_TA_56632
gcacaggctctcggtgccacgagctgccgagcgtctccttccacacagagccagcaccgccccgacggtgctcgcgacgatgaccccgcatcgcccaggccgagctcctcccgctgctcacggaggcacccctgccacgcttactgcccgaccacgcagcgccactgctcgcacccctcaaactgccc

SEQ ID NO: 56633 - DNA, 194 bp, Triticum aestivum
  unsure (1)..(194): unsure at all n locations
  Clone ID: PAT_TA_56633
ctgcatcttaatactatatcttcttattggggtatggagtgctggcaagcatcattgctgnggggtgttatttaatcattgcgttcatctgtgtggaagtgaacctgaaaaggctgcttgaggcggtcccccgcctgcggaatgaggctaactttgttcattacttagccacacacagacagctgggggggggg

SEQ ID NO: 56634 - DNA, 282 bp, Triticum aestivum
  Clone ID: PAT_TA_56634
gtcgccccgcgtccgaccggctagccatggccgggccctgggggcgcaagcgcccctaacgtgggtcggggcgggcgtgggccgcacgcgtagcatgctagcttggattttgacttataggcagttaccagtagctcagggctgttttgagtactgtacctgagttttgaatgttagttggtgaggaatatggtggggggggtgtgactgctcatgagctctgatggaggtgttgtagtaaggtcttgtgtggtgttgggttttactgggtaatgactacgt

SEQ ID NO: 56635 - DNA, 241 bp, Triticum aestivum
  unsure (1)..(241): unsure at all n locations
  Clone ID: PAT_TA_56635
cgattccngntcgacacgcgtccgcaagataagcaaagtttatctagttagtggatattagttctactggtttgactttggcatatcgatgtctactggatgacatattggaaatatgtagttttgttaaaaaacaccagtgtatgattccatattcttgttcattatatgcctttgtagtcaaatagtatatagattttggggggggggtggtaacaagtgtntgattncatattcttgg

SEQ ID NO: 56636 - DNA, 461 bp, Triticum aestivum
  unsure (1)..(461): unsure at all n locations
  Clone ID: PAT_TA_56636
gttcctcagatccccattcccgtccaagaaaaaaaaaaacttatactgcgccgcctcctccccggccgcttccccgcgctgccgccgcgctatccgcgggacctcctctacccgtctccccgcccggtgctgctcactgatttcggcgatccgcattgcgggtagggttgggttggagtggccggccgatccgcggcaccgaagctccgtcgcacggttcttggggctcgcgcccgcgagcgctggaccgcgccggcgacctgctgcccggacttcctgccgcgctgccgcagcgggcacgcggcgatcgccactggttgcgcttcgagggccgaatcggnggctaggcaacaagatccggcgaagagcaacccctgatcggntgctctccaccgncactcccggcaatgagtancggcggtggcggcggcggaggaagccccaacaactcggaatggcgc

SEQ ID NO: 56637 - DNA, 312 bp, Triticum aestivum
  unsure (1)..(312): unsure at all n locations
  Clone ID: PAT_TA_56637
ncggacgccatggctgtcttcgccgagagcgtccgcatcttcatccactgtctctccaccatttgcacagtggaggaagaatttggttatttggagtgtgcactggagttattggaagataattccattactagatcacaacttttgggacataagtacagaaaggtttccctacaaataaaaaccatgggtgggagaaatacgacaagaaggtcatgggtaagacaagacagcagatggctttgtttatcaatcaagggattattatgtcaccatgaacattggggattcgggccagccttacttactggg

SEQ ID NO: 56638 - DNA, 375 bp, Triticum aestivum
  Clone ID: PAT_TA_56638
gtacagtctgcgcggatgtatcttctagcctaacgaagcattggcggcagcggggtgtaaaagcctttcgaacttcagatcagagaagagcatgcacctatgtcggcgaggagctcctcgtcacggccgtggtagggcgcctgtgcggctgcacctgtgttggggaacaccgcgtcatcgtggccgtcgtcgggtgactctgcgagctcgtcatcgcgatcgtcatcgggtgcctcggcggctgcgcagggcagcgacggggcatgtaatctggacgccgggcctgattcccgctaatctagctcatatgtttccgtatatgactctccatgtaaattgaacgtgggttgttaccttctttttttgagatttgag

SEQ ID NO: 56639 - DNA, 402 bp, Triticum aestivum
  Clone ID: PAT_TA_56639
tacattcagcaccaaagcctgcaccatagcagagaacaatgatgaatgcaaggtatattatctaggaaatatatcgcttcaacctaatgatccatgatggtgtcagctcgatttgattctggaggcttcctttgctcatatagggattgtgacatgtttgggtggtctgcaatgtggacttgtacatttcaagaaatgcaaggtatattatctagaaaatagatcgcttcaacctgatgtccatgatggtgtcatgctcgatttgattctggaggcttcctttggttagtaattcacctactcttgatcattgcctgcaatttgtaaatcgacctgactttaagtatgttctgactgactgttcatttgctttatcagcttagtatagggattgggacatgt

SEQ ID NO: 56640 - DNA, 548 bp, Triticum aestivum
  Clone ID: PAT_TA_56640
gtcccccgcgcgaccaaaagcttcaggaggcggcggcggcggcggcggtcggcggcgcagcaggtattagttaatcatggtgttcagcaaggtggaagtgaacctgaaaaggctgcttgaggcggccccccgccagcagaatcaggctaagcttgtccattacataaccacagccagggagctgttggagcagcttggagctgaaattacaccagaaggaatatcaaggtatggtatagtgttgtgtgctattggggaattaatatgttgatggtggtatagcctgcaagctgcaacctgtgttccagctagcatttgttgaggatccagaattatagaaagaaatacagccggtatatgacaagatcgtaaccatcaagattgtagtctaatattaaattataatgcactcttgctcctagtttatgaatttagtgtgtccttccaaggtaccaatacttaaatcgtgcgaatgcatctgtatcagtatcgccatccatttatatgtatttcctattaaggtaaaggattagtggggtggttagtca

SEQ ID NO: 56641 - DNA, 682 bp, Triticum aestivum
  Clone ID: PAT_TA_56641
cgcgaaccacgcgtcccaaactgccagcccctctcttccccctgccgcaccacgccacccaacgacctcgatcaaagccgccgccccccaccgccgccgccgccgccaccatggggaggcgatccggaggcaggaagctgcccttcttctccgccgcctccacctcgtcctccaccaagcgcacccgctccgcgcgccgcctcccttccctgcccaagcccagctcgccgcctcccccctccccgaccactccgccccccgcgccgcagaccaccacgtctccgcctgccccctctcccgggggtggtgccgccgtggccgccaaggtcggcaagaagaaggccggcgcccgcttgtggatgcggctggaccggtggggctcctctgagatcctggagctcgacaaggcctccatcatccgccgcgcgggcgtgcccccgcgcgacctccgcatcctcggccccgtcttctcccactcctcaagcatcctcgctagagagaaggcgatggtcatcaacctagaattcatcagggctatcgttaccgcggaggaggtcctcctattggaccctctgatgcaggaggtgctccctttcgtggaccaattgaggcagcatctccctctgaggagcctggtgggtggggaatggtgaacacagcggtgatggcaatggggccaagc

SEQ ID NO: 56642 - DNA, 741 bp, Triticum aestivum
  unsure (1)..(741): unsure at all n locations
  Clone ID: PAT_TA_56642
cggacgcgtgggctgatgaggaatgctcgtgacattgatgaacttgatatgagtgttttgtagatcatcatccaaccgacgtgccagacatgctacatattggcatgatggacttctatggtacaaggacattgggcaccatgtaaatgtgactaatggtttgcttcgggacacgttcagtgtcctctgatgtactgaagaaagcatattaagctacataaacatggattcttctctattgtcacaaaacagctggctcttggggtttccaaagcctcttttggggatgcagctggagggttccatggcgtttttagcagggacggtgtgcggcaggttacgtgtgctggacacgtcaagttgaggtgcctaaagtttctatatggcttaattttgtcgctctcagcacccttgcaagatcattgttttatgaactcttcaaaatttctctacttttactgaatttgggtctttgtttctaagattcccctaacttatgttgtcatctggttctcccatcttataggttatttgctcagttgaccatttataacaaggaacaaaaaaatcactaggtgttctatacatgtcctccagtatggtatactatttcgtttttaagaatttgtatgccctttttctggaatgtcgtctcttggatacatcaagatagttgattccaattgttaatggntggttgttttcatactacattgttgctactgttcctaagtgtagcgt

SEQ ID NO: 56643 - DNA, 154 bp, Triticum aestivum
  unsure (1)..(154): unsure at all n locations
  Clone ID: PAT_TA_56643
ggcgtgccgggcgccatcatcgtcaacaaccaccacagctccgagttcctgctcaagacncgtgcacccttccacgaaacgtaccccgtgccgcaggcaaacctcctcctgttcgtgcgcgcaagctgcatgtgatgctacccccacacttgca

SEQ ID NO: 56644 - DNA, 548 bp, Triticum aestivum
  Clone ID: PAT_TA_56644
gctgaatcggcgtccccctcacccctaaccggcggcggcggcgctcatccctaaccggcggccaccggcgacgccccgacggccggttccccacctcaacccccgtccaccgtcttcaccccggcggccgtccatctctcccgccgcggccgatagctgcaggtccgccaccgctgtgccgccgcgccgcagctccgcgtcgccgccgacggctcattccctccgcgcctcgcgcacgtggccgccgtcgcccgtccccgttccgccccgccgcgcccctgccgcctccgccccggccatctagatccgccgcccctgtctggcctcggaccggatggacctctccgtcacgctggccttgagctcccccacggagcacggggagcagctgaggaggcgccagcactcattatcagagctgacttatgcaagagatgaagacgcaacaaaacttgagaccacgcgtgcacggctgttaaatgttctcaaaaggcatgaagatctgaaagagcgcctctcgcggtactcctttctctgctctttttttt

SEQ ID NO: 56645 - DNA, 589 bp, Triticum aestivum
  unsure (1)..(589): unsure at all n locations
  Clone ID: PAT_TA_56645
gcacaggctcccggtggacgagctgccgatcgtctccttcccacagaggccagcaccgccccgacggtgctcgcgacgctgacccgcatcgcccaggccgagctcctcccgctgctcacggtggcacccctgccacgcttcctgtccgagtatgcagagtcattgctcgcttctctgaagctgcccgtggtgatgccggtgtcggctgcaatggcggccaccgcgctccacctgcggctgcggtacggggaaagcagtgatggcctggtgacacggcgcgacgccgaggtcccagggtccgtggtggtgcggcccgagcggaggctggaccatgcgtggctggtgttctcgacgctgagccggcggcgcgccgaggccgatgccacccaggtgtgcgaggccctgctggccatgctcgtcgagatcggcggcaagagacgccgctgcctcatcgaggagatcgttacttgaattatttttctctctgcttgtttgntgagctagaactttctatatacatatagtgaagagtctctgtttttctgagaacgacaacagatgcaatatctgattataatacgggagtact

SEQ ID NO: 56646 - DNA, 182 bp, Triticum aestivum
  Clone ID: PAT_TA_56646
gcgcggaggagtggcgtgaagaggatagctcgggacatagggcaacttgatgtgtctgcttctttcatcatcatgcgaaccgagaagattgcatgctacatgttaagtatgatgagagaaggtaatgcaaggtctttagagtcgattgaagcggaactagtgcgagcttctgaggcgcaact

SEQ ID NO: 56647 - DNA, 646 bp, Triticum aestivum
  Clone ID: PAT_TA_56647
ctaatactgggataacatatcaccccgtgacatctgctacggccagcatgataggctggttaccattacaggacagctagacaatcagctgcaggccatatttttgatactgtcagagttactggacgttgttcactactcgtgctctgatgcaggcgtcaatttttcaagttatcctgtttcacctgttgggtgtgaagatggatatgtcaaaagatacaacagcaagcctaccacgtccctcagatcatctgtcaacaacagtgatgaacaagagtctctcactattactgtcgcagacaagcatgtcggcgctatcgtcggccgtgccgggaggaccataaaggagatcgaacaggttaccggcgcattcatcaggatctcgggcaagggggatatcatacatgggacaaatgacaggaaggtggtgatcagagggacattggaggcacttaatgctgcggaggcaatgatcatgcaactggtctgcgataccggtcgccagctggacggtggtgacaggaagcctctcgagcaacctaacacatccatgaggtcgcccgataacagcaatgacacttctgtccctgacaagcacgtgagcactgtcatcggccaagctggggaggaccatcaatatccaaca

SEQ ID NO: 56648 - DNA, 683 bp, Triticum aestivum
  Clone ID: PAT_TA_56648
cgacctccatcccgccgccacctcctgcctcgcgcatcggcttggaggcccctcggggctgccgccggtgcgggagtcctgcgcagccgtgagggctggggaccaagcggcggggcccgtggtgcgttcctgttgagggcttgctggggttggccgggatctgagccgccgtcgatggatttctcacaggttggctacatgttgcttcggatttgatactatccccatctgtcgctctccctctccctcggtgtggacgcatgcacctaaatccaaaacctgaactgaatcagtcgagcgctcgttgccagatcgttgtaccatcgtcccggtcgccgccgcgtcagttccacaccgctacagcacagcctaccaccgccactccattggcttggatttgcttgcggcatgggctgggaactgtacggtgttgtctgatgcatgttccgcactgggaggtttggtcggctgacgctaggtatgagcagctcttgagcctgattgctggatgtgcgcacgcatgcatgtatacttctcacttgcactgcttatacaacacattgcatgtacaccatggccgtggacaggcgaacgtgctcctactcctcacaaggcacccacaatctattaccaagccaatccaaaactttaccatgcattttttttgaaggacactaagtatc

SEQ ID NO: 56649 - DNA, 220 bp, Triticum aestivum
  Clone ID: PAT_TA_56649
gccattttttggctggaggcaaggcccggtgaggcctaatgtcgttgcttgtctgtagttgagggcacctcctccacctagctgtagtcacttggtgaggacggtcgtgtgtgtgtgtgtgtgcgcgcgagcgcgtgagtgtccctcctttctggaggttgtacccctgatgtcttcctgttcaatgcaagttcaatgcaatgaaacacaactcttttgc

SEQ ID NO: 56650 - DNA, 728 bp, Triticum aestivum
  unsure (1)..(728): unsure at all n locations
  Clone ID: PAT_TA_56650
cttcctccatcagtgctagcgtggcgatggttcctcctggtgcttctgcgtctggccgccaccgtcggggccgccaccaagggcccgtaccgggcaggagctgcgtcgagtctgatgccgctgctgctctggggagcgagatcctgcatcgccgtcgccaccctaccaggcttactccggtctgcctcttgtcgttcgagcaaaagtggtgccagggccgtcatcgggtatctaaggcgaaggagcagcaggcaccaccacagatgagccagctgcgcggttctagatgctccatcgagaaaagccgtcgccggggagctgcttcgcctgccgtctcacgccctggccatggcatcctacacgacggcgggtcgaccacgatgctatacaacatcgcctgccggtggccgtgccaacgggcttctagcctcgcacgctgcctgccggttcatctcctttactaactttgattcccgtctcctcttatttttctgtgcgtgtgagtctatttatgaagatcatctgtttatgttgcacagattgagattcgaactgcactttcgccgttttttcttattcccgaacaagcagcagcacaaatgtagggaggtatctgacaacaatggatgtggtaccactccgttcgaccccggtcttcctctacctcggatagncgctgctcttctctctccttgctaaagctctgaaagggatgagcatatcattac

SEQ ID NO: 56651 - DNA, 649 bp, Triticum aestivum
  Clone ID: PAT_TA_56651
atcaacattggagcgcgcgacccgcccgggtcggatacaaaccacctgtagatcccctgcccgtggaatcggatggacaactgggaacgagcagctcaggcgactgcatccagtgaggacttatgtacacgctccggaacgtgatattctgcgcagacctgaactgccatcgacgaatgcgactggcccttccctctttcagacggctggctcgttgcctgggctgagctgaagccacactgacgacggatggacgtacgacacgaaggctaacggcatgctggcatgcaaccgcacagctgcagatgaggctggacacggctcgagtgcaacctgccggatttcgagattgacaccatggagatgatcggagaggaggcgatacctgcgatatcacactacaaggagaatacagcccgcaaggtagaccacaacattgactatgctgtgttgcctagcgaccacttacggcttgttctgagcatcacctacgcatcatcaggttgaagagtatggagaaataacgttccctagtagaagtagtagtagtagtagtggcggtgaattctgtagcccaatggatagtatgtatgaagtatctctacccctgtgtgagaagataacttagagaccgtttctgtaccctact

SEQ ID NO: 56652 - DNA, 529 bp, Triticum aestivum
  unsure (1)..(529): unsure at all n locations
  Clone ID: PAT_TA_56652
gttcctcatgcgccgccgccgcccctcgcctgcgatggaggaagtgagaggaaagaggagagggaggtgaggcagcaggcaggagagggtcaccggctgctgtcggcctgcgccggcgaggtcgggcgcgacctggcggttggtggcggctcgatccgatcctggatcgggagaggaggaagggaggtggggggccggccgtctctgtgcctcctcgacgccgagctgcggctgctccgtcaggagtaggaggaggaagggaggaggaagggaggatgaggaagtagaccagcaggaggaagagaggatctcgggacgcgctccttattggacttactgtagtataaacaggtacatgttgtgcagctcatgcttttttctcttgccatcagtgagcttttctcctttgatgttactggttttggtatgttgtccccgtcgctgtgtgttaccttagttgatactgcttggtagctttcttcttgtttcggaaatggtcacggttagttagatttctttgttngttcct

SEQ ID NO: 56653 - DNA, 690 bp, Triticum aestivum
  unsure (1)..(690): unsure at all n locations
  Clone ID: PAT_TA_56653
aaggatttcttaaatctggaaaagaacttgatttcgcttaagttctacaatgtatatatcaagtaagttgcactgcagctgatccttcagccccaaccagcctattagtattgttattttgtagagtgtaaaacttccaaattcttctccattttgtgcgtaatataaaactaccagtcacctaagccattagggctaaactgcaaatgtactcaacaatgaagacaagacaatgattcatgattaaaaaatgttgtggaaatcaagttcatcctgattcttgaacaattaaacaatgtagacatgctgtaacgacaatatttatgattaccatggctttgcagaaaactcatggtcaaactgcagctatttagtaataatattacaactcacttcatattgcaattgatacaccatttaggatattactactggaactgagctcatgtgtagagtgacctgcaggcaagttaatggatcagcactcttctcctatttggtctcaatgcttcttcaatttcaacaggatcaattaatagcagctcttttgctcaatgcttcttcattttcaacaggatcaattcgtcagttctggtatgtagaactatcttatccactctgggaagtgcccttcctaccttntatttggtatcaattgagaactgttttanagagtagaaaccaatcacg

SEQ ID NO: 56654 - DNA, 577 bp, Triticum aestivum
  Clone ID: PAT_TA_56654
cccgagccgccccctcgtctctcttatcccctccctccctctctctctctctctctctctcaagcacacaacagcaacaactccggccatgggagaccttcgtccggccgcaccgtggacggagaagaagacgaatcttggctcgatctaccgcctcaccgatccaaacttcatcggtttcctctgtactgactgacccatggaatttttgcagatccattctttgcccaaggggattacgcataacccagcgtgtcaagatccactcgggcgcacgcgcgtcttgggccacctctccgttagtgggccgctggcagccggcccaggcgtgccgtcagcccaatggagggccgcatcctgcctgcgaaacactcggccgcctcctcgcccacccagtgcgctggggttttagacgcccacctgccaccgcctccccgtccccatttcgcacccgtcggcgagcccctccccctcccctccgccacccctctcctccaacgccgcctgcgccaggcgaaggatgcctccaatggcgggagaaggtaaccctggtgagggaggaggaggtgaggcggag

SEQ ID NO: 56655 - DNA, 656 bp, Triticum aestivum
  Clone ID: PAT_TA_56655
aaattatatgaacggaaagtagacataacaagcctcattttgtttcattggacctgcttcagataatgcatggattaaatcctacaaaaatcacaaaatgctatcttgtgttaaaaggaatagagttactccctagcgttgtgtttgtgcgctgtgtgcgcgtgggctgtgacacagcagtgtgtgccgggcctagtttaattaggtctaaactaatttagtttagattggttggttaattaattagtctaagcctattacatgtgggacccacttacactatttatatgttgaccagtcaacatttgaccgggtgaacccaaccccactgtccccacctgtcatacattatggctataatagcactaggtgacaaaattataatctgttctattttcgaattaaattaattctagaaaatgcaataaactttgaaaatgaatataaaataatccgtaactcagatgaaaatactttgcacatgaaagttgctcagaacgacgagacaaatccggatacgcatcccgttcgtccgtcacacatccctaacatatcgaacatgcaactttccccctccggatcacctgcccgaaaacgcgaaacaccggggatactttcccggatgtttctgctcttcaccggtatcacgtactact

SEQ ID NO: 56656 - DNA, 721 bp, Triticum aestivum
  Clone ID: PAT_TA_56656
gtctacaatctcccgtccttctaattcgatctcttccaccagccacttgagtacgcgacagaagccagtgaatcagtgagcgacaggcagagagctcggcctcgaccaagaagaagaagaagaagaaagaagcaaggcggcagcaatggcgggcgtgggtcgcaacatggtggcgccgctgctggtgctgaacctcatcatgtacatcatcgtcatcggcttcgccagctggaacctcaaccacttcatcaacggcctcaccaaccgccccggcgtcggcggcaacggcgccaccttctacttcctcgtcttcgccatcctcgccggcgtagtcggcacatggcgcggcgacagccttgccacctccgcctcgtcagcgctggtggcctgggcgattaccgccttggcgttcgggctggcgtgcaaggagattcatattggtgggtaccgcggatggcgcctcagggtgctggaggcgttcgtgatcattttgatgttcacgcagctgctctacgtgctcgcgctgcactccggcctcttcgggaaccagtttggcaaccatgctggtgctggtgggtacggagccgagcacggcgcgtatggcgccggcgacccgcacaacaagggcatgggcaccggcggcgtcgcgagggtgtaagccaagccgggtgatcgatcttcggcgtggtcgggcgctgggataataagtagttgtatgtat

SEQ ID NO: 56657 - DNA, 749 bp, Triticum aestivum
  unsure (1)..(749): unsure at all n locations
  Clone ID: PAT_TA_56657
tgatgttctcgctcttaaagaaatactgacaattgatgccaacgnacccgaatggntcccaacacacaactactttacttctctctctcgtanaaagaaattactgtcttctaattattatataggagtgcacatcaaatgttttcatttggtgcatcagttcaaagcaagccagaaaaattaagtcttctatttttgtagatcagaatcctagacgtagtcagtttatatcatttttccggtacctctattgtgcatatatttctcaaacgaattctgccatcgattaggagtgaaatcaccatgacatttacaagctttgtcttccatgctcaggtcaatgatacttgaaattcttgggacttatttcgaatcgaaacattagaagataagcttatggtgactttatgaggttttggcattggaccgtttgaaactttagattggcagagagatagagaccctgtgggccttggcagtggcgagctaggtgccagcgaggtaggcgacatcgtcaatgagggccatcatggcctccacctgcgccctcttgcaggtggactgccggtcatcgatgtggcgggtcgggctcttgcagcaacatctatgatattctctggacgagctgtaggtaggccagtagatgaggattcgacgaccaccaccgaggtatgccctcctctccttgcccttgggctggcatctctgatcaggctgtaatctgctgctgtaggggtgctctttgggga

SEQ ID NO: 56658 - DNA, 466 bp, Triticum aestivum
  Clone ID: PAT_TA_56658
ggaggccattgaaacgatgatggtcgccgaggaagggctcgcggtgaggcagcgggcagaggtgctcggggaggccgtccgttcgtcggcggctcagggcggatcatcgcacaaggaaatggacgacttcatatcatacatgacaaggtgatgtatgatgatggaaattttacactgatgaagaatgctgtagtttctgtttaaataaactttgagcagtttgagttgagcttggattgtatcacttgagaggaaatctcatttcgtaattcttgtcgtggttttagtttagaattatggaatggagtgatagtattaggagtagtactaaacaagcatgaatggcccagtattttctttggttgacactgtctctttgggatcacggattagaagacttgtctgccttttctaatgtattcttcctgtaatctttgactatcttaaaaaatatcttgtttgacca

SEQ ID NO: 56659 - DNA, 749 bp, Triticum aestivum
  unsure (1)..(749): unsure at all n locations
  Clone ID: PAT_TA_56659
cagtgattggatcgcacagaggatacaagacatgcttatccatggtattgaatcatgggcaccaatcttaccagttaagagggtggtgcttgatttttcatctcctaatattgcaaaggagatgcatgttgggcatataagatcaaccataattggagatacactagctcgcatatttgagtttgcaaatattgaagttcttcgacgtaaccatgtgggagactggggtacacagtttggaatgctgatagaatttctgtttgagaaattcgcaaatggggaggaagctggcaaccaggccattgagaatcttcaggtagatgttaatagtaccagagcttagtatttatctaatacttcagctgatgaaacttaatctaagtatgccaagattattcacaaggttaatgtatctgaccttagatggtgatatacctgtagcatcttactctaatactgagtggttaacctgcttcctttctccaaatgtacaattgcaccattggtggtagcactggctgatatatgccattttctgtaacccctaaagactgaattggtgcataaaaatcttgctctgagcaatagaaatcatganttatagtctgttctgcatatgtatatagagcatgttactggtatttatcacaatggttgtacctatttcttttgagtaattttcttgtcttactaaatctacgaattgtgacaaaactattactgaataaaagctcctttcgaatgtttcg

SEQ ID NO: 56660 - DNA, 701 bp, Triticum aestivum
  unsure (1)..(701): unsure at all n locations
  Clone ID: PAT_TA_56660
gaagacgacaagaaaggcggcgccgccgctcccggcagctcagcgccggggacgagattcaagaacctggtctccagggaatactacagccacaagaagaagttgcactctgtggcatggaactgcataggcacaaagcttgcttcaggctctatagatcatactgcccgtgtctggagcattgatccccatggccattccaaggttaaagacattgaactgaaaggccactcagatagtgtagatcagttatgctgggatccaaagcatcctgacacagttgccactgcagctgctgacaagtcaattcgcctttgggatgcacgaagtgggaaatgccaagttgttgaactcagtggagaaaacatcaacatcacatacaaacatgatggcactcacatagctgttggaaataaggtttacaataacagaacatgggtacattagattgtaatatacttttgatgcctagctgtttgtctagcatattgatttgaaggaatgggacattcattcatgttcaacattgtcttcatgacgcttgtgtttcttcattntctttcgttntcttctgataatatattgaattactgatagcatattgggttattgcccttatttcaaagtagaaaaaaatatcctgatatgtttgtgttacgcatcatcatggtgtgacccagctaacataacccttgctatct

SEQ ID NO: 56661 - DNA, 312 bp, Triticum aestivum
  Clone ID: PAT_TA_56661
gtcgatattcgctgcaccggcgaggcggatggcgcgcaccgagatgggactggcccgaccagacgaaggggaggcacttcgttgactttttgaggcaagggagtaggacgaagcaaatagggagagcagatcaaaggtgcgagtggcacgtatcggacggtcaaggtgcgaccggtccaaattggttgctgcggacccgcgcctagcgctgtccagagaagatgctgggggatgggctcattggagtttgggttcgggtcctgcggtggtgtgtgatgtgtgcgtggtgtgttaagaccctgttgggtggtg

SEQ ID NO: 56662 - DNA, 763 bp, Triticum aestivum
  unsure (1)..(763): unsure at all n locations
  Clone ID: PAT_TA_56662
tgaaaatatataaagtatcatttactagtctttggtctattttgcagaaatgtgcgcaaaggcactataaatcttcaagatccggactaagtggctaagagaacgaagaagaggaggaagaatggacttgtgcaagaagaaacgaagtagccaggggggcaactatagaagcgaggatctacttgggaagaaagaagaaaggtggagggccaaagtaaaaaaagacagatcagatcacgggggatcaaaataactagcacgcctccattccccatcgggcctggctacacatctctccctcgcccctccttctcctactccgaccgccgccacggctaggccggcgtggtggcgcgtcatcagctcctccccacgcctccaccagctccaccgcgccatcttcaccacccaccacacgcaaccaaatccatccaccatcgccaccatctccagccaccgccgcacctcacgcgcctgaccagacaagagggtcacgggcgtctggtcctctgcgtgaatgcctcgtgctgctgatcttcttctcctcaccacgctgcttctcttccctctccatctctgctgctgttcttcttccccttgctgctgctgcctcctctncgttgcatctcccttagcgctgctgctgcttctctcttatgcgtcccctgctgctcctaactttctcaatctctgctgcttcttctctgggaccccttgctgctgcttctctctgacccgaactgttgctgctccctctcgcacg

SEQ ID NO: 56663 - DNA, 625 bp, Triticum aestivum
  Clone ID: PAT_TA_56663
gtcagtgcattgggtaagagttctattttcagcatgaagcaacaattggttcaagctaaatgtttttcatcagatcaaacgagatctgccaatatggaaaaaaatgcattttaaatttgtacgctagtttgccatgggcttcggtagaaaacaacgaaaatgccttggtgttcagtagtgctcaaatttgggtaaacagtctagacatgcacaccctttgaatggaatagggaaaacagacagaaggttatggtcgtatatccagttatactgttgtaagcaattgaagaattgactagtttctgtcagttatgagttagccaggtttaatttgggatacattcttatgatattaacttgcaagcagccaagcagttacgttgccagactggaagagggtgccaaactggtatactgaccctctgcatgttatgaagattgaaaacacttttgttgtggtcatgaagtgttagacgttgtaggctgaagcctttttctatcttacagaattaatgcatctcccgtgtgctcttaagagaaacataagtaactgtgaacaccatttgtaggtgaaatgtttatgcagtcaatcctcatcatgcaaccatggttttaaattcggaaa

SEQ ID NO: 56664 - DNA, 720 bp, Triticum aestivum
  Clone ID: PAT_TA_56664
atcccttgatcgaggttttggtcgctgcatagcaataaaaagtacaaggtcactatgcagaagtatggaaataatatatcagaaaagaatgttaaaccggagagggataaagatggtgttttgatgaaaaagaatatgcaggcattggatgaagatggatttgcggcaccaggtcgaataatccacaatcatgatattcatgtgaataagaaaactcccaagataattcctgatgatactgcaaacagtcctgccgttagattaacagacagatgacaattgttatttttttgtgcttctttttagcatgctccatctattttttggctccaaagttttgctgttcaagaatgttatatgttctcagtcgcttcaaacattattcacccagggattacaaggactcacctgctgtttaccgaggtgatgatgacgaaactactgtagtagatcgtgtaatactttcatcagatacaaatgaccaattgaccattaaatgtatgatccgtcacacaaggaggccagaggtcggtgacaaatttagtagcagacatggacagaaaggtgtttgtggtaccattattcagcaggaagacttccccttctctgagagaggaatatgccctgacttaattatgaatccccatggatttccaagtcgtatgacaataggcaaaatgcttgaacttgttggggggaaggctggcgtgtcgggtggtc

SEQ ID NO: 56665 - DNA, 672 bp, Triticum aestivum
  unsure (1)..(672): unsure at all n locations
  Clone ID: PAT_TA_56665
gggggccaagaaggggaagacccttctgccggactatgcctccgatgccgaagacaacagggaggaatggccatccagggtcaagcccctggcaaaatcagttcagctcggcgattcgtcgagcggctctctgaattcgtcggatgtgaatagcgcttcacttccgacggcttcctccccgctccctgcggacgacgccgaggcggagtcccaaaagggaccgaaccaggaggaggtgatcctggaggtgccccaaggtgacctccccgactccaggcccacagggggcaaagccccggagggatctaagtccggcccagggccggacactgcaccggaaccaccaatggttccagagtccgacaggcggcgccttcataagaagggcgagcctacgccgccggcgacctccgtccattcggaggcgccggacatttgctgggnaggcgcttaacggcgcctccatcgatgagcaacactgcactgttatgagtgcggtgattcaaaaggttcagtccgccaagagcgggctgacagaagcctgcacgtgtcttttaataggcttcgaggctgcactgctgacctctgccgcactgactgcggaggtcaatgcattgaaaggaagcctcgagcggtccgagagcgagctcggccgtgccaagaagcagctcg

SEQ ID NO: 56666 - DNA, 611 bp, Triticum aestivum
  Clone ID: PAT_TA_56666
ggagagacgtcgggagctgctgacctgaccgcgcaggcggagacccttgcgatgccactcactgagtcgctgcaggtggtgcttgcggatgaaaacgcccagtgaccggtccacagccgtggaggaaaggatgctgattcgatggccgttgagattactggcgtctctgacaatgaccctggaactgtgggaggcgatttgacgtcggactcgatcatattgcaacgacgatgtcaagatggaggcgggctcgctggactcgcgtggattgggaacccttactatgaatggccgatggcggtgacggggggaccaagatcaactggcacaatgcgccggagctgcagggcgcgatactggaggcggagaacgcctagggcctcgtagaccggatcacgctcagcgagcagatgggttggggccagtttggcagtatccgttcctggtccgacatggctaccggcgaggtgctggacatggagtccatcgccaaggaccgggtgacctccacagacgacctgcggggcgcacggctacagatggaggcattggcacgactcttgggccaaccgatgttgtataactgaatgcggagcacgacgaccattact

SEQ ID NO: 56667 - DNA, 681 bp, Triticum aestivum
  Clone ID: PAT_TA_56667
gcagtccgccggcgccgcaggcggaggagacgcggctaggatcgaggagcacgagccatcgccgccacctacccatcggcgctgtgaacgaagcgacaagagagggaggtcgtcgtcggccttctaaatcccgcttttcccccgtcactccccctcgcgccgtccccgcctcgttcccctgccacctctcatagtgccatcgccgccccatctcctcccacacttctgatctccgagctcgagatgcagaggcgcgccggtgctcgaccagatcaacacggttggtctgctatttgcaggtgatcgttggtctggccggttcattatttgatttgtgccagcttgctactcttcgtccacaactttgcaggtcgacctcttttcttctccccttctctgcttttaggctaggcttgaatttttgcagccatgtattttccttagattgcctgtgtagagctgctattagattcggtttatttttgcctgtcgtttctgttggtgtgcatcctggtcaatgggtgtgtttgtttcttgtactcctatattggtagatggctagagtataagaatattattccctgcttgtatttttgtggtctccttttcgtctgagcttgttttttgtgtgtggatataggtatgtggtttttttgttccttccttggatcctggtagatt

SEQ ID NO: 56668 - DNA, 738 bp, Triticum aestivum
  Clone ID: PAT_TA_56668
caggcaactagtctagtggctgcctagctcccatacagtctggccacaaattggtatgaagcagacttgtttgaacgggtctccttgaacccctgatggactgggactttgaccgtagactccgtggggctagtagtatggccaaccatctctagtagtacggtcaaacatctctggtagtatggctcgggcacataggtaaaaactagtaacacatggataacaagcttccacgcacccctgtccaaagccaagagcagaatatgaagattttacttgcatcctcaccataactattgcattttcagacctttcttccctatagctgactgcaaatgccagctgccagtcaatgttgtcccctatgcacgtttgaattaactctgtttctgcacactagaaggttgcctacgaataataccggtcgaaattgtcgagtagaaaatggattcgaccctgcttatatcacaaacaaacatgactgtaggcaaatatatattacttccaatcatgtctagacttcactaatcattgctttaacataatttgttttgatatggcagtccacatgcttgtatgcatagggtattcaccggtagatggaacgtgggtgtaatcctttatactacctctgtaccaaaatataagatgtttttgcagttcaatttgaactacaaaaacgtcttatattttgatacgaagggagtagatttttatgctcacacctcatacaactat

SEQ ID NO: 56669 - DNA, 728 bp, Triticum aestivum
  Clone ID: PAT_TA_56669
ttttaataaataaaattttgtaaaagttggtttctgggtggatgtaggatcatagtgttgaaagtttggaatatctattttttgttactgaattggaacatctttattgatgatctacatgagctactatcaatatgtctaattgtgatttaaatgtaggtgcgtggcacacgagagttctttatgtgacatgttccttttagatttatttgtcatgtgtcacttatttatcatttttttaaaattagtttctagtacatacctctgaaactacagcaaatgtacaactccctactattttactggctgttatattatgtcatattgtgcttaatttacacaattcaggttgaaccaccattgcagcaaagattatgagtacagaagtcaatgtaaaattatcaaagaaatttgcgagagtcttagcaatgctaccttctgtccgagtatctgagggcacttggtcattgatgattcagaaagtactgattggtataaacaatcttctgaacgatgcctttgttgggctggaagaagaaaagaaagggcgtgagattatgatgcttctagttccacctggtaatgatcctccaccagtgttgggagatcaagtaaagttgggaggcaatctgcatgtgacaaagaaatttcgtgtcttcactgttcctaccatttcagcccttgcccattgctgctgcatgatgctgactagttattacccggttcag

SEQ ID NO: 56670 - DNA, 522 bp, Triticum aestivum
  unsure (1)..(522): unsure at all n locations
  Clone ID: PAT_TA_56670
cactgaccaagtttattagtatgtgatcctacatgtcggggagactgaatggaattttaatgacaacatactccctccgtcctttgaagagtgtagatgacactgaccaagtttattagtatgtgatcctacatgtcggggagactgaatgaggggagactgaatgaccgagtgtagatgacactgaccaagtttattagtatgtgatcctacatgtcgctccattaattcttctaggtaattcctgtatgcttaactgtttcctcattcagtccaataacgatgacagattcgaggtggtatcctttgtagctgaaggaaaagatgtatgcaagggtgtattccatatactgttatatctttgtgtcattataacatatatattccttcagtgcttaaaatgatctcattgccagtatgtttacgacgatggatactctcactgtattgcataattgatattcagcactaagtgctnnnaaaaaaaaaaaaaaaaaaaaaaaaaannnnaaaannnnaana

SEQ ID NO: 56671 - DNA, 679 bp, Triticum aestivum
  Clone ID: PAT_TA_56671
agttgagaaaaatattgttgacaacaaagagccttttgatagaagaccttcaaataaaggtgcatataagaaaaacacctttcaaaaagaggaggtggttgccaagccagttttgcacccgaagaagaggaaagcctctcctttggttcaggatgctccagtagcatcagtgatacagatggctcaggtggctgaggaggttccagtggtacaaactgctatgggaatgatgagagatgaacaaaaggttgctctaagcgtaagactacaatcatatggtggattcattccagaacatgtagttgagttcataaagaggcatgttaatgatgataatgatgctgatgaagatgagttgactattgacatgaacgctctcagtgatgataccctgtttgaattacagaagcttcttgatgactatgatagagtaaatcagtctggaaatcctacaaaagatgagcctcaagaagttgagttccaaagtgaatatggacttgccaactcatcaatgcatcatgaaggcaatgagcttgttgaggaagacattgatattggtgggaacgatcttccacctttaacatacccccctgtggtatttgaaagtgaaacggcagacagaagcagcaagcatagttcttctagcagttctagtagtgagtcaggatcatcctccagt

SEQ ID NO: 56672 - DNA, 671 bp, Triticum aestivum
  Clone ID: PAT_TA_56672
gttatggagtatggcgacatgaccttcaaggatgagaagctttacctttatcaaggtttcaatcctgcaaacaccaacattacaaacaagctatttttgcaagccccaaaggctgcaatcaaccaaagagacgcagatcttcttttcttgtggaggaggtatgagctgctacatggaaagtctaaagagaaggcgaacgttctgacggagatcagtgagacagtcgcccacaggaagcatcttgacaacagcatcgattttattgggaagctcctatttggcttcgagaatggaccttcggagcttcaagctgtcagaccttctgggaagcctctagtggacgactgggattgcctgaagaggatggtgcggatctttgagtctcattgtggatcgctcactcagtacggtatgaagcacatgcgagcatttgcaaatatatgcaacaatggtgtttctggcacgacgatgaaggaagcaagcatcaatacctgcggcggtcacaactcggcaagattgagcaccttgatccaagggtacagcgcttgatcgatcagtctgctgaggtacatactagtatgttccttgtcctcagcttacgcgaatgtgaatatgtagtattgtattggattgtactggtagtgtatcctgaaaataaccttggggccggc

SEQ ID NO: 56673 - DNA, 598 bp, Triticum aestivum
  Clone ID: PAT_TA_56673
attaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaaaaaaaaaaaaaaaaaaaaaaaaggggggggccgtttttaagggtccaatttttccttccgggggttgggaagttttttttttttttttggggcccctaaatttattttcttgggcgggtttttaaaacgggggggttgggaaaaccctggggttccccaatttttttgcttttgaaaaatttccctttttcccagttggggtttttacaaaaagggcccccccgtttcccttttccaaaattttgccccccttgttgggaaatgggacccccccttttgggggccttttaaccgggggggggggggggtttccccccagggggcccttttcttttgcagggcccttaggcccctttctttgggtttttttcctttttttttcgcccagtttgggggtttttcccgggaaggttttaatggggggcccccttttggggtcccttttaaggttttttgggcccttgaccccaaaaaactttttttggggg

SEQ ID NO: 56674 - DNA, 673 bp, Triticum aestivum
  Clone ID: PAT_TA_56674
gcgcagtgcacgctcggcatcgtcgtcggccatgtccgcccacctccgcctcctcaccgccggggccgcgctcccgttgcccgccccggcctccctccggcgggcgcggctgctcccgcccgcgcccccgctcccctccgcccggctcctcgccccgcaccggcgcggcctctccccgcacgcggccgtccgcgtcgtccgatgcgccgccgcggcgggcgcggccgacgggggcgagcgggaggtgggggtggaggcgatagcggcggacggcgcggggatatgggcgcaggtgcgggacgtggtggtgttcgcggggcccgcgctcgggctctggatctgcggcccgctcatgagcctcatcgacaccatggtcatcggccagacctcctccctccagctcgccgccctagggcccgggaccgtgttctgtgactacctgtgctacatattcatgttcctgtccgtcgcaacctccaacatggtggccacctccttagctaacaaggatgaagaacttgcacagcatcaagtgtctacgctgctatttatagctcttacttttggtataggaatggttttgttcactaagatttttggggttcaagtattgactgcctttactggatcaaaaaatcatggaattatttctgctgctaatacatatgcacag

SEQ ID NO: 56675 - DNA, 690 bp, Triticum aestivum
  unsure (1)..(690): unsure at all n locations
  Clone ID: PAT_TA_56675
ggaccttgtatgaaactaagaatactgctattgacgttgatggaaaatttggtggaatggtggacaacagagtcaagtgaagaaacaaaagagtttctgatccctaatttgcatcatttggagataaaggactgcccaaggttgaagttcctaccatatcccccaagaagtatgaattgggttttgagcaacagcgagacagttttgccagaacaaggatttggaaagctctcgtcttccatccgtccttctttgatggttctaaagaggtgtagtttctctcaagacaagtgggatagacttcaacactttcccacccttgagaaatttcaggtaatctcggccagtggattgaggactttgccagtggtcatgcgaggcttcacctctctcactgaactatatttgaagtcattgaagttcttggaggcactcccggtatggttcggtgacctcgcttctctagttgaaatttcaatcgatgattgccccaacctgacatgtttgcctgaaagcatgaagaacctcactgctctaagaaaattgacgttgatagagtgcanaggcatggaaacattaccggcaccgttgggacattaacttctctagaagaaattttaatcggcgattgccacaacctgacatctttgcctgaaagcctgaagaccctctccgctcttaaaaccctga

SEQ ID NO: 56676 - DNA, 277 bp, Triticum aestivum
  unsure (1)..(277): unsure at all n locations
  Clone ID: PAT_TA_56676
attggagggagncagacgctnctccgacagcgccaccgccgctgctccggcgggggcggcggagaggggagacgggggaggtgggatggcggtgaacctcttcaccgccgtcaaccaggcgctccacatcgcgctcgacaccgacccgcgctcttatgtctttggagaggatgtgggttttggcggcgtttttcgctgcccttctgggcttgctgttcgctttgggaccctggcagtgttcgttgctctgttgtgtggtctgggtctgggcggcttt

SEQ ID NO: 56677 - DNA, 653 bp, Triticum aestivum
  Clone ID: PAT_TA_56677
agcacggaaggcacgagcaggaggagcagggccgcgggcatggccggcacggcgagggggagcgtgaggaggagcagggccgtggccgtgggcggcgcggccagggagagcgtgaggaggagcagggccgtggacgtgggcggcgcggcgagggagagcgtgatgaggagcacggggatggccggcggccgtacgtgttcggcccgcgcagcttccgccgcatcatccggagcgaccacgggttcgtcaaggcccttcgcccgttcgacgaagtgtccaggctcctccggggcatcaggaactaccgtgtcgccaaggcaaggaggaggaggagaagtccatctccatcgtccgcgcgtcagaggagcagctccgcgagctgcgtcgccaggcgtccgagggtgaccagggccaccactggcctctccccccgttccgcggcgactcgcgcgacaccttcaacctcctggagcagcgccccaagatcgccaaccgccatggccgcctctacgaggccgacgcccgtagcttccacgccctcgcccaacacgacgtccgcgtcgccgtggccaacatcacgccgggttctatgaccgcgccctacctgaacacccagtcgttcaagctcgccgtcgtgcttggaggcgatggcg

SEQ ID NO: 56678 - DNA, 659 bp, Triticum aestivum
  Clone ID: PAT_TA_56678
gcctcctcctacctgtcaccgcctcgccgctgcagccatccccaaggtgagaaagctatcaaggctagggttcaccggaaaggaagggaaaaaatccccattccctccggcgtctcttacgccccgctgcccgcctactcttccttccggaagtatcgtcttcatcctcgacgcagaaggatagcacagactgcagagatgccctgccgccatgctccttttcgctgatccccttccaccagattggctgatgaggggaggtccaataggtccatggtggggatggagcaacgaggccggagacccaggcgacagatgcctcatgggtagaggagaggttgacaatacggacaaggagcaacagtgtcatatggatctgcagggaggtatcttcgagggatggctggtgtcaatgttatgcaattttggagttaacaaatctgcttagttatatgtatattgatttgtgttgatatgccctacatatcggtttcatcgtccaagcaccttctgcagaaagaaagaaaaaggctttcaacaattacagtcagggcagtctgctaattgtatcagcaacatatactgcaccgtggaccaccgggtcaagaactccagcttggaaaagtccctttatcatgccctactcattgacagctacc

SEQ ID NO: 56679 - DNA, 319 bp, Triticum aestivum
  Clone ID: PAT_TA_56679
gtttattgtcaggtttctgatacttggggggccgcgctctctagacatgacaccctcgtgctgggtttgcaatgggctagggtgggttagacggggggagcggtgacacagtgctttgataggcggagtgcattatctgttttggctgttttggttgttgtgatgatcaatatgtggagccgtgagcttggcggatgacagggtgcgaacgtgtctcttttgaagactgttttctaggtctggatgggattatatactactctgacagcagcgttgttattggttgttgcgggctagtctggacgcctttggatgatct

SEQ ID NO: 56680 - DNA, 159 bp, Triticum aestivum
  unsure (1)..(159): unsure at all n locations
  Clone ID: PAT_TA_56680
ggacacgccccgagcgaaagacgaggaggngcagcactcggctgaggacattcgggctggtgacgccacactccacggatgttgcagagaatctaacagacaccgcatacgctgccgggggggggggtgcgcagctcatacagtcgttgcacagagacc

SEQ ID NO: 56681 - DNA, 328 bp, Triticum aestivum
  Clone ID: PAT_TA_56681
ggggatatgagacaagagagtgaattcttttcacttgtatcatcttggccctgtattaaaaaagagagtctgggactattataggggtcttattttgagaaatattataagggactatgggacggtgcgatcagttgctaccatggttatcaatgtattcgtgagtaattgcaggttttctttgccacaaaggcgcacacatattgtagtaagccacatggttttgtagcttcaggcatgagactaaaaccgttctctattttttccttaattgcagtcagcgggtaccacatatttcttttgatagattgggacatggttctacttt

SEQ ID NO: 56682 - DNA, 519 bp, Triticum aestivum
  Clone ID: PAT_TA_56682
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaataaaatagggacacctaaaaaaaaataaaactggggggggccctttttaggggcccctgtttaacccccgggggtccccaacttaatcttttttttttggggccccctttctccatttccgggcccaccttttacccccgcacggttgggaattccctggggttccccatctttattgcctttgggaacccccccttttccccccctttggtctttacgaaaggggccgtaacgctccccttttccaaaaatttgcccctcgggatgggaaaagggccccccccttttttgccttctttacccggggggttgggggggtttccccccaagggcccccttcctttgcccccccccttaccccccgtccttggttttcggtcccttcccttttaaaccctt

SEQ ID NO: 56683 - DNA, 561 bp, Triticum aestivum
  unsure (1)..(561): unsure at all n locations
  Clone ID: PAT_TA_56683
aacccatcgtcttctcctacttccctctcttattcttctgtgcctcggcgaggtgggncaagccggtgcacacacaaagggtggttgcggctacggctccgatgcgggcgccgtggaggtggagtcggagctgcagcagaaggaggtggatggccgcgacaacagctttagcttcgatgagttccatcacctccattgctatctcaggcttgtttcgttgcttgcttgccgttgggtccaatcaaggctctgttttggttgcctggttcgacggttccactctgcctgcgtcgatctggcatctgtttggattttggatctggaacatttaggaggttgttctggattgctacgctctgtagtgacaggattcgtgtttcatatcttgcaagagatgaaatcgagaggctgatgtgaattcgtttgtgtgtagattttgtcagttataggatgggatgtttatgaagttttttttactgtnctggnggttagccgattggtgtatttgattggttggtccttttgtgttggttgntggtggngtgatgnnntnngaattaa

SEQ ID NO: 56684 - DNA, 588 bp, Triticum aestivum
  Clone ID: PAT_TA_56684
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaaggaaccaaattttaggtccggggggtgggaaggtaaaattttttttttggggcccccaaatttaatttccggggcggggttttaaaaaggggggggggggaaaaccctggggtttcccaatttaaatggtttggaaaaaaatccctttttccccggggggggaaaaagaaaaagggcccccccgaatcccctttccaaaaattggccccccttaaggggaaaggggacccccccttgtaggggccattaaagggggggggggggggggtttccccccaggggaacctttactttggcagggcccttagggccggtttttttggtttttttcctttcttttttccccagtttggcggtttttcccgggaaggtttaaaagggggggctccttttagggtcccaatttagggttttaggggcccttgccccaaaaa

SEQ ID NO: 56685 - DNA, 629 bp, Triticum aestivum
  unsure (1)..(629): unsure at all n locations
  Clone ID: PAT_TA_56685
ctgggtgaagagctggtgacatggctggtcatacaacgaactgaaattccgatagcggcaaatgaagccatcaaaatgacgagtctgtgatccctacagaaggaaaggttcaaaatcctcatgtatcaagtacagtggtacagttcaagggcttaagtatatatggagaaccgaaggccttcgtagacagtttaagggcaatggaacaaactgtgcaaggatcgtcccaaattccgctgtgaaactcttcagctatgagcaagcgtcaaggtgtaagttacaggtcaacagttaagatcagcctgaaatgaaaacgaaccggaggaggtccgtatcttataccggccagaaaacgagcagaaacgctaatccaaacagggccttaccggtagcagactggggattagaatgctcagcctagtccactcttgcgccttggagctggagccacagctggcatcatcgccatgtctgctgcttatcccatggatatgttagggggtngagaattactggttcagaagaagaagtctccccgtgnggtatggtttcatgcatttggacacagntgtactggtgaagaaagctttttcagtgctctatacagagaggagggcttccgtcattga

SEQ ID NO: 56686 - DNA, 516 bp, Triticum aestivum
  unsure (1)..(516): unsure at all n locations
  Clone ID: PAT_TA_56686
ccccgcgtccgcccacgcgtccgaattcacccgacgcgcccgccgtcgcgcatcccgttcatccccaaccgccgccgcaccctctggaggcaaaagccaacccccgcgtgctccgtcgccttccccgccactccgggggacgccgcggccgacggcagcgctccggctcggcgcaactcctccgcgcccccgcctgcgcccgccgtctcttccatcgctgtgggacgccgcagccagctgttcgggggaaggtagcggcaagaagcggcggcgttgccatcttcacaggagcgcgccgggagaactcaaaactcccaaaccctcgctcctactttctgagaccgcgcgatggcgaggcgagggctggcggctggcgccggcgccgnctncagggttcgattcgngccgtnctccaacaacctgatagtctcctgctgggactcggggctggggttgtagatgcggacaaatccattttccggctgtgggcgaattgcgaggcagcagtttcggact

SEQ ID NO: 56687 - DNA, 107 bp, Triticum aestivum
  Clone ID: PAT_TA_56687
ccggcacttactacactagtgtgctgctaataccaaccatatgcgtatataataaaggtattctacatatgtctacgctctatattgctaaacatcttgaaaaatat

SEQ ID NO: 56688 - DNA, 696 bp, Triticum aestivum
  unsure (1)..(696): unsure at all n locations
  Clone ID: PAT_TA_56688
ccatcgttctcgattcgatctcttccacttcagagtcggtgagcgacaggcactgaccttgtccgggaagaagcaagaagcaaagaagaagaaagaagcaaggcagtagcaatggcgggcgtgggtcgtaacatggtggcgccgctgctggtgctgaacctcatcatgtacctcatcgtcatcggcttcgccagctggaacctcaaccacttcatcaacggcctcaccaaccgccccggcgtcggcggcaacggcgccaccttctacttcctcgtcttcgccatcctagccggggtcgttggcgccgcttccaagctcgccggcgtgcaccacgtccgcacctggcgcggggacagcctcgccacctctgcgtcccctcgctggtggcgtggggcggtcaccgcctttggcgttcgggctggcgtgcaaggagatccacatcggcgggtaccgccgggtggcgcctccgggtgctggaggcgttcgtcattatcctggccttcacgcagctgctgtacgtgatagcgctgcactctggcctcttcggcaacagnttcggtggtaaccatgctggcgggtatccggcggagcacgcgtacggcgccggcgacccgcacaacaagggaatgggcaccggcggcgtcgccagggtctgaatcgggtatgctccatcgcctcaatcgcggtgacagtgac

SEQ ID NO: 56689 - DNA, 505 bp, Triticum aestivum
  Clone ID: PAT_TA_56689
ctcggtctaaaacgtgacacggccgatgtggagaagccaagaccatcgatagtgcgggcgtgcaacctcataatgtgctcgtatactgaccgcttatgtcatgttcctggccgagatgataccacagggaggagctggaaacaacacgtaggcgctgcccagactcaagaactcttgctactatgctgatttatccccatcaccgagaagcgaagaggccgggacataccgcccttgccacctgttcatgcagtccaactgttgagtgggacgcaccttgatccagcacatgaagcgcagggggagcgaggagtacactgacatggacacgatgaatggtcagttgcctagcgacactgcctaacgcttggactagatgctttttaccgacgcggagagcatcatgaacgaccttgcttagtagtaccatcacttccaggatgccactgacgactaggagggtgactacaacgatgaagatcaagaagcctggagaggacatgta

SEQ ID NO: 56690 - DNA, 656 bp, Triticum aestivum
  Clone ID: PAT_TA_56690
ctttctctttggtgctgggaggtaagagatctgaaggtactgcctgtgagaacgcgtgggtttttaagtgtgcggagaactgccagaaagaaaatccatgagaggatgactgctctccattcaactttgtcagctctggaatctacaggagctgaaggtcaagtaaatgaacttagaaaagtatcaacaaagttaagcaaagcactgaacctggaagggattagatcaatggtggaaagagtgacacaaaagaacaacattcaaaggggtgccaaagatgtagaatcaacagatcagtcaatgcaagtgatggaaaataatgagggaactgttggtggagtagatgctgtgaatggctctgagctgccaaatggaaatgctcctgctaatgaacaatcaattctgaaaatgcaaaaacaatcccagaaggaaacaaaacgccaggagaaagaggaacatcagatgatgaaacagcaaaagaaaatgcaagaagaggcactgagagaacaaaaaagacgtgaaaaggaagaagctgaagtaaagaaacgacaaaagaggcaggaaagaagaagcactgaaagagcagaagcgccgtgaaaaagaagaagctgaaatgagaaaacaagaaaagaagcagcaagaagatgcactgaaag

SEQ ID NO: 56691 - DNA, 603 bp, Triticum aestivum
  unsure (1)..(603): unsure at all n locations
  Clone ID: PAT_TA_56691
gacgcggccacctggttggcgtcaacggcgagcgtccgacaggccgtcagtctcattcagttttctgtcgccccgccctagatgaaggtgttgtgttagctgatggcacggagctcgtacctgcaactattgacaaagcatgttaggtacaggaatattgaaagatgactggcgaagtatggtacatcccatgggacaaaatcaatttaccttctggtgtcaccgctctactgaaatcatccatcaggactggcccagcattgtctattccgaggtcatatgagggaacctctgtgttaagcgctgcattagggccatatacccattgcctaccatctgctgctttggcctggattggcatttgttcatgcaccacagtgtcatttgttacttcattgtcttggtctgctgccgcgaccagtccttccagattcttaatcgccgggacaaatggccgaacgtggtgaaaatggcgactcttctccggactcttcaggtggatctgataggcatggtcagaaacaaatcactcagcatggatcactgcacgttcgacctatatgatggcactgggtccgttaatgtatacttntggtttgatgg

SEQ ID NO: 56692 - DNA, 664 bp, Triticum aestivum
  Clone ID: PAT_TA_56692
ctcccgcggcaaagcttctgcgaaaaaaaactatccttcgagacgctgcacgacggcagggatgcatagctatggcgacggcggaggcgacaggcgagggcttggagttcctatcggagccagtttacaggtttcctctgccagatctcaccgccgatgaatcgctgctgaccggcggaggcaaccaaactttcgtatgcacggctaccgaatccagtatcggtgatgtgggcgatgcggcggtgacatgggaactagatttgcagagcgaatgcaatggagtggctctgtccgcgccgaactcagagcagtcgatgggcaaagacgatcctcaggcgccgggctggaccaagagactgcgtgttgggcatgcacctgaagtcctgaagaacgccctccgtgtgctggcagaatgagtgctcttgaaaaaacattgagaagaaaactgactgttgtttctttgtggcatttgcaggggattccgaagaaaagcaacacccggacttgccggtgcaggtgccccgcgctcatacgattgctccgatcaaaggacaatggatggtacataagtgagttcataccatcacacaaccattcgttaatggagaagtgtggcgagaaggtgtactagccctcacagagacatatcgatatatacacatgt

SEQ ID NO: 56693 - DNA, 625 bp, Triticum aestivum
  unsure (1)..(625): unsure at all n locations
  Clone ID: PAT_TA_56693
cattctgcaggatttcttagaactgcgtaatacacgtatgagcgcctggatggttcagtacgtgccgaggaacggtttgcagcaatcagaaatttcagctctcaacctaccaaaggtgttgtaagagatgacagtaatccaagtggagcttttgttttcatgatatcaactagagcagggggtgttgggcttaatctcattggtgctgatactgttattttttatgagcaagactggaatcctcaggctgacaaacaggctttgcagcgtactcaccgcattggacagttgaatcatgtattatcaataaatttggtatcgcaacgcacgattgaagaggtcatcatgcgaagagcagagagaaaacttaagcttagccacaatatttttggagataaggatgcaactgatgggaaaggaaatgacttgggaaatgaagctaatgacatgcgttcgattatatttggcttacaccagtttgaccccgcagatacagctgcggaaacaatcaatgaggagacactgnaaaaattgaaatcaatgtcagaaaatgttatcaaaatgcgtactcatgaaccttcagaanaggatgaccgagcatttgaaatcaatccagatttgactg

SEQ ID NO: 56694 - DNA, 667 bp, Triticum aestivum
  Clone ID: PAT_TA_56694
cgactcatcagatgaatgctcttgagccagttctagtacctattataacgaggagacgatcaatttgttcgacctaagcacaaggacttctagagcgaattcagttatgggacaaactcatagagatgttcaaagtttcaagtcagaattgaagagaattattgattcggataaagttcatgtggaggaaagagatgcacctggtggtagtttttcaagcacaaaatcaagtacgacttcattaaaaatgctattagcaaaagagacgagtaaagaagtggagtcaaagagcaacgcaccaagtgtcgttgcaagattaatgggccttgaggatgattttcctgccaaagaaccagttttataccatgctaagagagattttaggaaaagtcaatcatgtgaccacttaacagtgacaaagaaggccgtgcagcagcaacagcatcagaattccatacagtccgttacacaagttatccatacatcctgtgaaacaattgaatatgatggtgtatatgaaaggatgttgaagagaaagccagaatggagtttgtttcaggatcagtcttcacaggaaggaagacattctgagagcaagagtggtagaatggatactgtcccagagaagttcaggcaaggaaaaagccttgccatggaagaaaagctc

SEQ ID NO: 56695 - DNA, 513 bp, Triticum aestivum
  Clone ID: PAT_TA_56695
agggcctcggcctggacaagatctccgaggggctcgggctcaagcaccacgccgacgaggaggaggccgcgcgcaaggccggccagaccgtcaagtccgcccgcgagaccgtccagcacaccgcctccggtacgtgtccgtggtgttcattgttggtttcttgggtggtcagagtgactggagtctgatgctgatttgtgtgtacagagacggggaggcaggcgagcggcaaggcttcggacgccaaggaggcggcggagcaggcggcgaccggggccgccaacaaggcggggcaggccaaggacaaggcggcggagacggtgaagggcacggtcggcgaggcgtccaagaagacggagcaggctaagcacaagaccaaggaggccgctggaggcggccgccaagaccggcgccgagacgcacgagcggtcgaagcagggcaaggctaaggttgaggaggcggccaaggaaaaggctggacaggggtacgagacgctgaagcaaaccaaggac

SEQ ID NO: 56696 - DNA, 614 bp, Triticum aestivum
  unsure (1)..(614): unsure at all n locations
  Clone ID: PAT_TA_56696
ccaaaaacacacaccatgaccatgccctctgaattccattcccagcccctgaccacaatcctactcctcctcgtcctcctttcaacagcatctcacttgatcctggaggctgttgctgctgagcatgatgagcagcagccgatcacacttccgggttgccctgacaagtgcggcaacataagcattccctacccattcggcatgaaacctggttgcttccgcgagggcttccaggtcagctgcaacgactccttcaatccccatcgtgcctacctcgcctacgacggagtattccagcggattaacgagatttacttcagggcgcagaaagggttgtgtcggcgtaatcgtgtttggaatagaacacgggaagatacggccttggagctcatcgatatatcagttgcaaagggtgaggcgcgcgcaacccccgcggtctcatctcgctgcagcgcaaaccataccgactccttaagcaaatctctacnggatgcggttgggagaaaagatgagcccgtttctcgtggtcggtgacgcgcaatgttctcatcggcgtaggctggaagagtccagcctaagatgaatagctacttgtggtcggcngtcggcgtcag

SEQ ID NO: 56697 - DNA, 196 bp, Triticum aestivum
  Clone ID: PAT_TA_56697
ccaacatcgtatcatatgaattccacggtagtaagatcgccatggctagcgctagccctcgtcctctccctgtgcctctccctctcgttcgagtacgtgggatgccgaggacgtaccgtaggggtagtctgacgtggtcggaagggggcgaccactaatggcggtcaacctccatctcctcaagagccatgccact

SEQ ID NO: 56698 - DNA, 455 bp, Triticum aestivum
  Clone ID: PAT_TA_56698
atcgcatcgtcgctgcctcccgagcgaggcagcccggtaggtcatcttcatcctggactggcagcctgatttcggcagctcattcttccacttgcaggtcccccttctctcttttcctacccctctcatgtttttggttcttatcctttttctgcatgtgtatgggtaaaccaatataatgcgattaaggtgttgcttgttaggatgtatatatctgtttatggccccctgccccgttcatattcaacaaatttagtaagtaattagtgtaatcatgattagccatgtcttactatttagtactaccaaagaaaaagtttataggaaaataagtgggagtgcatcctactccctccggttcccaaaaacttgacttccattttgtcccccaatagatatacctatatactataacatgtctagatacatccatatttttacacatggaaagcatg

SEQ ID NO: 56699 - DNA, 232 bp, Triticum aestivum
  Clone ID: PAT_TA_56699
gagggctaagatcgatcccgcaagacctagataagggagctcggaggagctcgagagcaccctgggtaggaggccttccagagcaggaggcggaccctcctcttccccgcataacgtaacgactccgtcaacaagagcaagatctacaacctttatggatgccgacagtcgctcgctgacggcctaatagagggccactgatgttatgatagccggcaagaatgctgtggcc

SEQ ID NO: 56700 - DNA, 562 bp, Triticum aestivum
  Clone ID: PAT_TA_56700
cccacgcgtccgcgaccatggacccctatgctcccgccgctcctcgcagtcccgtgtcttcccggcgcgccgatctgtacggcaggatggcgcgggaccttgacgagcgcggcgcggccttcttgaagggcggcgagacgtcgcagtccctcacgctctcggacctcttcgacatcagggacggcgccgtcgtgcccaggctcaaggccgccgacccgccggtgcgtgcaaacgtgctctacctggacccggtgttcgccgccgagatagcgaaggccgtgaaggaagtatttcttccttattttgataaagctatctggttccaaaattcgagcatgtatcacttcagtatgtttcatgcctcccatcatctggagccaatcttagcaaccaaggacgagattgaagccgaagtcgatgctgtaaaaagagttactgaggctgcttgtccccttaaaatttccttggatcgagtggtcttgacagcaactggaggttctttttggcctgtggcagggtgaatctggtactgatccttggcggctccgctccaaattggtag

SEQ ID NO: 56701 - DNA, 373 bp, Triticum aestivum
  Clone ID: PAT_TA_56701
gatcctgtttcaggtccaaaaacctgacagtattaggtacaaaggtgccgttgacgggctagaaggcttaaggagaacacaaggccctcccatcactgggtaaaggcagtgccaactaacctgccaagggttgtcccaaacgctgctgcgaaagcctagagctatgagcaagcatgaaggggtattttgtatctagtaccggcatcagactgtggctgacaatgctcagatcagcccaatctcgcgccttgcagccggagccacaggccggtgccatagcgatgactgtcacttaccccatggatatgggcaggagcaggattactgctcacacagagaagcctccctaacagcaccgcgatatgtcttcatg

SEQ ID NO: 56702 - DNA, 726 bp, Triticum aestivum
  unsure (1)..(726): unsure at all n locations
  Clone ID: PAT_TA_56702
atttgagtagcaaaatgataaaaataacacaatatcatttaatcaggacaaccatatagtccaagggcatgacagacttttcactgaccatacaacagataagctgaaaaaacaggcactgaaaagaactgactagcttattatatggagcttatttccacaggagcttatctagagcttattttcacagcatagctcaaaagaactgccccttagtcagcaggaagcagtcattgcggacgcgtcgcctcctcttccccttggcgtcgtcctcctccggacccctccacctcgacaccccagccagcctcgcactcgcattcgcactgctccagaacccctgacccgctcccttcccttgacgcgtgcaggtctgtgacaatcgatcctctctagtaggcaccaaagtttcaatttcttttactcttcttctgctctaggtgggtgcattcccctttccctccctctcccactactgctggctgtatgacatttcttggtacaacctgatgctatcttcgtctcccttccaagattgggttttcaggnggcggttcttatccacctgctactttcgtgcattcctcttctttactagggtttcataaatgaatttatttatttattttttgtcttagaggagggttttgattgactaatgcaaaaacacatcttctatgcagcacaaatagcagtggggcatttcattaaaggaaggccatgatt

SEQ ID NO: 56703 - DNA, 693 bp, Triticum aestivum
  Clone ID: PAT_TA_56703
cccacgcgtccggaaattccagcctggacattctccgagcagagcagtcaaacacgaagcaagtcccaaggagctctccgaatctgatagagtacagttgatctgtcgaggacaaactaggattttgcatgataaccctgatcgtttagtgggtcctggtgaagttgaaaggaagagtcagcctgcaccaccacttcttccacatccagatggaaatcgaaacgatgtaaacacaaaggcagatacaaggaatacccctagtgaaaggaacatggtgcttatgaagtcagtgcatgataacagaggtcctaatcgtacaagccattcgtctgttttggaaaatgcacattcccatcccagggaaactgatgatggtgcccacctgaaaaagttgaaggaggataatcttccgcttgatcagcaacctatcattaagaagaatgcagctttgatagagaaaatagggagtttgaacaacaaagctagaaatgttgatgcacgtaatgttgcagaagcattttcaaacaaggaaatcaaagagaagcagctaaaaaatgctgattcaaaagcagaccgggtgataaaagatgttccatgtactcctgctatcactgcttttgcttctgcttctggtcagcaagatgggtttctcctcgttctcctgtggtacagaaactgcagaagggacctaat

SEQ ID NO: 56704 - DNA, 658 bp, Triticum aestivum
  Clone ID: PAT_TA_56704
cggacgcgtgggttcgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaaaggatccaggttttcttcccggggcttgcaaagtttttttttttttttgggggcccctaatttaattttttgggccgggtttttacaacgggggggggggaaaaaccctggggttccccaattttttggctttgggaaaaatcccctttttcccggggggggtaaaaggaaaagggccccccccgttccccttttccaaaagttgccccccctgaaggggaaaggggaccccccttttagggggccttttagcgcggggggggtggggggttccccccagggggcccgtttcttttgccggggcctttacccccgcttttttggtttttttcctttttttttccccccattttgggggttttcccccgggagttttaatgggggggcttcctttttgggtcccgttttttggttttaggggcccttccccccaaaaattttttatgggggggagggtttccggagggggcccct

SEQ ID NO: 56705 - DNA, 599 bp, Triticum aestivum
  unsure (1)..(599): unsure at all n locations
  Clone ID: PAT_TA_56705
cccacgcgtccgcgtctccacatagttacctacagtttctaaatgcttactgttccaattttccttgtattttttgtgtgcttcctgttagcccttaggcatcacaagcccagacatgtggaattgcctgtctccagcagtagcatttcattgtggtctggagcaagtgataaaggctttgatgtgcatgatcttgaactatataagcctaggcggtggcggtgcgtagcaataggaggctggtagggggngnagttttattttctgtttatctctattcttttctaaacatacatgacctgcgttcactaaatattcatctggactctttttcgtacaagttaatactcgtattagggctgctcgacgaagcgaagtgagccgctggtttgggttttccataagatggatggttaaaaggtcaaagcttggtcaacatccccgacttatttcagaaccaaaccttgtaaaattctaggaaaatgcaatcctggcgtcgacatggttcagtctcgggggtcaaactgcaaaatggcttgcaggccaccatagatcagatggtcttcatcggagaccttggccttggctcgtatgaaact

SEQ ID NO: 56706 - DNA, 254 bp, Triticum aestivum
  Clone ID: PAT_TA_56706
ctttcgcaccgcaccacccccaaaccccccagccggcgacgagccttatcccgcgccgacataaagctcccctcgcgcctggagtctggactccctcccgtccccacccgcctcgcctcgccgctgcgtccctctcctcccccggcggcgttttcttccgcgcccattggtcaaataaggttgacaagaatctcacactgcttgcttcagtatggataccagctgcctatcatctatcaacatagctggagcga

SEQ ID NO: 56707 - DNA, 665 bp, Triticum aestivum
  Clone ID: PAT_TA_56707
ccgtccctctgttcctctccccctctcacctccaagggtttaattccgagggtgactttcccagcatctccagcctgcctccggcgtaattccattccgcgtcttcgatgcgtggtgggcgcaatacgaactgcgcacagaccaccgagggtcttggcgcaccggtttctggccagccggctaggatgcagcaggttcagcacacggttcagacgcacggatatggactggccagaaagcacacatacgactgggtcgttcttattctcctagccgcggtcgtggtcgtcttgcattatgctcccccgtttaaccggttcgtcgggaaggatatgatgactgatattaggtacccggtgaaaccaagtactgtgccagcatgggctgttcctgtaatctctatgctgtgccctgtgcttgtcttcatagcactgtatgttgctagaagagacgtctatgatcttcaccacgcaacactaggtgttatttttgctgtgctgatcactgccgctttcactgatgtgataaagaatgctgtggggagacctaggccagacttcttttggcggtgctttcctgatggaaggccggtatttgatcaagtgacaggtggtgtgatctgccatggcgagaaagggttctttaccgatgggcgcaagagtttt

SEQ ID NO: 56708 - DNA, 327 bp, Triticum aestivum
  Clone ID: PAT_TA_56708
gcgccgctcaggtggagggagggatccacgggctggtgtcctacgagaagaaatcgttctagccccagctttaatcgaggccgtcgtaccggtgtcctacgtgttccatccaaggttggcagggggtcacctgatagtgtttgagagcagcctcccagctcgtccgcgtgggcgtggctgttccccctatcgatctcccgctaggatggttgtaacatcatcatctttccaccatcgccatggttgaaaactttggacatcgtaagaaatggctgtaacaataaaagggatgtttccgtttgctacactgcgagtggaaaggaaaaa

SEQ ID NO: 56709 - DNA, 595 bp, Triticum aestivum
  unsure (1)..(595): unsure at all n locations
  Clone ID: PAT_TA_56709
gccgttccggtccgcgtcctcccccgcgtgggtggcctcgcctcccccaccggaatccccgccgcgtcgcgggggccgtcgcggttgcacgagaggcggaaccgggggcccggccccgatttcaagctggccgcctccgccgccaccgcgccccgctccgcgtcgccgtcgatggcgtcgtcgggcggggacgagtcgccgtcgccggccaagcccgtgctcctgcacggggacctcgacctctgggtcgtcgaggcgcggctgctgcccaacatggacatgttctccgagcacatccgccgctgcttcgcttcctgcggcaccgcctcctcctgcgcgcccagngcagccctccgcccaacagccgcggcgtcggggaggccggcagccgccgccaccaccaccgcaggatcatcaccagcgacccctacgtcacgctctccgtcgccggcgccgtcgtcgcgcgcaccggcgtcatccccaacagccaggagccgggctgggacgagcagttcttcgtgccgttcgcgcaccgggccaccctgcttggattccaggtcaaggacaacgacacctttggggcgcagctcatcgg

SEQ ID NO: 56710 - DNA, 652 bp, Triticum aestivum
  Clone ID: PAT_TA_56710
ctgaattaaaagttctgttcccagacctgattctctagcccatggaccatgctcccagttgtcgtcgtcgtcatcatcattctgcacaaattcagatggaataacagcttccgtatcattgaccaattctcaagcatttgttcgcaaccctagtttctcacatactcaacggtcattggacaattgtgagcactcagtaggcagtaaacctttgtttcaaggagttgatcaggtgagcaatagcacaggatggcaagtagagttgtcgtcaaacatatctaccgagaaagggaaccccaccccgctacttcagaaagtactccaaaatggtcatttgtcagataacactttggttggtgtgaacatgcagaacaatgggctatcgccagtcctgtcgacagcacataatcatggttcgcttgatgctggattgggacatagtagacatagaaggcagctcacaagagagagaagtagcagcagtctttcaaggggtgagctacagcatgaggaacagcttgttctgaatggtgctgggtgttgttgagaggggttatttccaagattgtttcagaccctctgaattatacaggaaggatgcttcaagagatgacaggcaattctagagcatatttgagggaggccatttctg

SEQ ID NO: 56711 - DNA, 672 bp, Triticum aestivum
  unsure (1)..(672): unsure at all n locations
  Clone ID: PAT_TA_56711
gggagctggagaagccggtgacctgcatcgttgggttcggcggggtggggaagaccgccattgcgacggccttgtacaggagatttggggacaaattccaccaccgggcgatggttacggtgtctcagatctcagacctggggggcattctcagaagcatcgacggtcaagtcaggccgcaggcaagcaatgagaagcagcaaagcagctcggcggagagcggtatcaccgcagccatcaagggtgtacggggtcacatcagccaaggcacgtcagccgtcatggccaagtgctgcggcggcgccggcatcccggaggaagacagggcaaagctggatcttctcaagaaagacctcaaggatcacttcaaggaaaacagttacttgatcttaattgatgatngtgtggtctgcaacaacgctggacaatattataaatgcacttcccgaaaataaagacagcagaataatagtcactacacggtttcatgctgttgctacaacacgaagaggagnaaggtgacattcgtagagttaaaggtcttgggtgatgagcaatctgagaagttattttggcaggctttcttggagtccaaaggaagtgaagatgctattagacatgatctccttgatggcaacaaacctgctgaattacctacncaagctgtctctg

SEQ ID NO: 56712 - DNA, 580 bp, Triticum aestivum
  unsure (1)..(580): unsure at all n locations
  Clone ID: PAT_TA_56712
cccgcgcggtgctcttaggcagtagtgctactgcgacctcgcctgcgcagacggatggcgccccggtggtgcttcgcgttgctcctgctgctgtgtgcggcggccagggcgcgggcgggggccgacgcctcgaaggggaagtgggacccggtgatccggatgccgggggaggaggagcccgccacgggcgacgagagttccgaggaggaggacggcgtcgggacgaggtgggcggtgctcgtcgccggatcctccggctacggaaactacaggcaccaggccgacatatgccatgcctaccagatattgagaaaagggggcgtaaaggaggagaacatcgtggtttttatgtatgatgacattgccaacaaccctctcaacccgaggccaggggttatcatcaaccacccagagggcgaagatgtatatgctggcgttccaaaggactacactggagaggcagttactgctaagaacttctatgcagttctcttgggcaataaaactgcggtcactggagggagtaagaaggtcatagacagcanaccaaatgaccatatatttatctactactcagatc

SEQ ID NO: 56713 - DNA, 266 bp, Triticum aestivum
  Clone ID: PAT_TA_56713
tgtttttgtttcagttctttgttttttcaatccattgctttctagcagtcttcatgataacagagatttgagaaggatctctctctgtagctgtaggtgataacttttttgtactgaaactacaaaattatttgttctatctatgtcgtttctatctccactaagagctttcagcctgcaagcacccagttgtccttctaagttggcaggattgatgaaaccttttagcctgaactagcatcctttggatttgggggtgcatcatg

SEQ ID NO: 56714 - DNA, 595 bp, Triticum aestivum
  Clone ID: PAT_TA_56714
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggacccaatttaacacccccggcctgggggggggaagttttttttttggggccccaaaaataaatttcgggggcggggttttaaaacggggggggggggaaaacccggggggtccccaaattaaagggtttggggaaaaacccctttttccccagggggggaaaaacaaaaaggcccccaccgaaccccctttccaaaaggtgccccccccgaagggggaaggggacccccccttgggggggccaataaaggggggggggggggggggtaccccccaggggaccctttactttggcagggcccttaggcccggttctttgggttttttcccttttttttcccccccgttcgggggttttcccccggaaggtttaaaagggggggcccctttaggggtccgaattaagggtttaagggcccctgcccccaaaaa

SEQ ID NO: 56715 - DNA, 645 bp, Triticum aestivum
  unsure (1)..(645): unsure at all n locations
  Clone ID: PAT_TA_56715
ccacccacctcataaacctctggaccttcaccatgcacaccaagaccgtcgccatcgtcatgactgtggccaaggtctccacggccgtcgtgtcctgcgcgaccgccctcatgctcgttcacatcatacccgatttgttgagcgtcaagacaagagagctgtttctcaagaagaaggccgacgagcttgacagggaaatgggactgatacgcacgcaggaggagacggggaggcatgtcagaatgctcacccatgagatcaggagcacgcttgacaggcacaccatcttgatgactactctggttgagctagggaggacgttgggtctggaggaatgtgccttgtggatgccatcacggnagcggttcgagccttcagctaactcatactctgcgccacccgatcccgggtggctcgtctgtgcagatcaatcttcctgttgtcaaccaagttttcagtagcaaccgggcgatcatcgtgccgcatacgtctccgttggcaaggatccgccctgttcaaggccggtatgtcccaccggaggtggctgctgtgagagtccccctgcttgccccttttaactttccgaattatgactggcccgagctttcgggcgaaaagctacgcgattatggttttgatgctccc

SEQ ID NO: 56716 - DNA, 515 bp, Triticum aestivum
  unsure (1)..(515): unsure at all n locations
  Clone ID: PAT_TA_56716
gcactgccccgtccgtccttttcgagctccgcaactccgtctccaatccccaaatcggaaattttgttgatcttatccatctcgtcggcggcgagaagcatgtcggactacgtcccctcctccacccagatccaggcgctgaggcctcggtccctccgcggcgcgctctgcgtcaccctcgctctgcccggggccctgctcgtccgcttctccaggagcctgctcgccgccgtcacgctcacgtggctacccaggacctacctgcgcgtcccggtggacggggccgatcaggaggccatttcgccccgccgcgttccgagccccgtggagctcgatcccgcgcaggtggcggcgctcacggccgcccttcgcctcgccatcgtcgnccggggccnctctcggtcccctctctcgcccagcgccgggccgacgcgtccgactccgactccagcgacgacgacgacgaggagcgcggctgctctgttgatcaacacctatgggttccactcatccag

SEQ ID NO: 56717 - DNA, 667 bp, Triticum aestivum
  unsure (1)..(667): unsure at all n locations
  Clone ID: PAT_TA_56717
atcgccgccgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccnttgcgttcacttcttggtgtgaagcagatgatctgctgctgcaacaagatggatgccaccactcctaagtactcgaaggcccgttatgaagaaattgcaagggaagtctcttcatacctgaagaaaggtcggttacaaccctgacaaggttccctttcgttccca

SEQ ID NO: 56718 - DNA, 616 bp, Triticum aestivum
  unsure (1)..(616): unsure at all n locations
  Clone ID: PAT_TA_56718
gaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaaggngtattggtgactgctttggccgcaccatcaaggatgaaggctntggctcattgtggagaggaaacactgctaacgtcatccgttacttcccaactcaggctttgaactttgcattcaaggattacttcagnaggatgttcaacttcaagaaggacaaggat

SEQ ID NO: 56719 - DNA, 310 bp, Triticum aestivum
  unsure (1)..(310): unsure at all n locations
  Clone ID: PAT_TA_56719
cgccactgtaccactagtaccaccactacccccctggcctgctgctgcagctgctagtctcccctggtggcggctcgcctccctccctccctcctatccccaccgcccgcctccctccctccctctaccccaagctcgggccttgctagctagctatccgccgtagagagagaggagagggaaggaggccccggcgctccggttggttccgtcggatctcgcctccaggtcacccgtctgctgggatctcgcccgccccatggccgtcgtcgcgccgacccccgccccggccgccgcgccggngcccgcc

SEQ ID NO: 56720 - DNA, 672 bp, Triticum aestivum
  unsure (1)..(672): unsure at all n locations
  Clone ID: PAT_TA_56720
gcggccgtgagcgtggcgcagtacgccgtgcaggtggcctccaacatgatggtcggacacctccccgggggcgtgctggcgctctccgcctccgccatcgccacctccctcgcctccgtctccggattcagcctcctcattggaatgtcaaacggcttagaaactctgtgtggtcaagcttacggggccgaacagtacggcagattgggagtgcaaacctacagagctatggtcaccctgacggctgtcagcattccaatctcacttctctgggtattcatgggaaaactcctgaccctcataggccaggaccccatgatctcgcatgaagccggaagatacataatgtggttgattccggccctcttcgcatatgctgtcagccagcccttaacaaagttcttacagtctcagagtctgataatccctatgctttggtcctccanggcgacgttgctcttgcacattcctgtttgctggttattagtgttcaagaccagccttgngtacattggagccgctttggcgataagcgtatcatactggttgaaacgtgttcatgcttgtcgcatacatcggatgctcaaactcttgtaaggagacattctcgcgtcctacactcgatgctttcagtggagtggggtgggggttcatgccgcctagctctgccgt

SEQ ID NO: 56721 - DNA, 567 bp, Triticum aestivum
  Clone ID: PAT_TA_56721
aaaaaaaaaaaaaaaaaaaaaaaaaaaaaaaaaaaaaaaaaaaaggaaaaagggctctaaaggataacaggactaacgaacaacgaacaagcaacaggggagggccttctttagaggatcctgacattcaatacactgggccgcggacgtacaacgttcttgactggggaaagccaaaatccatacccatgtcccggggttttgcaacacatcgcacgtgtcaaaacctggcggtttcccaattaaggcccgatggcgaaaccccttccctcttgccagccggcgctgaacgggaaaaggccagcggaactgcgcccttcccaataagctgctaaagccggagggggtaatgggcaccgccactggtcgctttataatgcccataggccggggggtttccctttatggcgtccgtttttcgtgccgggccccgactgcccccttcttgcgttaaattccatgctttctttaccgtttccggctgattgttccagggaacctggaacccggagccctcgtttagggtgagggtttagggtttggggcatcctcctcccaaaagaattt

SEQ ID NO: 56722 - DNA, 609 bp, Triticum aestivum
  Clone ID: PAT_TA_56722
acgcaagtattattccattgatggaagaagtttgagtgagtacaagatatggtacaacacatgacacagatgcaataggtgtgaatatggggtctaaagcagaaagagacatgggttgctcagccaaacacagaaaacacagctaaactcgccatcctgagaagcagcctaaaccaacaagaagacggccatcctgagcagcagcctagaccaacaagaagacgaccaatgtctttagatccagaaccaaggacgccgcgagcaaacaagacaacgttttcacaaaggagaacgaggccgagacgccgttcgctgtccaaatccggagaaccggacatagggtttcccctgatgctcgaagaagcacacagataacggccgtagcagcgcctccaagaagggggacgacacccgcttggtgtcgccgccgccagcaaaggatgcattgggatttcacccttggccagattctaagcaatcccaagccgtcggagcacaaatcgaagattaaggaagtcgagcataggccgaaaccacgaccacaggaaatgggagccacgcccgccaccggatgcctgagtaacggagcagcaaagggaccacgggttt

SEQ ID NO: 56723 - DNA, 333 bp, Triticum aestivum
  Clone ID: PAT_TA_56723
gcggcggcggcggcggctacggcagccgtgacggcggcggctacggaggcggcggcggcggcggctacggcggctccggcggcggcaactggagggagtgaatggtggggcccctagctggccagttatcctagttaccgatccctttttttacctgtctaccaaagtgttatcgctcgctcccgagtaccctagatctcgctccatcgcgtaggttccgagatgttctggctaccgttagatgtgacgccgctaccgttccgtgttacttgttaccgtccctgttccgttcgctatgaatgaaatgaaaaatcagagcaaaagtttgttcgc

SEQ ID NO: 56724 - DNA, 329 bp, Triticum aestivum
  Clone ID: PAT_TA_56724
caacatgaaaccttaaattccggccaaaatgaggcgggaatctagagacaaaactcaacggaacataaccaaaaggccacccggcgcaggagggggggcatttatcttgagggaaacctcaacaagtaaacattgagagcccgtttagggccccaagatggtgaggcccccggcaaagggggcggctagggccttcgcaccttttatggggaagtccttgcggtgttttgggccctcaaacccgaccgcgggttccaggggggccacggtgctttggctggccagattttgccggtccggtgccccttgtgggacggggcacattcggg

SEQ ID NO: 56725 - DNA, 270 bp, Triticum aestivum
  unsure (1)..(270): unsure at all n locations
  Clone ID: PAT_TA_56725
cagccgaccacacgtgttgccaacgccaaaaagtaccggggttttgtaacatatgagcgagagggtgtttcttaccgtgatccaaatgagcgtgttaaagattggaacgaggnttgccatttggaaattcccaaggtttttttnccccccaagaggggggccccaacttggtttaaaaacacaccaagttcctgccttcccgtttggtaatggggattttgggtgggggcaacctttccccttttttctttgggtccctttcccaagggg

SEQ ID NO: 56726 - DNA, 632 bp, Triticum aestivum
  Clone ID: PAT_TA_56726
gcaggggagaggggcagagggccggaggcgatggggctgggcgtgagggcggcgccgttcacgtacgtggcgcacgcgctggccgtggtggccgccgccatggtgctgtactggtgcatccacttccgcggcggcctcgccttcgaagccgacaacaagaacctcatcttcaacgttcatcctgttcttatgttgattggctttattattcttggcagtgaagctataatgatatacaaggtactacctacggtgaaccatgatacaactaagttgatccatctagtgctccatgctattgcgcttgtgctcggtgcggtcgggatatactgtgcttttaagaatcacaatgaaactggaattgcgaacctttacagtctgcattcttggcttggaataggaacaatttctctatatggtattcaggtatgacttttcgacttccgatatcgtggcaattctctgttccatttatcaatctggttcatttgatcacattggttttacgtatttgtagatgactgtagttttttaaccttttatgagtccgctgacacagttcacttacagtagaacaggcagacaatatttaaagcatttactaaaggatgagtactggattactctaaaag

SEQ ID NO: 56727 - DNA, 367 bp, Triticum aestivum
  Clone ID: PAT_TA_56727
acgacaggcgtgtagtttggtttcggccgtgcatcgctctggtatggatacgggcgtcatgcgttttactcgattgtgcgcagaaggttcttggactctgttggcgtgtagtttggacagcggctcgtcagcttgtcccgtgttttgcagctggtgccactgcgtgtgcattttagtagttggccgccccgtgtagtttagttaatgtgtttgtatctacaaagaaggtttttgtttttgagcacgtacaatgtagtttggagcatgtgaacatccagtgcaaaatggtgcattttatttttgaggagtttatgtataaaattacagggactttatttgaaagtgttcagaaattgcagtttggagt

SEQ ID NO: 56728 - DNA, 344 bp, Triticum aestivum
  Clone ID: PAT_TA_56728
accacgcgtacggacgactctggcaggcggtccacagtggccatcttacctacgcctgcgtgcgatggactagctgttgtatgagaggcctaagattgattccgtggacatgaactttacagacgtttcaggctggcatgaccgtgtggctacctaactgactcgcgtggcaggacattcacctttgatcttgtgctgtaatagcgaaaaagccccaaccactacgcgccttgccatctgacgcccatgctgactggcaattgtgacgagccctgttactgcgcattacccgcgtgagttgggcgtggctactcacagactgtacgcttgactgtgtcagaggc

SEQ ID NO: 56729 - DNA, 130 bp, Triticum aestivum
  Clone ID: PAT_TA_56729
gaggagtcgctgaagcggagccaagcggcaccggcgcgggcgtgaagacgacgacgggaggatctggagcccgagcgggaggatctggagccgcatctcaagtactccggcgacacaaacggcgcttgat

SEQ ID NO: 56730 - DNA, 641 bp, Triticum aestivum
  unsure (1)..(641): unsure at all n locations
  Clone ID: PAT_TA_56730
ggtggatataccaccactatttagcaatgctaatggctcttgttagccttacttgggagataaagggacagcctgattgctcgagtaagcagagaggggtacagcttttcttgcgttgggcaatcatgcaaggaattgcaatgcatctacagaataggtaccagcgtcaaagattacgcacccgaattgctctgggaaaggtgaggcctttctttgatttaacaaatagatcgatatgtgccctttgctcatttaatattagaactttgcaacttgagtataaaaagagtaactagtattattaaataagattctgatcagtatcaactgtagatgatcctgcatataatcaaagtattcatggagatctatagttggtgcttgtgaaaagcaattcagttcgcttgttgtttagctaggatttggagagagcacttgcacaaataaatgaatataagagnttgtgatcttccctaaaataaatcttatgggaaaatgctttttttgtatacttgatggactgttaaatcggaggttgtcatttctctacctttttcaccgtaacttcttgtaccagtaagagaaaaatttcctctggctctttttgattactctgggtgcattggctacttgcagctaaa

SEQ ID NO: 56731 - DNA, 574 bp, Triticum aestivum
  unsure (1)..(574): unsure at all n locations
  Clone ID: PAT_TA_56731
aatgcttcaatgggattacttgagtatgggcaacgagacagcgccgagtccttcagatactcccagagattctttgtcctcagaacatgatattgaaggttgtgcttcacctagatacacgctcatatataacaccagtctaaatacagtgcagaaggaggaagttgatgagcaggtcaaatctattcataaggacaatccaatctttgtggctgtgatgaggaggttcaatgttacaggaacgtgcactttaactttctccaagaaatatgttcagacacatgtgggtgataaggagcgaaggatatgtcttcagcgatgtggcaagaggtgggatgtgcaatttagcagtagcgttgaagtcaaaaggattgttagtggctggcggaagtttgtgaaagacaatgatgtagagactggtgatatctgcatctttgaattgttgaagattgatgagatgtgcacaatggaagtccatatcatccatgcaaaagattttgatagaccctcccaaattggtgggaggagtgtcnatggatggtgtaaagaacctactactaaaactggggaacct

SEQ ID NO: 56732 - DNA, 715 bp, Triticum aestivum
  unsure (1)..(715): unsure at all n locations
  Clone ID: PAT_TA_56732
catttcccgcgcttcgctcccagaatttcctctcactcggggagacttgtgctccagtcagtcagtcagccagtctcctcccccgcctccgccccgaaccccatggaccacctcgccggggcatccgtctcctccgccgacgaccccgccccctccacgggaaacgacggcggcctcctcgacgtcatccgcgccgtcgagcgcgccgagggcaccatccgcgaccagttgcaggagaacagcaggctcaaggaggagctcatgaagaagacgcgcctgctgcagagggtcagcgaggatgccgcatcccaagccactttcggcgctggcgcgagccaggagccccgcgccntccgtcgtcgctggcaagatggacggccccaacaagccttacgacgggcgctgctnccggcgaacccgcgaggcgcctccgctctccgtcagaacggnngtttcagagagtgggaggagaccccctgatgcatcaacagatgagacacaacaagtacctcgacagcggccaggccaacggcgcctttagaagggagccggcaggcatggacaatggcggaccgtcgcacttctccactccgtcgtctcgctccgtttctccagccaggcctagaaaagaagccgattatgattccagactcaacctacctggacaggggttactgcctggtttagagatgaactcaaacatgtcctggaagca

SEQ ID NO: 56733 - DNA, 479 bp, Triticum aestivum
  Clone ID: PAT_TA_56733
agcgactacatattttatatatagagctacctaaattcaattgactggccgtcgacaatacaacggactgacagaaaaaagcctgtacccacccaacttaattggcttgaaatacatctttctttagccagctgacgaactaacaaacaggccccgaccgatcttccttacaaacaggcgcgcagactgaatggtgaaaggcacgctgcctggagccattcattacgcgcggcgtgtggggtgcttacacgcagagcgatcgattcactagccagctacctaccgctcgttcctttcgctttctttcctttcttgctacggcacgttggccgtctttgcccgtctagctataaatcgctggcttcatgtatgcgaccgattgattgactgaccgtacctcgaccccaactagcttgagtagagggatgactcacggagcgatccatctgcctgacagacggttttccttcctcggacga

SEQ ID NO: 56734 - DNA, 220 bp, Triticum aestivum
  Clone ID: PAT_TA_56734
gcggtccggccacgcggtcggctccttactatcaggcgatgaaagcccaccgatatattgcccttgcccttcgctagtccgacgccgttcgccaccacaatgtatcatgcgtgctagcgcatagtaagttgagcatggctgtatctggcttattatactgtttaacactcagtggaggagcgtcagggcttcggaggatgaggcagatgaggccccagcc

SEQ ID NO: 56735 - DNA, 470 bp, Triticum aestivum
  Clone ID: PAT_TA_56735
aaaaaaaaaaaaaaaaaaaaaaaaaaaaaaaaaaaaaaaaaaaaaaaaaaaaaaaaaaaaaaaaaaaaaaaaaattaaaaaaaaaaagaaaaaaaagaaaaaaactattttatggtggtcactttttttattttcattgtttcgtcttttttcattgctactttctggtttattccctggcgttgccctaccttttgggttttgcctgccatttcccctttcgtccgcttggcggattcgcttggaggcccttcccgttcggccttccttcccgtttccctttctgaccggttggggggaccccccctgccctggccctttatgttttggggtggtggcggttccgggcaggctttcggctccccttttaagggccttggtttcggggccttccccttttttccttccctttctgtgcacgttccctttttttcccccttaggctttttttctttggcttctttccgggt

SEQ ID NO: 56736 - DNA, 644 bp, Triticum aestivum
  unsure (1)..(644): unsure at all n locations
  Clone ID: PAT_TA_56736
gtcttactcactgtgtgtgctaaaccaaccatatggtatatagaaaggattctacaatgttagcttatattgcaaactcttgaaaatatgcggtcattttactgtttttgccgtgaacttggggagcttgggacagagtatggtgtcaataatcagtatataccagaacaatatttttgtgatattgtatatactgacttagtgatagtggagtatttacccaatttttttccatggactttatactgcatttttgaactggttagaatagctgacgccttttatatcttccttgtggtatatgctaccatccaagggagtatataaggtactaatttcaagtatatactattgtactatattttgtctatatacatctgcaaccaagtagtatgtgcactgctctttgtgcatggcagtatatacatcattttttgtaaggcaatatataacagcttnttttgtgaaccagtatactactttttttagtcagtatatatatacataatcttttagtcgatatatactacttttctttagtcggtatatactactattcttgatataaagggtaaagcagcgcacacatgacgcgcagcagccggtgtcgactagacggtggtgctgctgcatggatctatcag

SEQ ID NO: 56737 - DNA, 170 bp, Triticum aestivum
  unsure (1)..(170): unsure at all n locations
  Clone ID: PAT_TA_56737
gccaaacaaaagtattgaattgagaaaccttcccttgcccgaagattgcaagtactggttggaggagcaaggtgaattcgcctccagttgaagcagcatttgaaccagttcacaaggcatttcttgtcacggagtgggngntaaaccaagnaatacccctttttttgggt

SEQ ID NO: 56738 - DNA, 702 bp, Triticum aestivum
  unsure (1)..(702): unsure at all n locations
  Clone ID: PAT_TA_56738
gcaagcttcctcgaccgaccggccggcttcgtacgcccgtgcagagccagtgcgacgtccatctcctgccacccggctgggctagctagctacctaccttgtcctcctgtggctcgccgcgctccatgactccccaggcctgcgcgcggaggccatgagacgacccggcggcgccgcccccgtcgtcgtcctcctcctctggctcgccgcgctcaccttcgccttccacggctgcggcagcggcctcctccgttgcggaagctcggtggccgtggttgagcgggatcgtcgtccggcctctcttcccaggaagatgcttctggccgtggagagccggagcctcgacccctcgtcggccgccggtgctccacaagatcaacaccaccaccaccaccagcaccaccatcatcatcgtgctggtcaccaccatcgtcaacggcaccaccgcctcccaagcaaatggaactggcagagagtcccgccgtccgccgctcccggggacggcgaggaggtcgacccgcggtacggcgtggagaagcgcctcgtcccgacaggcccgaacccgttgcatcactgagggccgncgggcttccatccatgggcgattcttcatgtacttatcctgatcagaaactgcaaaagcatgcaaggggggagggagaaaaaagaacccgaaatttactagcctgtggtacatatgaa

SEQ ID NO: 56739 - DNA, 297 bp, Triticum aestivum
  Clone ID: PAT_TA_56739
cccacgcgtccggactatagattacaagcggaccgtccacactatacgatccaacctataccgaccctgccatgcgacagcttatctatatgtatagcgtaacctaaattcactgcactgggcgttactcacaacgactggactgacactgccgtgacccaacccaacttacttgccttgcatcacattttcctctggtcaggtggcatagaagagaacaggaccgaacggactgcccttcaccaacagcagcccaaacggagaggggaacgcgacctgcactggagcattacactc

SEQ ID NO: 56740 - DNA, 517 bp, Triticum aestivum
  Clone ID: PAT_TA_56740
cccactcgtccgcccacgcgtccgactagttcttagatttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgttttaaagaatccaattttacgaccccgtccttccaacgtaatattttttttttggggcccccaaaattaaattaattggccgtgttttaacaacgtgggaattggaaaaaccttgggtttccccaattaaatggctttgaaaaaaatccccttttccccagttggggaaataggaaaaaggcccgcaccaatcccctttccaaaaagttgcccaccctaattggcaaagggaaccccccttttaccggcccataaaccccggggggtggtggggtttccccccaggggaaccgttacttttgccagccccttagcccccgttcttttcgttttttccctttcttt

SEQ ID NO: 56741 - DNA, 681 bp, Triticum aestivum
  unsure (1)..(681): unsure at all n locations
  Clone ID: PAT_TA_56741
tagcgatcgagcaacaagccaattcgtcacactcacagtgatcaaagattttgagattgcctagtagctgcaccgacgtacgtgcgacgatggacgcgccggccatgctcacgcgcaaccacgtccccgagaacatcgccgcagaggagggcgggcagcaacagatgcaccgggacgagaagcagcacaagccggtgctcaagaaggtcaaggacaaggtgaagaagatcaagaacaccatcgtcggccatggccacggcaacggcaacggccacggccacgatcacgatcacgagcaggacaccggtggtagcaacagcaccgacgaggacgaggaggatgtggcgatgagggaagcagaggtggagaagggcgggtaccagcaagacgtcgaggacaagcccatcttcacggactccagccccgagctgcacggcgcacccatgtacgactcggagaggatcccagcggcggcgaaagaggtgaagcacaacgacgctccgggggtgcgggctgggtgacattggcggcctggcagcggcgcatgggggtgaaacgcgacgacgccgcggggggagcggctcggcgacttcggcggcccagcgtcggcgaaggaggtgaagcgcgacgacacccaggggggtgcggccccgnggacttcgggcggcccggcagcggcgc

SEQ ID NO: 56742 - DNA, 439 bp, Triticum aestivum
  unsure (1)..(439): unsure at all n locations
  Clone ID: PAT_TA_56742
agttcagagacccagatgatggctagtttcaaagcagaggagatacttggagagggcatggagatggatggacatacttggggtagaagcataagtatctttggagaagcatcattcgcagaggcgagatgatggcgatgcggcgggagcttttcctcttcttcctcatgccgtagaggggaggagaggccgtcgtcctcctcctcgcatggagttcccccattcacatttcttggctgtctangttcgtcgttgttcattcaggtagggagnggttttgttcctgtaattcccttgagctgttcctcgtggagatggggttgtgtcttcttctcttcttgctgcgtgttgtcgtcgcagcttgattgtatgtttgttgtatctcagggcatctcgtctctttgggcccccnnnnnnnnnnnnnnnnnnnnnnnnnnnn

SEQ ID NO: 56743 - DNA, 684 bp, Triticum aestivum
  unsure (1)..(684): unsure at all n locations
  Clone ID: PAT_TA_56743
agcagcacggcagcagccaccgtcggctttgaaaagggcggagtggagaaaggaatcgctgagctcctccatccaactgcttcccccaagccagcccactgccttccacgccagagattcgcagccatgtccgacgagctcaagcgcgggatcgcggcgactgttcgcgggatgagcttcggcggcgccagctccgtcgcggccggtgggaagcggccgttcgagtacgggaggacgcatgtggtgaggcccaagggcgcgcacaaggccaccatcgtctggctccacggcctcggcgacaatggagccagctggtctcaactgttggaaactcttccccttcctaatataaaatggatttgcccaactgcacctacgaggcctgtggcaatttttggtggattcccatctactgcatgngtttgatgttggctgatctttcagaagattctcctgatgatgttgaggnggctggattcctcagctgcacatgttgcaaatttattgtctaccgaacctgcagacatcaagcttgggcgttggtggctttagtatggggtgctgctactgcgctttactctggtacttgctttgctcatggaaaatatggaaatggcaatccataccctgtgaacctaaggnngggttggtggtctcaggggctggctcccatgtgccaggtca

SEQ ID NO: 56744 - DNA, 655 bp, Triticum aestivum
  unsure (1)..(655): unsure at all n locations
  Clone ID: PAT_TA_56744
caaatcccgtgctaaaccaaatagggtttctcgccaccggcggcgggatgggccgcaactcaccggagcaccgccgtcggtgccctccccgtccccctccgcggcggcatggcccccaggatatggcctcgctgccgatccccgacgagctgctcgctgaaatcttcgttcgcctgcccaccccaaccgacctcgtccgcgcctccgccgcctgcgtctccttccgccgcgtcgtcgccgaccgctccttcctcaggcagttccgcaagctccacgccccgcccctcctcggcttcctcggtccgcataccggcttcgaccccgcggagcggcctcacccctccgcatctgcggccaccgccgtcgccctcgccgccgacttctccttctcgttccttccggcccccgaccccngctcaccgctgggttggtctgggacgtccgcgacggccgggtcctcctccgcggaatgcccctggaaaattctcatggagtcgttttcacagagacggtggtgtgcgaccctttgcaccggaggtacctcatgcttccctcaatccctgacgaccttgcagctagcgngggaggggctacgcccacgttcatgcgagatttttcttgttcccgaaggcggcgatgagtcaacaacggctga

SEQ ID NO: 56745 - DNA, 658 bp, Triticum aestivum
  unsure (1)..(658): unsure at all n locations
  Clone ID: PAT_TA_56745
ctaaatttagtcattgcgtgtatttagtgcatcattgcatttataggttaatgttagtgtctagaggcttccttgtcggtatgcatataatgcctacaacatgtggtaaagcatattgtaactatggtacgtgtacgcctttgtatggaagctttgttgctttattaggcttgcacatgttccattcagttataacaaatggaatggtctgcttgtgatcgctaacacttttactcacataatatacaagtgccaataatgtgtgatgtatcacataatagcagagtcatcactattttttctaatggagtaaataacagccttatcagaaccagcataacaccatctaatttatgaatncacatagctttttaaacatgaatgtagtaattaatataactagatcagagcccttgcacaatttggtctttaaagccatggttgactaacacgatttaggcttggcttgtgagcgtttagcaccaaatatgacatccacatgacctggtttaagcgcctaaagttaatttgcctgcattttgtggcaaaactgtacttgttagngggatttgctctggataaaaacagatttattctggaggatggtggggcaaatttttttttttttgaagaaattgtatcataaagttgtacatta

SEQ ID NO: 56746 - DNA, 686 bp, Triticum aestivum
  Clone ID: PAT_TA_56746
gtgagtgttagattcgctgcgaattggaggttcgttagcctcgtctctgagcactcgtcaccagctcagcaacaagcatcgcagtggttatgcgctttctctggtattagatgtgacatgagctgtttaatcagctctttgtttggcgtggccgtcagcaaaccagcaaaccaacgcaattgccgcatatatgtagtgggatatgaactgctcttagtttctctgtgctcattattagttcaataaattggcaaatggctgctgatgtatgattgactggctttgttcatcttgctagagttacttggaaatattgacattctcaaaccaaatatgaggtgccctttattcagtccatgggagtatttgtaagttgactgcttcaaacccaatccgtgcttgctgtttagtgaataaatatgctggtagaaaattgcaaacttcgtaatatgaataaaatttgtggtaagttgtgatgaagattaaaattgtatcgcccacaaaaaagaagattaacattttattacatacactaatctatctagcaccaatgtcacgcagtcaatttcctttatccttagcatttttatgacataccttcttctatttagaatctttggttgcaatcagttcttttttctggaaaaaatgaaatcagtttcttttacttttagcatatgtactta

SEQ ID NO: 56747 - DNA, 605 bp, Triticum aestivum
  Clone ID: PAT_TA_56747
accacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcaggggacgtacactggactctcacattgagggagcagttc

SEQ ID NO: 56748 - DNA, 684 bp, Triticum aestivum
  unsure (1)..(684): unsure at all n locations
  Clone ID: PAT_TA_56748
atctgatgaacatgttgctaccatgagatttgagtaactagatgaccacaaattgttttatgtcactgtacaagttaactgaaccatgatacttctgcgatttgcatagtttttgtttgtgattcatgcttatgttcaggtcatatactgtacagtatatcgagaaaacctttccgttatcaagagctaatagggaaatgctacagaaagctgaatatgacattcaggtttggtgtatccttctcgatgacaaagttcctttcaggatgcactggcctttacattctgacatgcaagttaatggtattcctgttncgggttgtcagcaggcaagctacacagccgttaggggccaatggtagagatgatggtcttatgttaacacagtttttgaaagaaggtcccaataagattgttctatttagaagtgactctcgtgcgttctgtttgggtgtcagaattgccaagaggagatctctggaaagaggtcctaaatttggtaccaaaggaacaggatggtgaagaagtttgatgatgccctttctcgtgtgcgtcgctgcgtcggtggggggactgaggcagataatgcagacagtgatagtatattgaaaggntgttgctgattcagtctctgtaaatctncgatgccctatgactggttcaaggataaaggagctggtaggt

SEQ ID NO: 56749 - DNA, 598 bp, Triticum aestivum
  Clone ID: PAT_TA_56749
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccttggagggccccattttaccgcccgcgggaggcaacgtaatagttttttttttggggccccttaattcaattcccgggcccgcgttttaccaccgtcgggaggggaaacccccggggttcccccacttaaaggccttgggaacaaacccccttttgccccgttggtaaaaaaagaaaaaggccccccccggacccccttcccaaaatgtggcccacccgaaagggaaaggggaccccccctttaacccttttttaaacgcgggggggggggggggtcccccccaggggccccccccctttggccgtccctttaggcccccctctttgggttttctccccttctttacggccccgggtcgcggttttccccgggaaggtttaaaatgggggccccctttaagggccccatttaagggttttagggccccttgccccaaaaa

SEQ ID NO: 56750 - DNA, 610 bp, Triticum aestivum
  Clone ID: PAT_TA_56750
cccctccagcaacctccccgacctctccctcgagctccagagcccctccccacctctctctgctgccatggccgccgcaagtctcggcttaaattcgagtggcgccgagcccaacccctcctacttccacctccagtagcccccctccaccttggcgcgcctctccatctactcttatcatcgccggagtgccgtatcccgagttccacctctgcccgaagccgccgtccgccgcgactgctgtcccgcttgtccgagcgctccccggagtccgggctgtatcccatgtgaagcgcggcgtctccctgatcatcccggtggccggagcgctgcccgaggtggcctgtggcgccagaacggccgccggcgtcgagctcctccctctgctccacgggcggcgtcgggaaggagaagaaggccccgacccctccctgccagctggcccggggggcctcgccgtcccacccgtcagccgcacaccccgctgaccccaccaccgctgaggtggataagtggaagcggtatcccagaaatacattttcttgcgatgaaagcgtactctgggttttctgcgggccctcacagaaaaacccctataactttttgacca

SEQ ID NO: 56751 - DNA, 626 bp, Triticum aestivum
  Clone ID: PAT_TA_56751
gaggaggtgaggatgagggtcacttatgtgatgccacccgaatcgccgtcggagattgcggaggaaagcgatgggccacagcgtatcttggcgcctatgcagcgaattgtgaataatgggaggagcgcttcggagctgtcgagtggctcggtgtccttgagatcagctgagctggggacagaggtcggatcacctactggacccgttgtaaggactgaagaattactgaaggctgcaggacatgctgctgaaacaagaacatatacagggcctgatgcacagtcccttgagctgttggctttaattacaaaattgacaaaggaaaaggattctgcccttgagcaaaataagaagcttcacaatgagttggagctagtaaggcgtgatgccagtaaacaaggaggattctcgctgatatttgtactggtgtgtgggctgcttagcatcattctgggctatcttgtaaagaaatgagggttttagtttcaagtccagtctattgatttaattcctacagtaaataaaaggtaacatctcgtgggtgttcgtcgccggccagctaccaaagttacaggggacaatattttttatttccccctttttgaactttcagatcaaaccaagct

SEQ ID NO: 56752 - DNA, 338 bp, Triticum aestivum
  unsure (1)..(338): unsure at all n locations
  Clone ID: PAT_TA_56752
atctcgcccccgatccgccattgcgcaatgccgcgccatctgctgctgccgctgccgctgctccttctcgtcgccgcggtgggcgcctccgccggggacgccggaggggagaggacgtacatcgtgcgggtggacgccgacgcgaagccgtcggctttcccgacccacgcgcactggtacgagtcggcggtgctggcggcgtccgggggcggcggggggtggccgnaggncggnccgctgatccacacctactcgtcggcgctccacggcttctcggcccggatgtcgccgtccgccgccgcggngctggccggcgccctcggtgtgtcggncgtgct

SEQ ID NO: 56753 - DNA, 684 bp, Triticum aestivum
  unsure (1)..(684): unsure at all n locations
  Clone ID: PAT_TA_56753
cgcagccatggggcagatcgcggcttaggtatggcatttacctttggattgtcctcttgtttcaagtgcgagtttggatgtgatgtgatttcactattcgagcatcttcgatggctctgtctgattttgttcttgtgcactcgtattgaaatgaataaatagcatttaggacggtgatattcttgccataaatgcccttgttcaatttaaacaaggattatacatcaggaaaactctggactaacttgtctttcacttcctcgaacttgtcctttttaatcaattggattgaaataccgcctcttcaaaattgagagtgacgtgcagatatgaaaattttcaagcggagttaattatccctcaatctgagttaagctgcgagccaagaaaccttggtgagaagtataattccataaataaagttctcaccagaacgcagagggatatttgcgagactgctgtgaggattctataattctcaatgctcagattgagatccagaaactggaatggtcccaagttctattttggtgcttgatgcaattaccttctcagatatggctgagatagttttatttgtctttgggtggtgctaanagaacaactgtggggtaggaacattgattctttagtttcacatagtattcagaaagtagagaggtttattcttatgctagaatttga

SEQ ID NO: 56754 - DNA, 659 bp, Triticum aestivum
  Clone ID: PAT_TA_56754
ggttagaatacctactgctctgaacaataagtggtttgtataaaccaccgatcccctcgtgcagtgtacaatgtgatatggatcatcataggatcaaacttaatacaggaagtacacacttaattgtttctgaactatactactttttatgttcattctcctgtccttttaaatctctaatttagttgcaagtattttatttgttattgtttggcttcttaagaacaaatctagcaagtttggcttcttaagaacaaatctagcaagcaacgactcgactgatgaaagagatgttgaccatctttgctgcagtgaggtaccttcttgatcatgttactaatctgtatctacattattcagatgtgaaactcatgcttcttgaaacatctgcaacacatatgtgcactctgaaatggtaaaatatttgcattctatagtacttcaagtttgtgtagcatccccatatttcctgcgacccagttccttgaactgactaacccttatttgatgtcatatgtcctgaactgactctcatgaccaagttcctcaacacgtccgcccctcaaggcatgttgtgcagtggctcaattcatcgcattatgattgaacacatttggacacattagggattaggtgaacactgaacactgccaacatcg

SEQ ID NO: 56755 - DNA, 409 bp, Triticum aestivum
  Clone ID: PAT_TA_56755
acgcggtctgcgatcgctcccccctccctcacgatgcctccgtcgatgccgaagcggcggcgcggcgttgccgcctcaccccgctgccggaagaagcagaaacgcctcgacgccatctgcgacgtcgcgccgacgcctcccccggggggcggcggcggcggcggcggcggcggcgaggattccgacccggagtccgtccgccggagcacacggtcacgccgcgcgccggtcacgctcgacacctcgccagccccctcgccccgccgcatgaggccccgccgcggcgggggcgtggccgggcccagtgggagcccgcggacgggaggcaagggtagggcacggggccaggcggttgcccgagcagtggacggtgaggaggatgaggaggatggtggttgaaatgcagggt

SEQ ID NO: 56756 - DNA, 566 bp, Triticum aestivum
  Clone ID: PAT_TA_56756
gtgtataataatgacttcctctgtttcaaaataagtgatgacgtggttttagttcaatttttttaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggtttaaaggaaccaaatttaactaccgggggctggaaaggaaaaattttttttaaggggcccctaaaataaatttacgggcccgggttttaaaacgggggggaggggaaaacccggggggtacccaaattaaagggcttggaaaaaaacccccttttgccaagggggggaaaaaaaaaaagggcccccccgaaccccctttccaaaaattggcccaccctaaagggaaaggggacccccccttgaaggggccattaaagggggggggggggggtggggtatcccccacaggggacccgtttactttggcagggcccttaaggcccggttttttcgggttttttcccttccttt

SEQ ID NO: 56757 - DNA, 730 bp, Triticum aestivum
  unsure (1)..(730): unsure at all n locations
  Clone ID: PAT_TA_56757
caaaaaagttcgaacaggcaaaatggaggttgcgacggcgacggaggcgtcggcgccggcggcgagcggcggggcgagcaggcggggccacccgttcccgtggctcgacgtggccatctcggagccctactacttcctccacctcatcgccttcttctcctacttcgcggcccgcaccacggcgcccgcggccgaggacgaccccgagctccacagccgcctcatccgacgggagatccaggcggtgctcgtgttcctggtgctcttcacagtgaagattgtgaaggaggaacactgggaaacattcatcgctgattcattgctctatgcaaagggcctcttgttggttgttacttttgttatcgattattggttgaccgttggctacttactgggatttattgttatatatgctatggctcaacagccaccttatgatggcctaggtacgttttacaattatattttgagtcatttaacatgggaagttatgtataggtgttgtccccctcaaaagaaaagaaaaaaaatctgtgtcggcaaactgtattcctaaagtaagatgatattccttcaattnttattcgtatcttttgtctgcaccattgatgtgattattccgcttcttggtaagtaaactttattcgatgcttaccatgtcccaatagctactcatagttgcaaacccggttctgtcaggtttatcctatgcggggcacattgggttggg

SEQ ID NO: 56758 - DNA, 196 bp, Triticum aestivum
  unsure (1)..(196): unsure at all n locations
  Clone ID: PAT_TA_56758
aaactgtcgtgccatgttcagaattggtaatagaaaagataatctaaacgcacattatgaaactatctagactcctgcctttggggaattaggttgctaagtattattttgtaaataaatgacatgctaacttgctggttcagtttaaagctataggcaggggcttgcggtagggggggggggggggggnntcatt

SEQ ID NO: 56759 - DNA, 451 bp, Triticum aestivum
  Clone ID: PAT_TA_56759
gtcgcttggtggttgcaatgttggtgattctagagctgttgtttctaaaggagggaagggtaagtccagtgtctgtaatactgtcattcgtgcactcttggtttcatcggaaagttcatatggttgtggtttttctccgtgggtccatggcagttgaaattaactgcataacatgatctcatgtaatttcttttcacttgcgttagatgatcatgatgttttctgcatcccaccctttcagctattgcggtttccagggatcacaaacctgaccagacagatgagagacagagaattgaggaagctggaggctttgtgatgtgggctggtattgttatcaggcctaaaaaactccctacttcaccatgtgcttgttactagcattattcctgtttatttactggtcttcgttttgcagggacatggcgtgttgtgtggtgttttttgttgt

SEQ ID NO: 56760 - DNA, 333 bp, Triticum aestivum
  Clone ID: PAT_TA_56760
gccccggaattcacggcgagcacccgcgcccgcttttttttttttttatttcaggggcaaagacacccccagcccaccttgcacataagagctttcgttttctcccacagtcctaacatcgactaaagaaaatcgctccaaaaagtgtcccgcacaaattgtacagtgtacataagaacaagcgaagcatcaggggtcctctaaacgctaggacggtttgagaatcagaactacgcgctgtgtggagagccgtgccggccatgagcttctcgagcgagacctcgtcctcctcgatgacactctccatccttgccagcccatggccccgactga

SEQ ID NO: 56761 - DNA, 282 bp, Triticum aestivum
  Clone ID: PAT_TA_56761
gaaagttgtgaagtgtcggtcgttgaggcgaggtgggccacgtcggtatctaatgcggcggcgcggaggccggcagcggcaacgctccatgcccatggctgctcggtctcctggtcagaagagaggagtgagagaggaggtgagatggacataagagactgcatagtaaggacggcgcggctgagtgttgctggtccggagatggctctaggtttgattttagcattcctctccatcccactttacgatggcgcttgcccagccgctatgctgcctaccccg

SEQ ID NO: 56762 - DNA, 571 bp, Triticum aestivum
  unsure (1)..(571): unsure at all n locations
  Clone ID: PAT_TA_56762
ctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggcgagaccaccggctgctactgctccacctgctagtgcggcaccgcgtgctgctgctgctgctgcagctgctactgatccgccgcccaccaggacgcccggcagagacgagcacgaggatgagaaggacacgcatgcacgcaccatcaccaccagctcacacaccaaccagtatatcatcaccagccgccgcatgcgctcgcggtgcgctcgcgctgaataaaataagaccaccgatctgtgtaccggaactctcgatgcccctaccangagtgttctagcagaagcgtccttccttaagactccacttctactgtatatatggcgcctcaactttg

SEQ ID NO: 56763 - DNA, 290 bp, Triticum aestivum
  unsure (1)..(290): unsure at all n locations
  Clone ID: PAT_TA_56763
gcggagcccgaggaggaacgacaccccggcaacaccaaccccggagcaccccgccaggcgccccacgcgcccaaacacgccgaacgccgaggcggccaacggggcagccgcgacgacgggagcgggacggcacgcaccaacgccgacggagccgagaacgaccaggaccaaacnncgcggccgacaccccggccgccccccaaagaggaccagagggcggacgaggaggacggcaacgggcccaagagccgcgcagcgagacaaccggggggacagacacaagggcgaca

SEQ ID NO: 56764 - DNA, 639 bp, Triticum aestivum
  unsure (1)..(639): unsure at all n locations
  Clone ID: PAT_TA_56764
aaaaaacctaaaccaatcgcacgcacgactctcctgccctccactctcgatcccctcccgtcgccgccgccctcggctctcgatcccctcgagtaagctgcgtcgccgtcgctctcgattccctcgagatcgttgcgccgccatcccctcgagatccccagatctcacaccgccaccgccggtgcctcctcctctggcgacgcggcgaacgagagcagggccgcagcaggggtggctgcctcgtgcccccgatgtccaggagtttcggcagatccgttttcgccctggatgtgagtcgtgtaccggccactctggcggtccgacctcgtgcgcgtcgtcctcaccatcaaccccaagtctttcctccagtggaccattgaactccacaaccaatttcttcgacgctgtcatgcaggttcgagtccacacagtgaggagattgattcatgcgtgcttgtttcagtccagatctctaaataaatgttccgaacgaggaagctatgggagattggcaatgtcaagcatgtgtttncttacgtcttcttctgtactccagctgggttgtaggtttttggaactactcctacagggcatactttaagggtgctgcaggtccgatcaacacttgagaagaaaaag

SEQ ID NO: 56765 - DNA, 523 bp, Triticum aestivum
  Clone ID: PAT_TA_56765
ccccgcgtccgcccgtccaccagtgaaggcgaggcagaccgtggacgagaaggcgaagccttggcggtcaaggaaggcgcgtaacagctggccagagggacccagcatccaggccagcggtgtggtgtgtggctgcggccgtgtggggttaagaagaggcgagagggaaagaaaaaggcatcgagtattattgtaaagggtgaacctgaaacgaagctgttcttcgttctgctcctaaccagatcccttcctcccttcaaaaaaaaaaaaaaaaaaaaaaaaaaaaaaggaaaaaaaaaaaaaaaaaaaaaaaaaaaaaaaaaaaaaaaaaaaaaaaaaaaaaaaaaatataaaaaaaaaaaaaaaaaaaaaaaaatacatgaaaaaaaaaaaaaaaaaaaaaaggggggggacactttaaggaatccaaatttatttcccttgcttggaaggcaatattttttttttggcggcacttaaaaaaatttcggggcggtgggttttaaacgggtgggggggaaaa

SEQ ID NO: 56766 - DNA, 721 bp, Triticum aestivum
  Clone ID: PAT_TA_56766
ctggtgctatcaatgttgttagaggaacaaaatcttccgatgaagaactgttccaaatatacagtcactcagaaagtattgcacttgttgtggacagtcctcaattctttaaccggcttgcagaatctttcatttcaaggattaatgcaagattcattgtcgtacctttggggtgataaatcatccctaaatagtaaagctgtgatggacataccagtttatgactacaatgatatcactgaacttggacgagaaaatcgcaatgcattatgctactcaagcgagctattcgagcaaggtcagcaaggcgtcttcgaagctattggtccagaagacgttgcgaccctaatatatactagcggaacaggtggcacaccaaaaggcgtcatgcttacacaccgaaatctcttgcatcagataaataacttatgggatattgttccagcagtacctggtgataggttcctaagcatgcttccccctgcatgcatacgagcgttctactgagtacttcatcttcactcatggaattcaacaagtttacactactgtgaagcacctgaaggcagatttgcagcaccaccaacctcattatattatctctgtaccactggtctatgaaactctgtacagttcgattcagagacagatatctgctagtcctcctgctcgaaaaactgttgcccttgcacttatcaaggataagtttgctatttatgga

SEQ ID NO: 56767 - DNA, 376 bp, Triticum aestivum
  Clone ID: PAT_TA_56767
ccccgcgtccgcccacgcgtccgagcagtctgtctgatgaggagaagggcggcagcgagaagaaaaagaagaagaagaagagcaaggaaggtggtgaagatgtcgctccagagagtgtggaggttgagaagagtgagaagaaaaaggagaagaaaaagaagaaaaaagatgcagaggaggcacaataggtagagatagtagtttacattggcttgtcatgttatttggttgcagttatgtgggagcttgaactacctgttttatttgctttgtaccccttgcaaccgtctatggtttggtaggtaggcctgatgtactatctttaggttactgccattcaaccgaaatgctatggtaattagagagatttcccttt

SEQ ID NO: 56768 - DNA, 691 bp, Triticum aestivum
  unsure (1)..(691): unsure at all n locations
  Clone ID: PAT_TA_56768
cggacgcgtggggaccgtcgtcggtcccgatggcgtggaggtgactaacactgtgccggctgtcacccctgaggttaaggatgccctggtcaagaacataaggaggagaatgacaccacagccactcaagattcgtgctgatgttgagatgaaatgcttccagtttgatggtgttctccacattaaggaagccatgaggaaagctgaagctgctggaaatgctgattgccctgtgaagattaagctagttgctcccccgctttatgttctgaccacacagacacttgacaaagaccaggggatagcagttctgacaaatgcaaccaaagtttgcgcagaggcaattgaaaagcacaagggaaaattggtggtgaaggaagcagctagagctgtgagcgagagagacgacaagctgtttgcggacacgattgagaagctgaagctagcagngcgaggaggtggacggcgacgacgacagcgaggaggaggacaatggncatgggagaacgtggacttcacaaaggctggcgctggcgcggactgagcgagtctcctccaggtgnggttgagatcacttgtacagcgccagcaatgaatggaagaatgcttggtttctcatgtttgtggaggcacgttggatggatggatggatgganttttttttttactctgttactgatattgatcagtt

SEQ ID NO: 56769 - DNA, 515 bp, Triticum aestivum
  unsure (1)..(515): unsure at all n locations
  Clone ID: PAT_TA_56769
agcacacggagagggtcagagcgatggcggcgtcggagctgcacttcctgctggtgccgctggtggcgcagggccacatcatcccgatggtggacctggcgcgcctcatcgccgcgcgcgggccgcgggtcaccgtgctcaccacgcccgtcaacgccgcgcgcaacaggccggccgtcgagggcgccgccagggcgggcctgcgcgtcgacctcgccgagctgccctttcccggcccgcgcttcgggctgccggaggggctggagaacgccgaccagatggtcgaccagaccatatacgtcaagttcttccaggcncatctgggggatggccgagccgctcgaggagtacgtncgcgcgctgccgcgccggcccgactgcctcatcgccgactcctgcaacccgtggacggccggcgtgtgcgctagccttgggattcccaggctggtcatgcactgtcccttcgcctactttctcctcggtgtgcacagtctggccaagcgcggtgtgtacga

SEQ ID NO: 56770 - DNA, 257 bp, Triticum aestivum
  Clone ID: PAT_TA_56770
tctaacgctacgctcgcacgcaacagcaatagcctctacaatagggccaacgtaaatacaatccacatggcccgccagttttacaacgctccggactgggaaaaacacctggcggtacccaaataaaaccgccttgcgaaacagtacgcctttcaccaagctggactactacccaaaaaggcctgcaccaatcgcccttaccaaaagtagcccacactgaaaggcaaaggggacgctccctgacaaggcccataaaa

SEQ ID NO: 56771 - DNA, 614 bp, Triticum aestivum
  unsure (1)..(614): unsure at all n locations
  Clone ID: PAT_TA_56771
ctcctccgacttgcacgccaccgattactcccgcctctcgcacctctggtctgggcaacgccaacgccaacgcgacgcgagccagagagtctctctctccgatccgatagagctcgcgaccatttccacctctcgtcgagccgcctccctccacctaacctaacgcccacctaatcgctcgtcaaacgcaaggatccaagaaaaagggggggtggaccgatttcgcgtccattttcttctctctctctctctcggccagaggggagggaatcgagggcggccatggactcgcncggcgtcggcctcctcgccggtggagttcctgctccggtgccccacgccgaggcggaggaggctgccgctggccggcgccttcttcgcgcccaccgccctcgccggcgcctcgctgctccgcgcgctcgcctcgctcgccgccgggctgctcgccacgccgcgcccgccgtcgcagccgcggaacttcgccgcgctcgcgcgccgnctcgcgctgntcagcgcactcctcgactcgctcctcctcgacgcgccggaccgcttctccgacgccgccaacctctgcttccgcgagctctacgtcgggctcttccgcgccgacc

SEQ ID NO: 56772 - DNA, 584 bp, Triticum aestivum
  Clone ID: PAT_TA_56772
cttttgtgcttcttggatatcaaattatatgttgctgatgtgacagtttgactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttaaaggaaccaaattttactcccccggcctggcaaggaaaaattttttttttggggcccccaaaataaattcccgggcccgggttttaaaaagggggggaggggaaaaccctgggggtccccaaattaaatgccttggaaaaaaacccccttttccccggggggggaaaaaaaaaaaagccccccccaaatcccctttccaaaaattggcccaccctaaagggaaaagggaccccccccttaacggcccattaaacccggggggggggtggggtttccccccaggggaccctttacttttgcaggcccctaagcccccgctctttcggttttttccctttcttttttccccaggttggcgggtttcccccgaaaagtttaaaaggggggccccct

SEQ ID NO: 56773 - DNA, 606 bp, Triticum aestivum
  Clone ID: PAT_TA_56773
aacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttaaaagaaccaaatttaactaccccggcctggcaaggaaaaattttttttatggggcccccaaaattaatttccggggccgggttttaaaaagggggggaggggaaaaccctgggggtacccaaattaaatcccttggaaaaaaacccccttttccccagtgggggaaaaaaaaaaaagccccccccgaaccccctttccaaaaattggcccaccctaaagggaaaagggacccccccttgtaccggccaataaacccggggggggggggggtttccccccaggggacccgttacttttgcaaggccctaagcccccgttcttttggttttttccctttcttttcccgccaggttggcgggttttccccgaaaggtttaaaagggggggcccctttaggggtcccaattaagggtttaacgccccctcaccccaaaaaaatttgatagggggga

SEQ ID NO: 56774 - DNA, 355 bp, Triticum aestivum
  unsure (1)..(355): unsure at all n locations
  Clone ID: PAT_TA_56774
ctccagcgaatcgagcgggcagcgagcgacagtgaaagaaacgctcccaaccctagcccaccccgcgaccctagtttctcatgcgccgccgccgccgccccccgcccgcgttggagaaagtgagaggaaagaggagagggaggtgaggcaccaggcaggagagggtcacagactgctgtcgtcctgcgccggcgaggtcgggcgcgacctggcggttggtggcggctcgatctgctgctgatcaggagagaggagggaggtggggggctgnccgnntttgtgccttctcgacgccgagctgcggctgccccgtgggctctctctctctctctctctctctctctcgntctgngag

SEQ ID NO: 56775 - DNA, 420 bp, Triticum aestivum
  Clone ID: PAT_TA_56775
aaggaagatcgtgcagaaactggaagggcatagcgacacagtcattgctgtgtcatgccaccctaaggagaacatgattgcatcaggagctcttgacaacgacaagacggtgaaagtctgggttcaaaaggacggagatcaacgagaggcgtaagccagcttattttcttggttgtcatgtgacctgactgatgatggtagccaggtaagctacttggctccctgagtaattatagattgctgcagtggagaatgcgatgctcctgggctgtgtattttcgtcttgtgttgccttcgctgctgtgcgatttgtagtgaaattaaactgttccagagagccgttaatgggatggttgtatggaaggctggacagaggcaatgcttaaactttgtttaactgaaaaaaacaatgcttgaaaa

SEQ ID NO: 56776 - DNA, 641 bp, Triticum aestivum
  Clone ID: PAT_TA_56776
aatttgttgcttgttcttgttgttgccatgagggccctcaagttgtttgttgttattcctatgagagaccttgtttggatcagaagtagcatatattctattcttttcttgcaaaaagttcatttctgttctgttttgaagttacttggcatacaaattactatatatatgctattgtaaaagactagatttcttctaattgtgaagttcaagctctcgggatttgctcttcaattttttaacagatgtaatgctcaaaaaaatgtgatcaatgaatgctgagagggattgatgttaaatgtcaaacttatgtctttgtgtgtagttggtaagatgtatattgcacatcagtgtagtgaaaagaaataaaaaattgcagctaattattttagatgttagattgtggagtttgaagtagcggagacgacaaccatatggagatcggcgagtgcgggatcaacctcagcagcagccagaagcagcgcattcagctcggccgcgtcggctaccaggactgcgacatctactccttgacgacgtcttcagcaccatcgatgcgcacaccggcagtgagatcttcaaggtgcattttactatctactattggacttatctatactagactgaactgagtggtttat

SEQ ID NO: 56777 - DNA, 612 bp, Triticum aestivum
  unsure (1)..(612): unsure at all n locations
  Clone ID: PAT_TA_56777
gatgccgacggacgtgatcgagcggaagctcgctgagaggaaggggacgacaagggacgcgggcaggggcgaggcactgaacgcggacgacgtgatgatgcgcgtgaaggaggcggaccagatgaccgggacagggtttaacgacgtcggcaagatgggcgaggagggcaccggcatgaaggcggcactgagggccgacgacgaggaggacgtgatgctgcgggtgaaggcggcggaccagatgacagggcaggcgttcaacgacgtcggcccgatgggcgaggagggcacgggatggggtccggcattgagggcgcggaaggacgcctgaagcatgcacacctgttgcgtgtgagcgttttgtgtgacactttgtacgagctactcctgtagcaaatgaataaattagagttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaggggggggccgttttaaagaaccaagttttactacccggggtttggaatttttaattttttttttggggcccctaa

SEQ ID NO: 56778 - DNA, 540 bp, Triticum aestivum
  Clone ID: PAT_TA_56778
caaaatttaaaaaaaaaaaaaaaaaaaaaaaaaaaaaaaaaaaaaaaaaaaaaaaaaaaaaaaaaaaaaaaaaaaaaaaaaaaaaaataaaaaaaagaagaaaaacaaaataaaataaaatgaatataaagataaaaaaaaatgaaaaatgaaaaaaaaatggggggtgcccttttaaaggaatctagttttcctggcgcgtcttgccactgttttattttttttttgggggccccaaatttaattttttgggcggtttttttaccttggtggggaggggaaaacccctggggttccccattttaatggctttggaaaaattcccttttttcaaagtgggggttaaactaaaaagggccctaccgttcccttttttaaaatttttcccttcctttgtgggaaaggggctcccttttttcggggctttttaagggggggggtgggttggtgtttccccttgggggcgtttccgtttccgggccccttaagacccggtttttgggtttttttccttttttttccccccggttggcggttttt

SEQ ID NO: 56779 - DNA, 591 bp, Triticum aestivum
  Clone ID: PAT_TA_56779
aactccacacgcgcgcgaccaagggactttggagcgcaccggactcacgcaacttcacgcgcactgggtgacgcaagcgcccgtacccttgggggcgcaaggcgcgcctaacgcaggcgcggcatgctagctgggatcatgacttacatgctatcattgcataatgacttacacggcgatcttccatccactggctcactaaccatgcgcgacgatgaattgtgagactcaaccgatgatctagtgctagaatgaacgactattgtgacactgtgatgaataactataaactaactgtgatcacgacggtataactaaacttcatgaccactattgaagcccgaacaacgcaacatttggggaattgtgctttacaacgataggagaagcctgcttcacaggaacaagaagagccgacattatgagcgctaggctgacacaagctatgaatgcttgtgtgacctatgctgacacctctagctgcaaacttcgagaatctaatagatcgatactccaaacatttacgggatcgtattcgccactgctaatcagaatcaaactagctctgacccttttgatcacacaactatt

SEQ ID NO: 56780 - DNA, 161 bp, Triticum aestivum
  Clone ID: PAT_TA_56780
gaaaaatttcccaagcacttagaggagtacttggaagatgatgcagaaatgcagagtacttctggtggtagtactctgaaaatttagagtagatgatgtagtgcgagagctctcctctcctctctttgaattcggaaacaaaattcacaaacaactctgag

SEQ ID NO: 56781 - DNA, 772 bp, Triticum aestivum
  unsure (1)..(772): unsure at all n locations
  Clone ID: PAT_TA_56781
gagaaagataaaactgacgactggggatgattgcacagaacctagtagtctgaaaaaaccaagggatcacgcagaacctagtctgaaaaaaccaaggggcagaccaagaaaatatccactgtcagttgccaaagcggtagattcaacaaaaaatagcggaagtccaggttctagttttgttgaccctcttgtcacttcaggagttattccaggcgatcttgcattatcttgtgctataccatctgtgaagcctgtggaatcagctccaaaaaaaggcaggggtcgacctaggaaaatcccaattgacaaaantaaagtgttncgcctgacactgaatggacagaagatatctctagagctctaatatgctgcacgaaaccaaagaaaaaaagggggaggccccggaaatatccactcccaagcagcagcaagcatgtttctggcactgatactgaatttgaaagagaaactggatacacggagtctaattctaatttaagtcttgttacagttgatgcagaactaccagttccatcttcatctcttacaatttgtgggaaaagatcaagaggtcggaaggttagaggacgacctanaaaggaaacaaatccttgtgcactttcttcgtcagtggttttctggtgtccaatcacagagtagggagaccatttcaaataatccagcacactctgttgagaatcatttgccatatggacactctagtttgacaagtgagcttagttcgattggatgcttagatgtgatggcaatg

SEQ ID NO: 56782 - DNA, 226 bp, Triticum aestivum
  unsure (1)..(226): unsure at all n locations
  Clone ID: PAT_TA_56782
ggttcttggaaggtctgctatatgatgcatgctgttgtgattaggtctggtttccaccttaacgtctgtgtttgcaacgctctcctggagctttatctttactccggctgtttgagggaggctgtgatgttgtttcgtcagatggaggagaaagattccatcacttggagtacgatgattggtgggcttgttncgaatggacgaccaaattctgcccttaaccttt

SEQ ID NO: 56783 - DNA, 215 bp, Triticum aestivum
  Clone ID: PAT_TA_56783
cgagtcgcatctgtgggacaacagttgccggcgtgaaggccagagccgcaagggccgccaagtttacctcggtggctatgataaggaggagaaggcggcgtgggcgtacgacctcgccgtgctgaagttctggcgtgtcatgtgcttgctgttgtggctgttcttttggttgtggtggtgggggggggggggttcactgttattgtgtgtttttg

SEQ ID NO: 56784 - DNA, 508 bp, Triticum aestivum
  Clone ID: PAT_TA_56784
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcggccttttaggagcaaccattcttacccccgcgtgccggcgacttaattttttttttttggggcccccaaaaattaattggggggccgtttttcaacaccggggggggggaaaaacccggggggccccccaaattaaccttgtggaaaaaccccctttttcccccggggggaataaaaaaaaggacgcccccaacggccctccttaccaattgtgccccctcctgggggaagggggggcccccccttggggcgcattattacccggcgggggggggggtgtttccccgcggggggactattttttttgccaccctattaccccccctttttttggttttcctcccttttttccccgcgttgtcggccgttttccccccgggatttaaaaaggggg

SEQ ID NO: 56785 - DNA, 158 bp, Triticum aestivum
  Clone ID: PAT_TA_56785
tttttttacgaataacaacagcaaggagaaatgcatttcctcttgttccaggcaagaaccttgatgatgagcatgtatttgccttctgtgagcatcttgtcgaactgtcagcataccttcaaactgtatgtggtgcaatctttggataagagaatgct

SEQ ID NO: 56786 - DNA, 488 bp, Triticum aestivum
  Clone ID: PAT_TA_56786
ataccttgtatccctcatgtgcaaagccttctcttcgccgccctgtggccacctgcctgactagggaagaggacacgcgcggagcacgctcggttcaacgcagcgtgcagcgtagccagcaggaccggccgcagggctatcatgcccggcgcgtgcaggagtgccatcacgaccacaatcatcacggcatgcacgagcactaccaacagaggccgaggtcactgacggcacggcaaagtgtatcatgaggaggaacatggccgtggccgccatcggacctgccagggacagcgtgaggaggaccaaccacgacaacccggtccatgactgcaagcacagcgagatgaccacacacggaaatgcacgcggagcgtacgtgtgcatgtcgatgacggtacgactgatgatccggacaccgcacgagcataaagagacacctgtcaccattcgacgaacaagcctaacatatagcgttgatgacgaactac

SEQ ID NO: 56787 - DNA, 326 bp, Triticum aestivum
  Clone ID: PAT_TA_56787
gcttgttagtggtgcatgcttgtggtagctcatgagccggttcctttgtttcttgtgagctgtaccctctgacaaatagggtcacctgcctgggtacactttatcaacatttactcctctgtcacatattaaccgacagataaatgggaatacggctttagcatagatctgatctgatgcactctaatggagctacacttatgaactctaggcattagctttggaggtgctgtgctgtgctgcgctgtgctgtgtacggtcggtggtgcaagatgacggcgacgtgttgctgcctgcgttccgactcgctgttgagtcggtgtctg

SEQ ID NO: 56788 - DNA, 551 bp, Triticum aestivum
  unsure (1)..(551): unsure at all n locations
  Clone ID: PAT_TA_56788
ggcgtcaccaccacgccagatcccttcctcgccgccaacagcagccggcgggccagatcgggcgctgactaaatctggcgcctaagcacccgcacgcctacgccgcagccacggccggccaagctccaggccacgccactccacccacccagagaaggagaagcgcgagacgaagcagagggccgccggggagcgccgcgacggccgcagcgccggaggccgagccttccccacctggagcggtcgccgtcgtggaacgacgccgcgcgcgcgagncgggaagccccggccgccgccgtccgccnngcgcgggcttcgcccggcggtttcctccggcggcggcgcggcnggggagccggggagagggggtggcgaagcagagtgccttcctgaacagaagctctccaccggtgactcccaactcccaaagcaagcaaaagatgctcaagagactgatggttgagaagagtggataggcacctgacatgtcactcttctcataagcttgctgagctgagctcaactttagagagaggggagaggatgattaa

SEQ ID NO: 56789 - DNA, 631 bp, Triticum aestivum
  unsure (1)..(631): unsure at all n locations
  Clone ID: PAT_TA_56789
ctttggctcaacttacactttgttgacagaggctctagtttttccaagattattttggctggtcggttgcctgcacagcagaacgcaacagttaatcttgacctaagcaccagaagtgtctcagaattcagttcttgggctgagtttcataatggtgtagctgctggcctgaggcttgctccttttcaggagaaaatgctgagaacctggatacaatacaatagaccttctgaaccaaattttactcatgctggtctgcttctagcattcggtctgcatgagcatctacgagttttaacaatgactgatgcttatcgatatctctcccaggagcatgatataactaccttggtttgttacttggtttggcaacatctcataggggaacaatgcaccctgcaatttcgaagatgctctacttccatgttccctctcgccatccatcttctacaccagagttggaactaccaacacttctgcagtcagcagcagtaatgggaattggacttctattgaaggttcagcacatgcattaaccatgaagatacttctgggtgagattggccgaaggagtggggggtggataatgtgctagaaagggaagggtatgcctgntgctgcaggctctgca

SEQ ID NO: 56790 - DNA, 515 bp, Triticum aestivum
  Clone ID: PAT_TA_56790
ataggaacgaaggctcgcgtgaatgcgcggccagacagccagacaagtaacgacgacgtctgggaaggcacctgctgatgctgctcttagagacctccctgctcacctgcggattaaacctggaggacccaaagaccttcaggaccagaatccaacgcatgctgaagcttgtcctgatcattgttgaagatgacaagagcgccagcaaaacgacacagacatgccggccctgaaggacgacgccggagagagcaactaaggcaggaggtggactaagcgccaagagctgtctgacggttgtggtcgttggaaggacatgccctgcaccgcctagatggtcattatcttagtgaagacgctggatggtacaggcacggtatagctgcattgggtttgacctttagatgcccaaacattaagcgcggctatctgtatgcggaactcggggaacagatacagattggtggctcgacggtagggatcatggattatcttgctgtaagctgtgacttgaa

SEQ ID NO: 56791 - DNA, 663 bp, Triticum aestivum
  unsure (1)..(663): unsure at all n locations
  Clone ID: PAT_TA_56791
gactgtctcgtccttcctccatcttgtgttgttgcttgttaggcatagcatagttcagcggccagccagatagccacctagctagccatgggtgtgggtatgtgttccaacaagaagagcaatagtggcggcagtgttttcgtgtggtttttagtcctggcctagccttgctcgtcgacgctgcggcggcaaagaggaggcaagggggcaccgccgtccacctgcccggctggtactgcgaggagaggtgccatggcaagcaggactacatatactgctacagacggtgcagggcgagccccagtgccagcagcggcgccggcctgcgtctggcatcacataggggggctggtgaagaagatacaggaggaggtggcggaggagctggtctcgtgggggagggcgtcgggcgtgaagaagagaggaagcaagtgaacatggtcatccacccgccctggtcttgcgaactcgaatgcgaagacatagttgatccagagtctgaccctgactcctacatggcttgcgtccgtgaatgctnacttggagttcaggaataccgtgtgtgggagggcanaaggtgaagatgccagagaagaggaggaggaacccgtctcctggcgatgccggtggagcatgccggccccgggagagggagaaggggaa

SEQ ID NO: 56792 - DNA, 722 bp, Triticum aestivum
  Clone ID: PAT_TA_56792
cccacgcgtccgccggcaacgacgctcaaggctccctaacccccgctttgtccaccccgaatccctcctgctgcctgccctgtcgccgcttcccgtactgccggccgtcctcgccgagagccgctaactttggcgccaccacgagccgggtaagaagatggtgaaggggatgcccaaatcaagacctatcaaagcggcggccgaggtggtcttcgacccgtccgtctctggcccccggaagccgcgccgcgccgaggcgccctcgtcgagcagcgagtatcaccacttcatggggtcgaatctttcaaatatgtaccacaagccagctccggcgaaatctaccgacatgtctgatgatgagcctgacatcgatattgagaagttattgaaagatgttgagcttttcggtgccactacctggaaggacaagaacaaaatacagaaccgcaaagtagttgaactgggtggaaaggccattaagaagcagcgtacaccgttatctgtggcaatcccagctatgaagaatcagcagaaaagggaacaaaagaagattgaagaggaaagactgcttgggatttttaggaaacaaaacaagaacaagaaatttgagaagcttagaccagaggaccgagtactcagagcaactgaagggcgcttcaagaacggtatacctcgatgtgaagcacctcatgggaggaccaaaaccatccctcgtcgtcatc

SEQ ID NO: 56793 - DNA, 563 bp, Triticum aestivum
  Clone ID: PAT_TA_56793
ccccgcgtccgcccactcgagccgtagcactctccttccccaactccggtgagaagccccgctactcgccctctgcactgctagcttgctccagttgaccctagctccaaccagtctctccatggagtccctagtggtcttctgaacctccctaacccctttgctactcggattgtcgccggagtcaccaaatccgaggatcactgcagctcgcagccgctggatgcgcgttcgtcgccgctcgaccacctctctgatgtggccggtagtgctgaagctatagtcgacgaatatatgttctatattggttctgttctcgtgaaaatgccagcagctgaaccagaaatggaagcgatcaagcagaattttagaacgccttcttgcaattggtgtttattggaaataagttccaatacgattccatgtaaggggcgtgagggccacgtcttctttttcgttttatctactagtagtaccagttacgtagctatgtggtttcgtttgttaggggaatcgatgtgggccgaataattagttaggtaatattttggttagtccaaata

SEQ ID NO: 56794 - DNA, 651 bp, Triticum aestivum
  unsure (1)..(651): unsure at all n locations
  Clone ID: PAT_TA_56794
cgaagatccttcagaaggaaagcaagacaaagcagctgttgatgtctcggagtgtcttactgaagatcatgccattaacagtgaaaccatagagaatgtaacagctggcgtgagcgagttaaatttgcctcaagagaaaaccaccgaggaacagaccgaggagaaggaacatcaacatttgtctactgaagaaattgactctctcttggacatatgccttctgcaagcattacacacgaacataaaagataaagacctccccatgccaggaagtatattgtggtcaaatcacattctcccatgcagacctccaggtgttacccttgatattaagaagtcatcacataaaaaactatccaagtggttgcagtcaaaatcgtcttctggccttatctcagtgaaagaggacaagcataaaaaggaagtcatgttgataagtatcagtcgcaaacatccagactacacggccttcaaacatcataagagggtacaggagccagttgaacagcatgataacattgttgccgatggcagcagtacaaagcacntggaagtggatgaaatttataagccaagttcgcatgtcaaccccatatttttgggctgttgacgctgaccagggnaagtattacagtgcatcagaggcgtctg

SEQ ID NO: 56795 - DNA, 340 bp, Triticum aestivum
  Clone ID: PAT_TA_56795
cttaaatttgtatatgtacttgctctttcatgcttgaacaagttttttgcagttttctttaaagaggattggcgtctatctactgtagttaaaactactttgattttgtcaaatcgatgcatagtagaaggtatgtgtggcgtgtgtattaatcagtgtatagttttacctctcaatcttcatggttttacgattaatttttattttgcaaggtttgtgctttgatccagagggaaatgcatgtgtgcgtatttgtaattttgagatggtgatgccaatatttgtttcatagtggactgacctgactagcatttttaggcctcatttttcactggatgca

SEQ ID NO: 56796 - DNA, 650 bp, Triticum aestivum
  Clone ID: PAT_TA_56796
gttctggagtcaatgtgcagagcagagtcacagatcttgagtgggagcaatcttacgtcacttctgtctaatgagcgattccatcgttgtatgattgcctgttctgctgagttagttctggccactcacaagacagtcacaatgatgttcccagctgtgctggagaaaactggcataacagcttttgatttgagcaaagtcatagagagctttgtcagacatgaagattcacttccgcgagagttgaagcgtcatttgaattcacttgaggagcgacttctggaaagcatggcatgggagaaaggctcctcaatgtacaattccttaattgttgctagacctacattgtctgcagaaataaaccggctaggtttactggctgaaccaatgccttcgcttgatgctattgcggtgcatcatgatatttcactgggtggccttccacctctcccatttcacaagcaaccagataaagatgaagttagatcgcccaaaagagcatgtactgaaaggagaaatgtgctggtggacaactcatttagatcaccagtaaaggatgccatcaaatcaaagtttctacctcctcttcagtcggcgttttgcaagcccaacaagacctaatccagcagcagggaggagaaacatgcgca

SEQ ID NO: 56797 - DNA, 254 bp, Triticum aestivum
  Clone ID: PAT_TA_56797
ccccgcgtccggttctagatcggggatggagaagctcgcgaagaagagtgaagtgtgtccgtggtgtgtggtctgtacgagcaagtgtggcgtgccgagtctggtagtagtagtacggttgtgtgttcggtaggggcttttggcgctgtagccgcgtggaagcgtcaagcgttaaacaaataatgtaacttgcatgcaatgcaagttgaactatcaaaggcccgttttgtcagaggccgtttggttcagttttt

SEQ ID NO: 56798 - DNA, 314 bp, Triticum aestivum
  Clone ID: PAT_TA_56798
atctgggaagtctcgttgtacaattgcttgttacacgcccgagtggctttcactcaaaaaaaaaaaaaaaaaaaaaaaaaaaaaaaaaaaaaaaaaaaaaaaaaaaaaaaagaggaaaaaatataaagaaaaaaaaaataaggaaagagagagctcgatttataaggtattttttttttagttacattggattgggttgtcttggggcgctggttttgtaggtggccctgtggttaaagagttggggttgcctgggtgttctttttttttttctcttccttgttttttttgggtgggggtgtttttggatggcc

SEQ ID NO: 56799 - DNA, 288 bp, Triticum aestivum
  Clone ID: PAT_TA_56799
cccgccgctaaatttcgtcatcgcgtgcatttggagcctcattgcatttatcggtcctcgtatccgcttacagtctcacttcgcggctagcatataatgcctacacatgtggtaaagcctattggaactatggtacccggacgcctttgtatggaagctctgttgctctattacccttttacccgttccattcagttctaacaaatgcaatggcgagttcgctaccgctcacactttcactcacatattatacacgggacactactgggagcggcacatcatacgcgc

SEQ ID NO: 56800 - DNA, 570 bp, Triticum aestivum
  unsure (1)..(570): unsure at all n locations
  Clone ID: PAT_TA_56800
atttgaaatataatggattttatgatgattcgtttctactggttgttgctgacaggcaccagtgtttacacctgaaggtttccctccttcaagatttttttgttagagagttgtggggaaaattggaaagcaaacttatcttgagaaggtgcatccctccgtcatcacaaacttatacagttcacataacaagattactgcctctgctgcgtccattgttttagttggttcaaatgaggaacttgggatatcagtaactgttcaacaagtctaccctgataccatccatactgatgaatatctctactttgatagtttgaccactatactcatggaacaacaagttcactgtttcggcaaaggtttattgctgatggaattgaaagtttggtcaggataggtatgtcattggtgaaaaatagataagattcgngggttccgttggaaatacactatcaatcttcacaacgattccaaatgtgccagagggctaagatttatttaagaatatggtcactgtatgatgggatccaaatgcgcccgacggctaaggatgtatttaagaatacg

SEQ ID NO: 56801 - DNA, 457 bp, Triticum aestivum
  Clone ID: PAT_TA_56801
cgcagctgtccaagatgctgatccaggaggagatcgacgagaactgcacggtgtacatcgacgccgccaacaaggacgagctggcctaccgggtggaccgcagcggcgggctggtgaacgccgagacggggcagaggtccgacatcctcatccaggtgcccaacggcgccgtcgccaatggcgggggcggcgaggccgccaaggccgtgaagaagatgagggtcatggaggacggggacgaggacggcatggacgaagatgtttgaactctgaagctgaagtgaatcttgctggatgaagtgtgtagatgagttgcggtgaggctggcgcttcgtgttgttctgtgacgcgtgtgtcggttggccggaagctgctaccgcttcgggactagctactgagtatctgtgatattgtgtgaagtaaatagaatagagtgtccggcgatttgcttcgcgga

SEQ ID NO: 56802 - DNA, 525 bp, Triticum aestivum
  Clone ID: PAT_TA_56802
cttctcttctgtccgcctgcaggacttgcgcccgcacgcgcttgaccgccggcgggtgaaggagtcggggccggatccggcggcttgtcgccgcgcttatggatccgaccgcatccatcgcgactgggtggtgcctgcggccccatctcgattcccgccgtgtcactgacccaggcctccggcctcgaccttaattccttcctgttcctccctatcaagcaggtcgtcgcctcctgtggcatcgtctatcatatctagccatatcgtccgccggtggtgccaccagattaagcgtccacatgtgcggtgtgattgccgtcctagatggcttccgcacatccatgccttgcctacaggtacagccagccttttcccattcgcaatatgcctaggctagagatggaggcctttcccatgcgagaatcaccaaagacatggctatgggtatggtagatacactggatttaatatgtgagttccatagtatacatattttttctacttgccctaagaattccaaataaa

SEQ ID NO: 56803 - DNA, 171 bp, Triticum aestivum
  unsure (1)..(171): unsure at all n locations
  Clone ID: PAT_TA_56803
caacgacctagcacgggacccgccgccaccccgcccgacatcgcattcctcacctcggctagccggagggcctctgctcctctatccagcgccgaccatggagttgacggngccagttcgcccccgcgccgcgtgtgattcggcgatgccctcaccacaccgtgacatcca

SEQ ID NO: 56804 - DNA, 238 bp, Triticum aestivum
  unsure (1)..(238): unsure at all n locations
  Clone ID: PAT_TA_56804
caatcattgtagttgcagtagcaccgaccgatcgagctccctcctggttagctataagcagcaagaagcagcgctcgctcggtgtgctcgtgcgacatggccggcaagaaggcgctggcgctggcgctcatggtcgtcctcgtcgcggcgacggcgcaggcggtgtgcgacatggacaacgacgacttcatggcgtgccagccggcggcggcggcgnanncgacggnnacccccgcag

SEQ ID NO: 56805 - DNA, 663 bp, Triticum aestivum
  unsure (1)..(663): unsure at all n locations
  Clone ID: PAT_TA_56805
ctccctcttctcgccccaaaccctagaggtatgacgggcaccgatctggtggcgccaccaccgcggatgaccacgtgccggcaaggcccccatctgtccctcgcttgatcccctccgcccgctcctatggtgtgtgccaccgaagcctccggcggcgcttgcgtcctggggtccgccccctatcgctcagcctcgtgtctgccggcgcaggcgccgccacctagtcatgtgtgccgttctgggaggcttgacaagctgctgattagaggacaccaacctagcctcagaggaggccatcctcgccaagtntcgtgtaggtgttggtcgcctgcgtgcgcggccatgccgccgccgtcccctgctacgaatctcgctcactgcaagctgcagagcccgtgcccatctcccctgagtaggatgctcattaggcaacccaaggtgtgtacgcccctacttccccaaggtactcaagcctcacgcctaggctgaccacgagatgtgtgctgctgtgaggcatgtagcaccacttctcccgactgctatcattagtgaaagatctcatgtcacggcgtcatggtctcatggaatggacatcacatggcttattaggaactctgagttcagcgggcaccatgcccgaatgtgtttagatccactatttta

SEQ ID NO: 56806 - DNA, 483 bp, Triticum aestivum
  Clone ID: PAT_TA_56806
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaggaacccaattttactccccggggctggcaaggtaaaactttttttttggggcccccaaatttaattccctgggccgggttttaaaaccggggggaggggaaaaccccgggggtccccaaattaaagggcttggaaaaaaacccccttttccccagtgggggaaaaaccaaaagggccccccccaacccccttccccaacatttgcccaccctaaagtgaaaagggaaccccccctgaagggggcattaaaccccggggggggggggggttccccccaggggaaccgttaatttgccaggcccctaagccccggccttttggttttttt

SEQ ID NO: 56807 - DNA, 420 bp, Triticum aestivum
  Clone ID: PAT_TA_56807
ctaaccactgatcaccaccatcctatcctcttctacacccccattgccagtctacgatcgccgatggtctagcatgtaccgcctgcggcctgctccactgtgccgtgtaccctctcggtacgcgtcgtgggatgcccgaggacggacgtaggggtagtaggaggcaggcaggaagggggcgacgaccatagggaggcccggctccgggtgcggccggccgtaccacttcagggaggagagcttccggaagagacccaagacgagggacgggcacttcaacgtgctggagcggattgaccacgaactgctgcggggctccatcggcgactaccgcgtatcgaggctggactcggcgccgtgcgcgttcctgcaccccgcacactacgacgccgactagatcgcctttgtgacggaaagcga

SEQ ID NO: 56808 - DNA, 742 bp, Triticum aestivum
  Clone ID: PAT_TA_56808
cgtctattctcgccctctcgcccccctcgccggctgccgtcttcacgtcccctcgctcctccccctcctgcacggctccgtgacttcctccgtcccgacctcgacggccacttttgctggtttttctgattctggacactggtgctgagatggccaagcggaagcgggagcgggtgacaacacacaatgctctgaccagcaccgacgccggttcccacaagagaacaaaaaagagggatgaaaattcagaagaatgtcatcagtgtcggaacaacactgcaagacatgtggactgctcaagctgcaagaagagatattgtgtccgatgcattaagaaatggtttgtacctttctaacatcatcacgttggtcaattgatattgttcaatttgcttgccttcctacgtatcgatttacatttatatatttgttatgaaatcatcggattgtgtttgtggcactatcttaagaacaggtattcaaatttaattgaagatcatgttaagaatagatgcccatgttgtcacaataattgcaattgcatggattgtctgcagagtgatataatgcataagattgacaaatggaatgtatcacatgaagatagaatcaaatttgctcatcgaactatatactttttgcttccttggttgaaaaaacttcacgaggaccagatacaagagaaacgtattcaggccataattgacgggtggattttttttttctttggagccctaattga

SEQ ID NO: 56809 - DNA, 208 bp, Triticum aestivum
  unsure (1)..(208): unsure at all n locations
  Clone ID: PAT_TA_56809
gngccggacttctgggtggtctccgtgggggcnctgcggcgcgcctccaccgctccgnctggttggtgctgctggtgaggatggtgaccgccgtcggcgcggctttggtctggcctcgccgcggcgggtcctcggcggtgccggtcgtcctcctcttcggggagaccctggtggtggccatcgtgggggtctcccgcgccgtcgtgtg

SEQ ID NO: 56810 - DNA, 138 bp, Triticum aestivum
  unsure (1)..(138): unsure at all n locations
  Clone ID: PAT_TA_56810
cccggggtcgtctcccgcgtcccggctggtggcgctggccgnctgcggcctggtgttcgtgntgcggggcgtgtcgctgctcggcctctcctgcggcggcgtgccgtctccctggtgtggtccttggtcttcgtggcc

SEQ ID NO: 56811 - DNA, 611 bp, Triticum aestivum
  Clone ID: PAT_TA_56811
cccacgcgtccgccgcccacgtacctcactcacctcaggtgaagctagctagtgaagtgagcttaggcaagtcaagtccgtgatggatttgaagagggtgctggacatcgtggaggaggaggtggtggacggcgacgaggaggagctcgcctccccggacgccaagcgccggcgaacgcttctcaatagtagctcgatgcaggaggccattggcgcgcagtacatgcagaagcatctgcccaagctggagccctttctgcgccgagttgtgcaggaagaagtgcacaatgttcttatccgccacatcgattcggctcacaggttagtgcctaaatactactcctgtgtttagtgattcaatcttctgtgaacaggtacatgcttcatttacatgctatccaaggttactactaagcactactagcgacaatattatgaagcagatataactctgaagatcattttcactgttgaatttgcaattttaacaaagtcgttgcaaataatatggacctgaatatactacccgtaatgctgttgaaaatcctttaaattgccaccatatgggctgttacaaaccttatgcagtgcagtggcggtagtcccctttt

SEQ ID NO: 56812 - DNA, 241 bp, Triticum aestivum
  unsure (1)..(241): unsure at all n locations
  Clone ID: PAT_TA_56812
gctggcggcctggcctcttcgcctggggttcgtgaagcggggcgtgtggctgctcggcgtctcctgcgtcgtcgtgcttgtccctcntggagtggtccttggccgtcgcggcctacccgcctgggggcagggtggcgtncccggtcttggcggacccggtccgctccgccctcntgctgctcagcctggtcgtcccgggctagcaaggacggccatggggctggtgccgccccgcgccctg

SEQ ID NO: 56813 - DNA, 596 bp, Triticum aestivum
  Clone ID: PAT_TA_56813
ggcccccggctaccactcgcctcctccccaccccagatccgtcgacctcaccctgcccaccaccgcccaccgccagctccaacgacccccacgttggcgcccatccacgagctggagcagccggatgaggacgaccctaccgagactgcctcttcctccggcgaccacgccacccagcgccaccaggacgccgccgcaccaccaccgagcttccagctctccccgtcccaatcccgtcctccggccggccgctcctcccgcaccaccagaagcagcacaggcggacagcagcagctgcgcccgcctcccgcccacgccagcagaagccgtgctcgatccggtcaaaggtgatatttttacacgggcggcggtgctcgatccgtgctggagcagcgggaggaggacggaggcgcagcgggcttctgttcttccctgctgtcgagaagcagccccggcctgttgacccgcgcgccctcgtcctggccgtggccgctacctgggctgctcgcgaggcggcgcacatgttcggggtcgccgacgaccctgaggaggaagaggagtgcttggtccggcgctccatctgctgcaccctgccg

SEQ ID NO: 56814 - DNA, 571 bp, Triticum aestivum
  unsure (1)..(571): unsure at all n locations
  Clone ID: PAT_TA_56814
atccccggcgtggtcgaataccgtgtactgtaggatggccggagcggcaggagacgctgcagctggccccggggatgccgccgctgcacacgtcgctgatgtcgtggaacaacgccggcgcccccgaagggcagcacatcatcttcgacctcgtgtgccggaacaacaagttcaacgacctcgcggagatgaccgtgtgcaactcgttccaggaggcggaggccggcgcgttcaagctcttccccaacatcctgcccatcggcccgctcttcgccgacggggagttccagaagcccgtgggcaacttcctgccggaggacgcgaggtgcctgaaatggctggacgcgcgggccgacggctccgtcgtctacgtggccttcggcagcatggccatcttcgacccgcggcagttccaggagctggccgaggggctggagctcgccggccggccgttcctgtgggtggtgcgcccggacttcacccccggcctgagccaggcgtggctcgccgagttccancancgcgtcnccggcccgggcatgatcgtcaactggtgcttccatcatcaggt

SEQ ID NO: 56815 - DNA, 702 bp, Triticum aestivum
  Clone ID: PAT_TA_56815
gaaggaaggaaggaaaggaaggaataggtcggcgccgccatggagatgctgagcatgctgaaggtggggtacacggtgctgcgcagcgagacgccggcgacggacctcgtcaacaccttcatggactgggcggctcgccggtcgctcctccttctggcgctcttcatgcccccctactacgtctacaagctcaccgcgtcggccgccgccaccgtcgcgccgcaggacgtcgcggggaaggtcgtgctcgtcacgggcgcctcctccggcatcggcgagcaaatagcttaccagtacgcgaagaagggagcgaggctggccctggtggcgcggagggagggaagcctgcgcgaggtcgccgccaaggcgaccgatctcggctcgccggacgtgctcgttgtgcccggggacgtggcgaggccggaggactgtaaggcgttcgtccaggccacagtcgagcgctttggccggtgtaagtaacgtgccacctgctatttactgcataccttgatagcacatcgatcgtgtacacatatcgatatgctcgagtcactgtaacttggtcaagtggtttgattgcaggggatcatctcgtgaacaatgccggcctggtcaacggggtgctggttggaggagaagcccgacgtcgtcacgttcaagcaagtcttgggcggtgactgttggggcgcggggcattcaacg

SEQ ID NO: 56816 - DNA, 148 bp, Triticum aestivum
  unsure (1)..(148): unsure at all n locations
  Clone ID: PAT_TA_56816
gtccggntcgattcccttatcaggnggctgtttgcttcttctctttttggatcgagtgactcatcagaagtttgctgtcgttttgtcccggcttcttttatctgggctgtcttgttgctggagcttggagntgctttctttacctgct

SEQ ID NO: 56817 - DNA, 527 bp, Triticum aestivum
  Clone ID: PAT_TA_56817
gacggagctaaggctgagatggaggccacattgttttctaaaaaaaagatggaggcgacactgcctgcggcagcgtctccaagatgaagatctaggacgtggacggaggcagggatgatgcaaattgtcccagcgtcgttggcggaggacatgtagctggttgtggggttcgggtgaaggtgagttagagggatgaccggtggcagcggcggcaactcgggcagaccagggcgacgaggctgcactgtgggtgttcgtgtgcctggaggaagaaggttacggtccgtttttatatgtgtatcattacattgtctgaatcatcacattgttatgattaatttgtaccttgaattgttaaaggagaggggaattaaaaaaccaaaaggttctctaaatgcagcttcttcaatacatttatattgacagttgatagatggatccagtaggccttggtagtgctaagcgtgtttgaatccactattgcttgagtcgttcttccggtctctcattggtacatgggggcgtgc

SEQ ID NO: 56818 - DNA, 454 bp, Triticum aestivum
  Clone ID: PAT_TA_56818
gaatgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcggctcaaaagaaccaaagctaacgaacgggggcgggcaaggcaaaaacttttgaaaaggggaaccaaaattaaatcaaggggccggggtttaaaaaggggggggggggaaaaaccgggggggtcccaaactaaatggccggggagaaaacccccttttggcaagggggggtattggcaaaaaggcccgcacagagggcccttcccaaaagtggcccagccgaaagggcaaagggaacgcccccggggggggcgcattaagcggggggggggggggggttccgggcaggggggccgggccctgggccggggccctagggcccggcc

SEQ ID NO: 56819 - DNA, 583 bp, Triticum aestivum
  Clone ID: PAT_TA_56819
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaaggacccaactttacgacccggggctggcaaggtaaaattttttttttggggcccccaaatttaaattacggggccggggtttaacaagggggggaggggaaaaccccgggggtccccaaattaaatgccttggaaaaaaacccccttttccccagggggggtaaaaggaaaaaggcccgccccgatcccctttccaaaaattggcccaccctgatggggaaagggacccccccctgtaggggcccttaaaccggggggggggggggggttccccccagggggcccgttactttggccaggcccttaggccccgctcttttggttttttccctttctttttcccccaggttggcgggttttcccgggaaggctttaaatggggggcccctttaggggtcccatttaagggttttagggcccctgccccccaaaaa

SEQ ID NO: 56820 - DNA, 688 bp, Triticum aestivum
  unsure (1)..(688): unsure at all n locations
  Clone ID: PAT_TA_56820
ccaatgcgggaccctggagcaacaccgatacatgatggaatgcgaaccccgatgcgtagtagggcctgggctcctatgagctcctccaagagataattgggaagatggaaatcctgatacttggggaagcagtccagcttaccagccaggaacaccaccagctcggccatatgaagccccaacacctggatcagggtgggcaaatactccaggagttagttataatgacgtcccaactcctagagagggcaattatgcgaatgctccaagcccatatgtgccttccacacctgttggtcagccaatgacaccaaattctgctgcgtaccttcctggacacctggtggtcaaccgatgactccaggcaatgctggaatggatataatgtctcctgtaataggtggcgagggtgaagttaactgggcattgccagatgtgttagttaatgtcttggcggcaggtgatgaaggacctggtgtggtcagggaagtgcttggggatggaacttgccgtgtggcacttgggtcgtcaggcaatggagacatctgtgacggtccttccgtctgagcttcgagtcatcagaccaaagaagagtgacaggatcaagatcatgaatggtaccttgcgggggatttgttggaaaacttataggattagnacgggttctgatgggattggtgaagctcga

SEQ ID NO: 56821 - DNA, 693 bp, Triticum aestivum
  unsure (1)..(693): unsure at all n locations
  Clone ID: PAT_TA_56821
ggaaaagttagtttgcttcgagtatctacccaatggaagtcttgataactatatatcagatgaatctactggacttgattggagcacacgctataatataatcgaggggatctgcaaggatttaatttaatttaccttcacgtgcaaaatgataagcctattattcactttgaccttaaacctgcgaacatattgctcggtgaaggtatgattccaaaaattgcagacttcggtctgtcaagactgcatgatcaacaacagtcaatttacacaacatcccgtcttggaacacgtggttacatggcacgggagtttgtggatgaaggaaaaattacactacagttagacatattcagtttgggtgtaataattttggaggtagtaacaagacataggcactacccggacgttattacagaaacatcttcggatgattttatcaagcttacgcttgagaaatggagaagtgtacaaaggtcacccgggcatgattccccaaaaccagactacgaacaaataaagagatgcctnacaggtcggtctattggtgtgtgaatcatgaccacaccaagagacctccgataacgaaggttatcaatatgctccaaggatcagaaattattgactccaacatcagcaatgaggaagcagcgtaatcggcaggccatgtataaatgatcacttgacagcatg

SEQ ID NO: 56822 - DNA, 368 bp, Triticum aestivum
  Clone ID: PAT_TA_56822
aaaatattagggacggaaaaaaaaagggaaaaaaaaaaaaaggagggccggacaaaaagaaaccaaactgacggacccgcacaaggaaccacggggccgtcctctggcgtcccctaaatgggtgcactgatggggcgccctacatctactccactggggaacccctgacgtcgcccacctggggggggggggagcagtcccccccttatccgcctgccgtacaatcccctaggccgcagcgggtgggccttcgaacagcccccgcccgctgaccgctgccagggacgggccctgcagaggggcattaggcacgccgcctgaggggctgacgcccggggggaccgggcgcggggccagcgccctggcgc

SEQ ID NO: 56823 - DNA, 338 bp, Triticum aestivum
  unsure (1)..(338): unsure at all n locations
  Clone ID: PAT_TA_56823
atgaacacaagattgacgacgcgatgtgagtctatgccttcttactcccgcgtgcgaaccacggcgtactgttttttatggaggacggtaaagtcaattctttgtgctgtgggctagatcaatgcggtcagtgaagagccagtggtgaccctaatgaccagcatggccacgcatctgcctttcccaagcttgatgtgtacatatgaggccccgaacgttgcgggcttccagatgtttggccaacactgaatgcggagacgaacactccctgccccgccacatcaagcgcggcgagcgggcnttcctctcgctgggggccccttcccctggccatcgag

SEQ ID NO: 56824 - DNA, 482 bp, Triticum aestivum
  unsure (1)..(482): unsure at all n locations
  Clone ID: PAT_TA_56824
ggccgccctttttttttttttttttttttttaaactggaacttagttcagccgaactccgtgttggcgaacgagtttaattctgacataatgttacattatttccagctccacgcagtttgtttacagggttcattgcatggaggcctaactatagaacatcgcccgtagtgacgaggacgactgggcgttcaagggcgtgctcttgtttttattcctagaaccgtgggccgtcatctacagagcggattggaacagcatctcagccagttcctgtttgccggatggaacggttggctcgccccattccaagaccttcttttctagcgtttcaaagtctcccttcccagcctcgatcatggcaccaatctcagtgtcaaagctctggtagcgcttgcggacaagctcgtccagggaaccatcctcaatcngcttggcaaccatgcgtctctctctgggcgtngctgccatcctgagcttgag

SEQ ID NO: 56825 - DNA, 190 bp, Triticum aestivum
  Clone ID: PAT_TA_56825
ccgagtcgaagaaagagaagtgcattgtaatgtaaagatattccaggaacagaacaggagaaaagaaaaaggagacaagaagcaccatacatatactgtaaaaaggtcttcttgtctcatgccgcaccgtgcttgcggcacggcagacttaaatttgtagccagcctccatcaagccgtttctcgttttt

SEQ ID NO: 56826 - DNA, 398 bp, Triticum aestivum
  Clone ID: PAT_TA_56826
caaaaaccctagagacctcccgcctcgcctcgccgccgccgccctgcccctctcggcgagccgggattccagcgcgacacatctcacagggaggccgccgggcgcggaggcgatggtggccgagctgcggcgcgacgacatggcggaggaggcggggaccatccgcgactccgtggcgttccggctcgtcgagcgcgtgctccagtccgtgcggatggagccgtttctaattgccccgtatgatctggagcaatataggatgatggtaggcactctagacaccagcaggacaaagaatcgtgacgacgaggctttgtatgtgacgtatttgaaggcattggcagaagcaggatgcagaatagacatcacggaccatgattcgcttttgaacaatatat

SEQ ID NO: 56827 - DNA, 226 bp, Triticum aestivum
  Clone ID: PAT_TA_56827
gcgtgatggtcagttgggctatacagaggttttgtgccaaacgcgttgaaaaatctaccaaatagcagcatgtaaactcaccgcattcgacacaatgaagatcctgatatctactgggcaaaaggaactggaaaaaataatgcaagataatcaggagaaaacaagctaggaaaatagcgttgcacaaccttaaagctcggggagctggcatacaacccctttaatg

SEQ ID NO: 56828 - DNA, 678 bp, Triticum aestivum
  unsure (1)..(678): unsure at all n locations
  Clone ID: PAT_TA_56828
cggtccggnaacttcccccgggtcgacnccacgccgctccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgttttaaaggccccaattttacttccccggccggggaagggaaaattttttttttggggcccccaaatttaattcccgggcccgggttttaaaaccgggggggggggaaaacccggggggtcccccatttaattgccttggaaaaaaacccccttttccccggtgggggtaatagaaaaaagccccccccgatccccctttccaaaatttgcccccccctaatggggaaagggacccccccttttgggggccctttaccccggggggggggggggtttccccccaggggacccgttacctttcccggcccctaagcccccttctttttggtttttttcctttcttttttcccccgttgcgcggttttcccccggaagcctttaaatggggggcccctttagggggcccaattgagggttttgcgggcccttcgcccccaaaaaccttgtttggggggggggctcccgcggggccccccccc

SEQ ID NO: 56829 - DNA, 492 bp, Triticum aestivum
  unsure (1)..(492): unsure at all n locations
  Clone ID: PAT_TA_56829
cccggaacatcccccgcgaggtccgcatcaggtacggcgatcatcggttccgcaacgtcgtgcctgtccagatcctcagggtttgggacaagtccctgtccaccgacgccaacggagagtacgtgcctatgttcgaggccgcggcggcggcctcctagctgaatccactttggattttagcttgtagtactagtactaatcccggtctgggtgagacctggaggcagcaggggcttgatgctcctttggttcgtatagtctccatggatctcaccgactagctagcttgtgttgtgtgttgctgcgataagagcacgcagctagtagagtattagaccaagtgcttagcaggggcttgatgtggtagccttcgttgaagttcgtctgttgtctgtcaggcatgttagcttgtcaagggcttaatttgtaatcatattattatgtctcaagtagtatgaactatgaagtgaataaaaattnatctataaatat

SEQ ID NO: 56830 - DNA, 723 bp, Triticum aestivum
  Clone ID: PAT_TA_56830
atctgaaatatacgcacttcaggattaggtgcccttgctgggttggagccaactaattttattacattggctaccccacatcttggtgttagaggaaaaaatcgggagggtggccatcacacgttaaattatacttagtcaaaccttttgtaacttcccatctaatcttgggtgccttgaaagcaaaggctttgccttggtgtttgagcaatttttaacgacccattaaggattttgtgaggtagacccataacgccgtgccatatcacttttcgaagccaaggccatctaagtagacttctggggaaacctatagctggtgctcactaacaaaatagggatactactgtgccctctttaatatcaagaatgctctgatttcatgcaaatccaccccctttggcttttatcactttctatttcttcaagggctgcgatttctacagaaacttgcagcacctttggcgcccttcattgtcgggcgcactggtgctcaactctttctcactgatggcgaacctagcgagccacctctccttctactactgacatccgaccacgaggacattaagcctatgtagggtgagggggacagatcctttagaggcttccttattctagtggaaataatgtttcttcgtctcaccagatctgctctagcggctttggaagaccgccttctgtatgctatggttcatatgaccgcgtcctcctatgaaatta

SEQ ID NO: 56831 - DNA, 363 bp, Triticum aestivum
  Clone ID: PAT_TA_56831
ggacaaacgaagcggcccgggccttttcttattacaactcggtactaaaccgatcgatcggacgaacacgagcagtagtacaacagtagaaacatcacacacacactgacacgcacgaacacacacacacactcgctcgtgtagacacgtacgaaggcgctagcacacatagatcaggtagtagacgacgcggcgcggcggactgacatcggcctgctagctccagcttacgacgacgccctggtgccggtgccggtgccggcgcccgctccgccggtggcgccggtgtggccacctcctccggcgcgcgcgtcctccgcgcggctctggatggcgtggccggcctgctgcgtcttgtgcccc

SEQ ID NO: 56832 - DNA, 461 bp, Triticum aestivum
  Clone ID: PAT_TA_56832
accgaacatagcagcatagcatctccccacgctctcacgcatcaccacagctacagcatcaagatcactagtagtagatcaactagccaggtatagctatggcgtccgagcagagtcgccgcgaggagcgcgcgcaggccgcggcgcataaggcgaccgacgagctcgccgcggccaggcgggacatgcgcgagcccagcagcccaggacggcggaccggcatcttcggcaccgtgcaggagagcgcgcgctccctgatgggcgccgtccgcgacaccttctccggcggcgtccgggacacaaccacggcacacgacagccactccacaggcgccatggggaccgcgggggggaaactcaatgagtacgggagctacgcatcccagaaggccgatgaagggaaggagagcgcgagtgagatggcggaagccgccgcggggaagaccaaggagaccaaggat

SEQ ID NO: 56833 - DNA, 661 bp, Triticum aestivum
  Clone ID: PAT_TA_56833
cccacgcgtccgccgggaggaagaaccctagccgcccttaaggtccctgttccccacgccgcctctggacggacctgcgaataaaactgtgaatgttcgcttacacctgatgccctcctacgcacataatgaggagtaactatttttctactcttgagactgaaggtttataaccactatttgagtggacttttagtctggagtagggggtagctgcacttgtttgtatcctgagacagcaagtttgcagatagaaccttgaactagctcctctgtcacctgtatcaactcgagtgtccttggagaagctcctgcaagcaacattaccaatttgcttggatcctttctcatgggaaatattgtcaacactgttagaagattagtgaatgtgatttctgagggcttatctagtacagtatcacctaaagagaactgttctacagacgctgtggttgctaagggtttggaacgtggtccagccagggatacacataagagcaaagagttgagaccacacagtgttccttctgaaaataatttgtttcactgcgacgcttacgagaaattgatcaacggtgagcttaatttaagttgtagaagcagtcctgaggcttcagaggactataaaatgataccaaatgcagatagagcagtgtctggt

SEQ ID NO: 56834 - DNA, 559 bp, Triticum aestivum
  Clone ID: PAT_TA_56834
agcgagggcgagggcgagggcgcctcccccgccgtccgcgccatcgccaaggcccgccgcgccgagcgcgcggcggcgcgcctcgctgccaagaaagacgacggcgccccggcccctgcccctgctcaggcggcgctgccgtaggagcgagcatcatcgatagccaagccatggagctggtagattaaattagagatcctatccgtgattggcgtcgtcgtcggctccttcatccgtgattttcgtgtcgaatttccattttgtcatgtcatagggactgcacttttaggattaggggtttaagagcagccagcaatcaatctagctgctcccatgggtcagtctatcagtcagtcagtcagcctcttccggtcgtcagtcgtcttagtcgagttcgtcgagtcaagctagcggaagcgagaaacttattagaagagcaggcaggcaggcaggcatcaccatcccgtgcaactctgctgctgctgctcatggtggccgatacctgataaaccattgcatatttgcgtgtcttgaaatggaacactcgcttgtcatgttc

SEQ ID NO: 56835 - DNA, 248 bp, Triticum aestivum
  unsure (1)..(248): unsure at all n locations
  Clone ID: PAT_TA_56835
attggaactggtggtagtaaatagatggaacagaagtgaaatcgagtgttgcatggactgagaaacntcgaaatgggaaaatattaaacagctgcacccagtgaactaggatactgagaaatcacgaacatngcggatagaagcactaccaaatcttaggtccttggctaactttctatgaacagaagccaaatnctgcgcacccctgggggaaattcaaccacccaggccacaaagcttccttttgg

SEQ ID NO: 56836 - DNA, 554 bp, Triticum aestivum
  Clone ID: PAT_TA_56836
attgacaacagttgttgacttcaggatatttcatggatgagttatactccttgactcccatgagtgtatcatccgcttgctatgcgaactgaggaaatcaaagtggcaaagcaattgactgcatgtgttgacttcaggatatctcaaggacgagttagaatctatgacgctcagggatgcatcctctgcttgctacacaaactgaggaacccaaagcaccaaaccttggcaagaggcaacgactggggtgttcgattcgatcctgcgccatggcccggcccctgcaggagagagagatgaggggcagagagagaaggaaggagaggagggagaaagagagagttaggtgaatgcactggactcttcaagatcgagcgcaccattggaaaggccgagtacgtccatcgacagcctgcccagtgtccggattcaccaagcagtacaaccggagacgctgtcggctgcctgcaggcaacaagccgtcccgttgttgtctctgcctgaagaaggattatgggtctcaacctctttgctactcatattaaaattccgct

SEQ ID NO: 56837 - DNA, 148 bp, Triticum aestivum
  unsure (1)..(148): unsure at all n locations
  Clone ID: PAT_TA_56837
cagctttacaagtacattggtgagatgcctccagagggcatatcgctgatcggaccnactggctccggcacgagcctgatcgctagagctgctgccaatgaaacaggctgcattcttgtttctgatgaatggcccagagattatctcc

SEQ ID NO: 56838 - DNA, 465 bp, Triticum aestivum
  Clone ID: PAT_TA_56838
gctgcctacacaatactgttgtagcttgtgactgctgacactgagcagtgagtgagctgacgttgcaccttacagcaagcacactgagatgtctcattgtccctttttgccttgtcctgaacagttgttattaccaatttcagtttcggaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaagatcttttaaaaaaaaaaaaaaaaaaaaaaaaaggggccgttttttaaaaacgccgtgaattggaaaacccctggggttaccaaacttatttttttttggagcaccttctcttttttccggggggggttttttcaaagagggccggggagaaaacccttgggtacccatgctaaatcttgtttggaaa

SEQ ID NO: 56839 - DNA, 400 bp, Triticum aestivum
  unsure (1)..(400): unsure at all n locations
  Clone ID: PAT_TA_56839
gcgccgtatcatgcatgtagatttcttatgggtagcggaaatgaaagaggctcatttgctatgtcatttctatccactggtctagataagcgtctagtggacagctcaaatgattgttcgataaaggctgtagttttccaggttgttccatggtctgttaaggtctactatcacagcctagaagttttcatcggtgggaatagcatggctatctcagaagcggttgtcctgatacatgtcgctccntcggacgacntgcttttgcctggtgcngtggnggtgcttgttatgtttccttgtcgcttgcgcttggctacccttgctttgggcttccgcggggggttcctacccgtggatgatttccctcgtgctgctgctggcggttttgatgttgcatcgg

SEQ ID NO: 56840 - DNA, 648 bp, Triticum aestivum
  Clone ID: PAT_TA_56840
ctacgccaccgccgccgccggggaactcctcgaccagcccaccctcctgccgctccgcccccttcccttcccatcgccgcagtcgccccctccatctcctgccggagccactcccctgccgcgaacatcctgctcgcgttgtacatgaccggtacggcggccctgacggggagcgagaaccgccacgggaacgcggtggtgagcccctcggtgaagacctgcgcggagagcaggaacgcgtgcggggccatggcggcgatccccgtggtgtccccggaccggaggccgtcgaggatgtacagcgccgggagcacggggccgacgaggaacccacccacggtgtgcgaggggtctcttcccgtacgtcaaggcatcccgcctcacgtttcctctttcggcatcacgggccgccgccgcactccctcccccggccgccccgcgggcttctatctctcccagctccgctgccgcgccccgtcttccatctctacatgaatcgctgctgtggaagccatgccccaccgcgccacccggcggccatccgggcacgccgtgtccgggatgatggagttgagtcggccaggtccctgttcccgtcggcatcttctgcatcgggacccggggggccaagccgcgcgctgctcatct

SEQ ID NO: 56841 - DNA, 250 bp, Triticum aestivum
  unsure (1)..(250): unsure at all n locations
  Clone ID: PAT_TA_56841
ctcctccccttccggttcgggttctggttcggttcgggtccgagagtagctagcctagtctagggcttccgtagttcggagaggagagatagggagagatccatggtggntacggggttccgctgcttcgtgggcgggctcgcctgggcccccgtcgncctcttcctccggcnggccttcggccggtgcggtggggtcctcggcgccttcttcctcttcggccgcggggcgggcgggtcccgtggcttcg

SEQ ID NO: 56842 - DNA, 232 bp, Triticum aestivum
  Clone ID: PAT_TA_56842
tgtaaaagagttgaaactctatcagtccagcacgcgatcagacggtgagcggttccctccccgagtactatggctccggcggtaatggaggtcgcgccagcgcccgtggccgtggtagccgagccgttccccgtgcaggggcacctaaaccagatgctgaacatgacgctgatgctcacgttccgggaactgtacaaacactacagattaacccgtgcgagaagatgatcag

SEQ ID NO: 56843 - DNA, 571 bp, Triticum aestivum
  Clone ID: PAT_TA_56843
cccacgcgtccgctctcctccatcctcttctgcttccttcctcctccccggatctgcaccccatacgaggagtaaaaatggcggcggcagagcacggggttggtgacagcggttgtacgaggtggtccacaggcgatgaacggccgccaagcattcctccgggcaccgcaccggagcctcagcggctaaggctacagtggcgctgccagtccctcctcttcctctctctctctctctctctctctctctctctctcccatgccaccgttcccctccctcatccatcgacacggcccagtccacctcaccgagagctctcagcagtagggggaatggcagcgacggtggctgctggacagtaggggcccgctgaggtggtcctttcgaaggaagggggagaggatgccggtgacaaggaaagaagatagtaggacaaagctacaggacgagtgtggtgaaaagaattatttgctttgtcaatgtataaggggagttacgtgcatggtagaggtgcagatcaaggaggtcggcttatgggacgagggtgggtgacgtgtacaagggaggaaaa

SEQ ID NO: 56844 - DNA, 697 bp, Triticum aestivum
  Clone ID: PAT_TA_56844
gaactggcattgcctttagcagaagtggctgacaatgatggtgagggtaccatagaacgcccttctaagaggcgttacaggcgaaatggctctgcaaacgctacatttgatcaagaacgtagcagcttgtatctggcaaagctcatcattttgcatgactacccacttcatattgttcaacagccagccttcagcgctcttattggtagtctgcaaccgtgtttcaagttgtcagacgttgatgcaatggaggggagaagtgtatgctgtttatctgaaagaaaaacacaacctactgcaagcattaagcactatgcctggaaggatgagcctcaccgtaggattatggataactagtcagactcttggctatgtgtcaattggcggggcagtttattgacacggagtggagagtgcatcgaagagtgcttaatttcatgatggttgcttctcctcattcgcaggatgcacttgctgaagctatcagcagaagcctttttgactggggcatgagggagaagctactcgccatcacattggataacgattgcccatctcatgatatctacagtgcaaaccttgagagatcatctttccaataagaacggtgtcatgcttaagggccagctatttgttgtaaggtgctatgcacatatcctgaacgcagctggacaggatgtgataacttcagtccatg

SEQ ID NO: 56845 - DNA, 125 bp, Triticum aestivum
  unsure (1)..(125): unsure at all n locations
  Clone ID: PAT_TA_56845
ggcttgcggtgggtncctaggcgcgccgagacgaggaggggcgtatcatgcgacgcgctgcttcggggggctggntggttgcgtagatccggagattccccgtaggtgaaccttttaaactgcct

SEQ ID NO: 56846 - DNA, 757 bp, Triticum aestivum
  unsure (1)..(757): unsure at all n locations
  Clone ID: PAT_TA_56846
ctggcttattagccattacagagctgtaaagcagaaaagcagaaaagtgcaagcacatggcttgtcggacggtgaacagcttctcccgcgtcttctaagccgttggatggttgatcgacggaggagagaaacccacttaagtgaaccgttagcttggccctgagaccgtaggatttgagatggacggctgtcaatgcaactgacatgcaggaacaggggaacttaagaactgagcctgacaggtgcatatcagggtgagcttccccaatccttatttcccctccgctcatgatctctctctcctacccatcttctatgcaagatttgtgtagcctaaagcctttgtatgatacgtgtaggtatacctttggaagaaaaaatcaatcaaatgttaattctccaaggtgacttgccttttctacgcaggtactgcttgtttagtactgtggatagtactgtggataagtaaatgtaagcatgccccaataatgatacgaacaaggtttgagaggctcaatcattttcatttatactaagaattaaccagttcactaatttctatgctactaatagtgtcgtctgaatatatctactacattcactgcactgtgcttacattcacactgattgtagctgcaagntaagatctaattgtncaagataattctgaggacctancacaacatgcgggtttgaactaagtgatattttctggccttactccatgtacttttaaatcattttaatgatatcgata

SEQ ID NO: 56847 - DNA, 710 bp, Triticum aestivum
  unsure (1)..(710): unsure at all n locations
  Clone ID: PAT_TA_56847
ggaggcttcagtctaccttgtaaagcctatcttaatgactatcatgtcctccttcgaaggtacccccacaacaggttatgttggaagagaagttcctaacaatatggtttctaaggctacactttctcctgctctagaaacagcattggactactatctgagggttttggctatatccatcagttatgcgggtcctgtcttgctgaactatagagaagaattaaagcacgtaataatgtctgcattccaggccccttcatggaaggtcaatggagctggtgatcatctccttcgctctgtgctaggaagcctggtttcattttatccactagatcagtataagccattttcttgtcattccattgctaatattattgagccatgggggttgttcaaaagctcatcaggacagggaggttgaaatgcttaattttcctccgaagtggcatgatcccagtcaagatgaactatcttttgcaaacgaattgttagaatttcatttccagtcggctgtggaagatcttttgactatttgccagatggaagttcagtctgagacaggagatgagaaggagcacctaanagtaacactattgcgcattcattctgcattgcagggtgtaatgtcgtgcttacctgaactgcgtncatcatataaagatgggaggtccaaggtagtagaacccantttctttattgcaggatcctct

SEQ ID NO: 56848 - DNA, 290 bp, Triticum aestivum
  unsure (1)..(290): unsure at all n locations
  Clone ID: PAT_TA_56848
cgctcgaggagggggtgggggaagaggaggaggaggcatgccggaggcggacgtgctggccgcggtgaccgcggcggaggtggtgtccccgcgatccggctacttccggcagcggagcataaacaccccggatccggaccgcaaggcgttcgacgtcgagaacccgccgggggcctccgtgggcgccaccggagtcggagcaggagggctggggctccggcccagcgagtccgtcgccaanctgnactcgctgtaccgntcggagcgcgccgccctggcgcccncggtcg

SEQ ID NO: 56849 - DNA, 492 bp, Triticum aestivum
  Clone ID: PAT_TA_56849
gttctaccattatttttttaaaaacgggggtcctagggggcttagccacaagagcctgatcatcgacaaccccgaggcaacaacattcgcggaccgcaaacataaaaaaaacatgggcgttttaaaaaggataacacaaacgaggatacagaaaaaaagaggaagacgcctggggggggggatcctaaaacactactggtggttgttgtaggggtgctgggagtaatagggggcccccgcagagtaggagtcgtcctcaaaagggggggcggggggctgggggaccgcagctggggggggccccccccataaatagaaaaaggggaaaaggggggaaaagagcaaaggggagtgatgcaacagagtcctcggaatcgaggtactccactacagcagggggggcaaaaggtggaagggggtcatatggggggggggggactttatgccgccatactaagggggggacaaatactgggggggaaaactatgctg

SEQ ID NO: 56850 - DNA, 637 bp, Triticum aestivum
  Clone ID: PAT_TA_56850
ctaattcctacacattaacctagaatcagttgttgacaagagaatacgtagtcatttgatcctttgtctcatttttgggttgtaaagcagaaacataagctctcttttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttaaaagaaccaaagttaaggaccgggggaaggaaaggaaaaacttttttaaagggggaaccaaaataaaataaaggggcgggggtttaaaaagggggggaggggaaaaaccggggggtaaccaaattaaagggcttggaaaaaaaaccccttttcccaagggggggaaaaagaaaaaaggcccgaacggagggcctttccaaaaagggggcaacccgaaagggaaaagggaacccccccggagggggggaataaaggggggggggggggggggttaccccaaggggaaccgtaaaattggcaaggcccaaaaggccggcccctttggttttctccctttcttttttggcaaggtgggggggttttccccgaaaagcttaaaagggggggccccctta

SEQ ID NO: 56851 - DNA, 681 bp, Triticum aestivum
  Clone ID: PAT_TA_56851
acttattgtaaatggccagcgtacagtatacaggctcccagcctacggcctgcgacgtgctacgtcttatctcttgtatactgacacctattcacagtccactggccgacagcgtacagactggggactgccagaaccctgccagctcacaactcatgcacctcagtaccactttccccttttggcatctgacggaataggcaagaacccatcgcccttcgcacttgccgaccattgtgcatgctgaatgggacgcgccacgcgccctggcatgaagcactaagcgcggggggggtactggcaacgcgcacggtgaacgtgacactggcctacggcctactgcttgctcctttttctctttcttcttccttacgcgccacggttgtccgctttacgcgctaaactctaaactgcctgcacgctttagagttacggcttaacgcgtcacggaccccaaaccactagatactggagaagggtgatggatcacgccatgggcctgatacacggtagacggcccttcgaccttggacgtcacagtccaaatactgaacactggactcttgctgcaacatgactcaacactaactcctaccatggtctatacttatgatggataatgcagattgccgactattggctattggttgagctgagtgctgatttatcaaacgcgtatcg

SEQ ID NO: 56852 - DNA, 502 bp, Triticum aestivum
  unsure (1)..(502): unsure at all n locations
  Clone ID: PAT_TA_56852
cgtcaacggaggacaagatggaacatgtcgaggagttccctcgccgctgcctcacgatgctagcccgatggctctgcccgggggctgaggacgatcacgccgccatagcccataggctcggcatgttgcccaaatccgaggtcgatcacgccgacgacctatcccaacgggtcgagcactagcgcgccgccatatcccattgggaggaggccgggcgcgccgctgcccgcgagcctgcaggccttcaccctccgcctgaacaagcgcctcgccgccggcgccgacaggagcggcaacctggtcttctcgccgctgtgcctctacgcggcgctctcgctgtgggccaccggcgcgcgcgagcgcaccctcgacgagctgctcggcgtcctcggggtgcctttggagggacgtacaccacctttcacgtntgcacgctgccccgggaaggcccttgggcgaccggccccgggacgggccggcccgcgcgtcagcttcgggtgcg

SEQ ID NO: 56853 - DNA, 316 bp, Triticum aestivum
  Clone ID: PAT_TA_56853
gccggaagcctatggcctctgcatgagtgtggctggtgatgctatgagggtcgttgatgaccagcgccgtgataggtggcctgacatgtgctgacgtccttccgtcttcaggagcaacctgcgttttgacaaggagcagtatatcgtctcgcatgaagccgctcatcaagaacctgctctgccgagcttgaaggggatgacctatgtgctttcaagaagaatgttggtgtccgccacaaggcatcgttcttagcaagctagaagacctttacttccttgttgctgggagcatgcgtgatgatggcggagcggtgtt

SEQ ID NO: 56854 - DNA, 790 bp, Triticum aestivum
  Clone ID: PAT_TA_56854
ccccgtcgaaccctaacccgcaccctgatccgccgccgccaccaccgcctccaccaccagcccaccgaagcctcccaccgttccattcgcttccctcccaccgcttcctcctcctcataaagcctgccccgttcgaaaatctttgcctccagatcgtgatcctgcggcagttcttggatcgccagatcgatcggatggctgccgcggcggtggacccgatggtgcttgggctgggaacgagcggaggtgcgagcgggagcggagtggtaggaggcggtgttgggagagcaggaggagggggtgcggtgatggaaggggcgcagccggtggatctcgccaggcacccctccggcatcgtccccgtcctccagtgagtccgaatccacacaagatgatgatgatgtgtgtttacgccgtgaacgaaacctaaacgtgacacctaatttggacggggttcgtagatctcgatggtgttgtgttggggaatcccgcgttttatctaatctagatagaggtcggccttctgcacgtgttgcagtttcccatacctagccggtctcattttcttgcccaatgatctgaacataatgcggtgattgctgcacggagtctcttacccgttattgtagatcttctctcgggaagtttcttggggcaaatgtttgacatgctatctgtagttgggaaatcgtatgtccaatggtaaatataagaagtcaggtttgggaacatgatagtagtgaatacaacatctgtgtttgtgccatggccagttgccagcttacataaa

SEQ ID NO: 56855 - DNA, 705 bp, Triticum aestivum
  unsure (1)..(705): unsure at all n locations
  Clone ID: PAT_TA_56855
gcttgccctttgttgctctccggctcccacgctctccgcccggcccccgctgcacaaacttttactactcctactcctgcgtctccgtcccccttcttcccccttttgccacttttggggacctcgacccctctcaaatccagaggaaggccggggaaaagcaagcacaagcacagctcccccctccagctccagccaccccaacaaaaggttccctctcccccttcccttcccactcaatctcgccgctcccgtcctccgccgccggttcttggatcctggatttggcggccgaaagattccatatttatttattctgcaaggtggagggagggtgtggcgatgggggcgtcgcctgatctgccggcgtccggctggtggagcgcctcctggacgaggcctgatccgtattggtcccagtgatctggccgtgccggcggctcgggtccgtggtgccagggtttgtctgctgcccggcggctgcttggagatctttcttgcgctgttgcctattggggggtgagttcagaagctgcgaggatttgcctagatccctcttcgttcctgctgctgatttgctgtgctgggatactgctanggttttgggtgtggccatangttgtctgtggtagtacaagatgattaaacagatccttggtaggctgcccaagaagacagggaaggccggcgatggcccggatgctg

SEQ ID NO: 56856 - DNA, 698 bp, Triticum aestivum
  unsure (1)..(698): unsure at all n locations
  Clone ID: PAT_TA_56856
ggtatgtttgtttttgggctggttgtagatggctttgtatgttatggtagtgtgcttgctctccctgctctgctttctcttggagaagagaagagcagggtaagtaaaacaaacaacacttgtttgcagctaatgcgtacaaacacactagcagctctcttttaatgaaattcttcaatctttccaattctgatgattttttaactgtatatttcagaaatccaagggcagtagtatttcataagaagtggtgtgtgacaacacgtccgatgcttcggtcctgaagctctttgggaagacagttgttgtgaacaaatcacatcagctgccaagccgacggtggtgaggacaccgagttcgtcaaggaggagcagggatggcgcaggcgatggaggagtggtaccagcagatgcccatcatcacgcgctcctacctcatcgccgccgtcctcaccaccgtcggctgcaccctcgagatcatcttgccgtaccacctgtacctgaaccccaagctggtggtgcagcactaccggatctggcgccttgtcaccaacttcctctacttccacaagatggggaagaaaaatggagctgataatttgttaggctattcaaaacctgggaggaagatgagtactctggttactgataatntgtagtcatgctaacagaatttacaactattgtttgattcaaacc

SEQ ID NO: 56857 - DNA, 456 bp, Triticum aestivum
  Clone ID: PAT_TA_56857
gcgtccgttctattccgtggtagcagagctgtgccatctccaccgtagacctaggttcctgcacgtcgcggtcgccggcgagttgctggcagccgtccccgtcgagttcgtgcgagtccaggtctgactcgggtgagtcagactgtgcagcaccgcgttccttcgtcgccccggctgcgtaagtccaggtcgaacttggccgccgccgccgccatcctccgtctcccctgtcgtgcgagtccaggccgggctctgggcgccgcggaaatccgttcctgtctaatttgtggctgtcgtgctgcagttcccctggctgtaccacccaccgcagtcctctttgcccctttttcgcatccgctacttgtggctgctactgctggctgagctggtatgcgctgaaccttctattgatgcgctagatttgtgctgttgtgagctctcaaaacgaaaaagtag

SEQ ID NO: 56858 - DNA, 690 bp, Triticum aestivum
  Clone ID: PAT_TA_56858
cacacttgatgaccaccgccagctcgaccgcgaccctatgcgagctgacattgtaccacccccttcgcaccgaccggctgcaggcggagctctgggacaggctgcccaacgcctgcgacgggaaggaccccacctggacatatgagcccaagacaccaacccacttaggctgcgccaatgacttacccaactgcaccatccactacaacgcttccctgtgacaagaaactggatgccaatcaccccctaaggatgaacaggcttggttccagtgccgacaacaccacctagcaaatgaggggaaggagaacatgacgaaccacatcccgggtgacaagaagaccaccgtcacacatgccgacatgaagaactaacattgctaacgacctatattgactataggcctttgcttggatcacgacggcctacatgatcaaacgtggcagagaaccatattacgactacaccagactatgacctataaccgagactcacggtatcgaaagagggctttgaagcatgcttaatcctaagatcttgaagatctactgcaccatctctcagatgagaacgctggcctggataccgatgtcagcaccattctgctgaccaagaaacaaatgctggtggagaaaatgatagaacagtccaaagagaacgtgaacgccaataaaggtgcccccctctcgc

SEQ ID NO: 56859 - DNA, 679 bp, Triticum aestivum
  Clone ID: PAT_TA_56859
gtttttgttgaaacattgaataggtgcttcaagaatgtatgtgagcttgacattgtatttaacttcaacaaggtacaatgattctctttgtttggtatttactctggatagtcactgctataataaataaagaccacaaaaacattggtgttttttatcctcgtttgcagcatgtatgctttttgatacatgggtcataaaaatcatatgcaactgcccaaacaaatacttgaatctaacaagacctacaatgctagattactgcatatctgtttcattttccactactgaccaaatttttacagttggaattcgaagaagcattctccgacttaaaagtatatgttgttaaatcatgctggtgtttcactgaagttctgtagtaccttggtagtgggcacctcaaactcacagaagcatgtagtatttagtgtacatctcaaccaaagatcaacatcacaattgaaatggtaacttataaattctatatagattaggataaacaaatgggtatgaaataccaaatcctctcgagctgttagacaacttatctgtaagtgagcattactgtcctgtagtccaccggcagtctggcagagagcttgaagaaaagtgtaggaagggccaatccaatataacatgctaaagggacctgttaaaaaaagatcgataacttttt

SEQ ID NO: 56860 - DNA, 223 bp, Triticum aestivum
  Clone ID: PAT_TA_56860
cttccctcccacctacctctgcgtggtggtggcgtgctcttttccgaggaccgaccgtggccgtggggagcaatgctgtgacacgagatggtgcaggtgtaaatgcaatcgaaatatccggcatgagccctctctctgagctggtgtggtctccggatgatggtctcagcattaaaatcgcagcgtccagcctaagcacaagaaaagcctctcttcgctggaa

SEQ ID NO: 56861 - DNA, 105 bp, Triticum aestivum
  Clone ID: PAT_TA_56861
ctttactggggaaaagtgacaatacaaccaccacaggatgacttggaactctaaagtggaaacagaatttcaatatcacgatccaatagctgtctccacttcgag

SEQ ID NO: 56862 - DNA, 722 bp, Triticum aestivum
  Clone ID: PAT_TA_56862
gaaactttacagcgaggcacatcgtgcgagcgagatcacgtgcgcgccgcggagcctccagatgggcgggtactctaggaggctttatatgttagattaggaggaatcaaggattaaatttactggaatattctattacacacacattattacttaatacatccatgtgagatgaaaaaaaccgtactgatatttatattttggatataatataatgtgcacctgctcatactttcaataaaatcactactttggtgggaaagtaaaaactcctcatttccttccaatttaagaccgcactagagaatatacataacacatctatttgattggtgttacaaatttgcaagtgcagcagcttaactgtcactaatatatgaaatgttgctctaagtctcttatgtcacattaatgaacgttattacaaaagtttcttataaatatagtaataaatgggaagttgtcgtgtcgactataatgaccagtgatatagtttttgaaatatacaaccatgggtataaccaaacgtatatcctttccttccggcaaccaatccaacccaatccaaatattgaggtctagaatccagaccgaaccaagctaggtgtattccccatccaaaccaatccaaactgcttcacgtttttggattaaatcagtagtgtaaaaccgtggacaaactgctgcgttgctaccgtgaactcgtgaagctactgctcgcg

SEQ ID NO: 56863 - DNA, 744 bp, Triticum aestivum
  Clone ID: PAT_TA_56863
tgagacttgcttacgatcagcagtatttcttttctgttcactcgtcggaagcttcaatcaggattctgggctgaatgcttttaatgaatcagaagtgccatgcacctcggtcagattccagatatctggtttgcatggtaggagccaagcagtgtttgtgctgttcagcctcattggaattggcaagacacaatggaagaacctgcaagcaaagttcagatatcactctttgaaaagggagctgtctaaagttgactgcacatacaccgatatcaaacaactcatcagtggaaatgaccagaatgtccggacttcaatgaatctcttttcgaagagtttatcttccgatgctcaggaacctcagttctgctcagaatctaattatcctgatgctgatcctgtcatattttgtcttgataatcaaagtgaatgcactcgaaatcatgtggacgtggcagctgcacgtcatcacctaaagctgctcactgaaaccaacttgacttccaatgctgtagttcaccaggctgctcattctgaaatttctgtagaagataatcagcagtctatttcacaacatagatctgctttggttaagcaggtttgttccttggagacgggtaccgtaagtctggattgtgacaacagtgatggtgatatcaatgtgataagcagaaggttgccagatcaaaatgggacttgcatagctggtgacaaactttgttcttccatcataatgctacaaac

SEQ ID NO: 56864 - DNA, 188 bp, Triticum aestivum
  unsure (1)..(188): unsure at all n locations
  Clone ID: PAT_TA_56864
tccggacccgggatatgccgggtccgacccacgcgcccgacttcttgtcgactagctcgctgatggctgtccaggacgatcgaccacgatccagaggagcagcntacccgaggagagccgcgcatgtgcggcgtactacccgcgctggggcgcggcgacgactccttgcgaagagggtccacgtgcta

SEQ ID NO: 56865 - DNA, 696 bp, Triticum aestivum
  unsure (1)..(696): unsure at all n locations
  Clone ID: PAT_TA_56865
attttctctaatggcttgggttgataacaatgcattcttattcataatgatctgtacatttctcgctgtcctagattatcatctcttgaaaatattttgaagtcagctagtcttccaacggtcagatcaattttcattgaagagtgtttaggattgtcatctatgcgaggtgaaagatttggcgagttgagttgtttaaaagaattgaagctaagcaagtgtccaaatatcttgtggaatggattagttcttccatcgtctcttctaaagctgcatctcgaagactgtggagatatttcgaattacattcccaactgcttggttaaccttgagaatttgatacgcatgtccctggtaaagctgatcaccatcagatccattccagcggaaatctggtatgataacttgttagagttacagacacttgagatctctggctgccctgacctgatatcaataggtggaccagaagcaattgagcatattgaaaatgcctttgtcgaatcttgtgcaaagttgacgggattgacgcaacctcttgaaagatgccgacgtcctcctaagtcagcttgacaggcccctgcctggaacggtgagactcactcaactatctgaaggccatcctagctggatcctctacacctgagttgttggacccttatccatgttggagnagatgttcaattccttgcctga

SEQ ID NO: 56866 - DNA, 620 bp, Triticum aestivum
  Clone ID: PAT_TA_56866
caggattaaggccctaaggacctggcatcgctgctgctggacctgggacctaggattgctgctgctggacttgggaactgggattgctgctgctgtgtgcctccttggcacccctggatctgggatcgctgctggaaacaaggaccagggatcgctgctggaggcgaggacctgggagcgcctgggacctgggcgcatggaggagaagcaggggcaggcggaggagaagcaggggcgggcgagcggacgatggcctggtgaacgggcgggctatggcctcgcggatggaggaagacgatggggataccgattcaaactaggggcaacgatgtaaattccaccgttttcacctggtcggaactaatcctccagcgacttacatttcggaatggagggagtaggtgataacaggtactcctataatttgggtatgttagggtccgctagctgctatacaagtatgattaacatcttgtcttagcttcactagggcaatatgctccacaatagttgccactgatctcttcttaaccagctggctacgtcctccccagttacccaggcgctccctgtaagaatggtgcctgtcaccctgcatattcctgtgaatataccgtgcc

SEQ ID NO: 56867 - DNA, 678 bp, Triticum aestivum
  unsure (1)..(678): unsure at all n locations
  Clone ID: PAT_TA_56867
gcccccgctataaatcttccccgacgccgcacgcaaaatccaaaaatccccggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattacagcatcatatcaggctaccattcaagggtttgagtccaagggattttcaaaagaacaaggtgaaaatttactaacaaagagtgttgagattgcatgtgaagcacgggagatgtttctgaagcagcatccagatcaatccactcccttgcgtcctattctggttgcagcttcaataggaagttatggggcttatcttgctgatggctctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacatanatatcccttcatggtntttccttcaactc

SEQ ID NO: 56868 - DNA, 416 bp, Triticum aestivum
  Clone ID: PAT_TA_56868
gcggtgccgctcgtgagagtaagtcacttcctggatccggcttttcctaactgattcgcatgatctgttcctgtgcgccgtgagcacgatcaagagcgcgagcgcgagcacgggcagggcaagaagaaaaaagagggcggccgtctcctggcccgccccatgaggagcttggggcgcgagcatgatctggggaagccggaggagcctgggccccactttcgttttcagggaagccggaggcgctgcaggcatgcccatgccccatagtaatgagcgttctggggaacgggctccccgggggtcccccggcctccttgttctgcgccaaagaccggaacctctccctgttgacctttccggtggcccctggctgccactagcacgtgtgagcctcctctgcgaacagcgtgctgaag

SEQ ID NO: 56869 - DNA, 725 bp, Triticum aestivum
  Clone ID: PAT_TA_56869
cgctctccctctcggttcccctccccgccatggccgccgtcgacctcgcgaccaccgtcgcccccgcgccgagcttgggagccccgcagatacgcctcgacgccctctttctccttcccaacgcaggagagaccaggggctctacatcgtcgccatcgacttcgtcttcttcatcggtgcccggagctcgccaccgacgattcgccgccttctgcagctactaaacttccaccggcctttcttgcgcctcgcgacgttggaacccaggatccagatgccaccgtcgagatgactcctactacactggaggtgcctactactacgtgcaggccgctgacgacggccgggagtagtttaggagaatcccaggcaggaggcatgcgcctctttcgatctatatcccagtttgtgctagccatcttatggcaacttgtttaacttatgtctgtactcagatattgttgcttccgctgactcgtttatgttcgagcacttgtattcgagccctcgaggcccctggcttgtaatatgatgcttgtatgacttattttacttttagagttgtgttgagatatcttcccgtgagtccctgatcttgatcgtacacgtttgcgtgcatgattagtgtacgattgaatcggaggcgtcacaggggatccatcaacggtggccatcttgatcatcccagcgctctccatgacgaggagggagtagttcaccctcgg

SEQ ID NO: 56870 - DNA, 722 bp, Triticum aestivum
  Clone ID: PAT_TA_56870
gcaatttagagacaagcaattatggcaaggatactataagacctatgagcaggatatgcaggctcagttcatgaagtcagtcacaaaaggacctcggctgaattttcctagattttctggaacaaacccagtggggtggataaggcaatgcaacaaatacttccaaatgtctggagctccagaggagtacaaagtatcattcgctcaaatgtatgtagttgatgaagcagatgtgtggctcaagagatctggtcttctgaagaaacaactcaattggaaatagtttggagaagaagtaattaaaatattttctgacaaaggctcttatggtttgacagagaaatttaactcagtcaaacagttacatcactctgtctctgaatatacaaaaatctttgaagatctcatggcagatgtgcaggaagaaaaccctgagttgggagagctgtggtttgtcaggtgttatgtgaatggcctaagagaggggataaaattccaacttagaccttttagacctcaaacactaacagatgcttattgtatggcaaaggacatagaacctaatcatccacacatagccactatcagtaagaaacatagtgcacctttcaataatttctatcagataccaaattggactcctcaagcataacagaacactcctgtagtacaacatcaaatacctatcagacaagctgaggtaccaattaataatggacaga

SEQ ID NO: 56871 - DNA, 752 bp, Triticum aestivum
  Clone ID: PAT_TA_56871
gctgttcaagcaatcactcgtaaagggagctcagaggtggtgcaagataacaaactagatgggtctgacagtacagatagtgtcaatgtgaagagttcattagtcccagaggacaaaggagctacatttgagatgtcagattctgctgtaccaaaaccctcatcaccaagatctaaagataacgacaagattcttgaagaagagaaggcaatacgtgcaactggaactactttggaaaatggaaaaaagaacgtagttaaaggaagtgctgatcatgagtattttcttgctgaagatcttgcaaaagaatatactggaaatttgtcccaagttggaggcaaggatacttcaaaggaagtggatgaaaaattgatatcaaacagcatctctggcaataaagtatttgatacttccatggagataccaaatcaacttcaagatacatcacttggaaggaaaagtaacgacttgactgacgctgaacttggctcggaagtggaggagtgtgtatcttcattggataaaacctcttcttgggttgatgatgctaaacatgggtcagattcagttgaaaatggcatatgcaatcatcatgattgtaatatggatcacgttcatggacagccttttttcaactttgatgattctcattcttacatccatccatttatcaagacaaagattgctcatttatgggaccatgatttgaagcagaatagcagacacagtatcgtcctgaagagcaattatgc

SEQ ID NO: 56872 - DNA, 244 bp, Triticum aestivum
  Clone ID: PAT_TA_56872
cccacgcgtccggcgagttaagggttcggaaggcgagtacattgttctcaggtcatccgacgtgatagcggtgctgtcatcataagcttgccctgccctacgtgaactaggaattttgatatttagtccaaaaccttgtttggttattgctctttgcttgtgattggtgaactgtgaattgcttcttcgctctatcgtggaaatgctgcttgatagttttaataagatgacggcttagacttca

SEQ ID NO: 56873 - DNA, 245 bp, Triticum aestivum
  Clone ID: PAT_TA_56873
atatccttttgtgcttagttttgttgttgtgaattctcccatttttagctttgagttaaacacacatttgttttagtcaactgacattcctcgatgttttcaaactgatattatcttttgtaagtttaggtttgcacttggctttatcagaattagaatatgcacaacatgtgttggagaagtgcctgttttgaagcttcacagctttaaccatttgtttttatgaaataatattcattcagttt

SEQ ID NO: 56874 - DNA, 660 bp, Triticum aestivum
  Clone ID: PAT_TA_56874
caatcttcccgaagaatgtgacatctcttggacatgttccttcttgaagctgcaccatccgtagaggacctgtgcatcacagtatgggatcataagtgccggaaggagtcacaaaagagtcgctccaggaaaatggatgtgcattgggagccatctgatcctgattttaagcacaagaatctggctaggctaactatctacggtttccagtccgatgacaatttcatcggatacgttagacgagtcattcaagctgcggcgaacatcagggaggtatccctgcacgacaggaaggtatgccgattgtgttctgaaaagtttcctcatcttggtgttcgtccttcgagttatccacggaccagcgaggaagtggatttgttgatgaagaatatgacagcggcggcaacgacttctcctgatattcacttctgctcataaggtggagttcagcatgtcgtatgtggttggaaggattcccctatctcgaagaccccattagtagctactacattgcatattttgcagaatgtatcttggctaccaatttgttggaatgactcatttagctattttcgacagatgaatcggataaaataagcacgtctatgctgtggttgtgcagtaacgtgcttatgtgaatacagtcaatattcagttcga

SEQ ID NO: 56875 - DNA, 523 bp, Triticum aestivum
  Clone ID: PAT_TA_56875
gctaataccctatatcttgcttttatgtagtggtccctcgatgatcttagacaatctttgttgtagaaaggagcactacactatgagtatgccctttgttagctatgatttgcccatttctgtaacactagcttatagaaggatgaatggtggcaagtaggattatctcagtagtcaatagtcagcaccactatctgagattgcacatttaggaccatggtggcacaaagaaaaagaagcttggtctagaacaaattgccaaatgctaggatcaagatttcttttctacgacatgtccttctccggaaagttgttgtcgagaactcaattgatgtgttcctttttttttcaagaaacttgatatagaacttatcttatcttcagttaagtaggtgttcatttgcgtgttgcctcatacatgttcttagtgacttgttttattcaacatggattggtatcctcacttgaaatatgttacaagtgatgcataaggtttattttttagaactgatgacaagataaa

SEQ ID NO: 56876 - DNA, 788 bp, Triticum aestivum
  unsure (1)..(788): unsure at all n locations
  Clone ID: PAT_TA_56876
tctttagtgaagaagtttttgagtggctgtctgctcggagctaccggaagagcagctagccaacgcacaaagaccaaggcggagaatgaagctagaagcgagacagaatacccgaggaagcacactgcctataagtagtccgaccaattcagtgagcagcagcaggggcaggctggcagaacctcatcagccccatttgctttgcaaccaggatggacgccacctcaaaatgatctaatattttttcagtccattttccattttatccttttgtagtttgtttaattttggctccctgattggtcttctccttgtgtacagtttgctcaaacagggaatcgaggacagcaaggaccattgaagcccgagatgtttggaattggacagttcaatctctacttttctcctccaatgattcaggtgttcccgtttttctattgaaatttgaagtaaaatatttttttcatatatatctatatgaatgaaatttatgcactatgttgtagttgaggtcttgatgggcaccatttttgaagttcgctctggacctcgaaaaattcaggaccggccctgtatatatgtagtgttatttcctttgttgtttgtagatgcaagttaccaaatataggttaatatctagcctgtagtaaatgtgaagttaggaatgagattttccttatgcattttctggtttgtgaagcagctnttggtaacctggttcatttagtctatagatgttcaacttttatacagtttcttcattgtataaattaaattgcatgctgcct

SEQ ID NO: 56877 - DNA, 678 bp, Triticum aestivum
  unsure (1)..(678): unsure at all n locations
  Clone ID: PAT_TA_56877
atcgaatctcaccccaaattacgattgcgagcaaaaccctagctagcgtgccggctgaatccactgaaaagatggcggcgccggccgccagcgacgcggcgagctgctgcagtctatacagatgcatctgctgctggcgtcgtgcctgctcaccccgtatcccgcgtgtcgcccccggcagagactacttctgcatgccggctggcgccgatgaccaacctgcgtggtcgctggtcgtcggctgccgctccctctccctctccttctccgacagcgccctacgcttgcaccgcttccgcgtaacgcgatgcggtcgagtcctcggcgggagcaacgacgccctcgaggtcttgcaggacgtccgagctgaggataaaaaggcgccggcggagaagtggtgcctctggactgctagcgccacgcagtgccccgacggccactcactttgcatcttctgcgaggatttcgatccagtgaatatccgatactccgcgcccccacaagtcctgcggctggatgtcaacgctgaagacaagctgcgngaattgtccccccatgcctcgtcctcctctagagcctcactggcggttctcccatctctcagctgctggccagatctgggctgcatacgttgttgaacaccaggcttatgaaacattcagcgtcgggatgcagctc

SEQ ID NO: 56878 - DNA, 537 bp, Triticum aestivum
  Clone ID: PAT_TA_56878
ctgcttttagttaatctattcctttaaattttgactgatccttttttattgtgaggcaataattttattaaatgcttataatttgtttgaggacagatagaacatctgttttcgttaagattgattatcaagtacgtctcttgtttgcgaattttataatttttgtatggggtgcagtgacaaggatgaggcataattagttctcctcggagaattgggttaccacatcactggatgtaggcacaacccaagcagtccagaatgattgactcatctaaatttctctaattctcttacatgatattttctccagacagtgcgtgcatttactgcacaaaagttaatttatttgaattttatgttaatgctttgaccatggatgccaaaacatcacagtttgcctgatggagtgaattccgttgtaaaatgaagttccttccatcaaatagatagcttgtattaaaattgtttttctatcctgtaggtacatgttggttattttgatgcttacttttgaagatttgcagagatcagcga

SEQ ID NO: 56879 - DNA, 571 bp, Triticum aestivum
  Clone ID: PAT_TA_56879
cgtcagggctgcctgtgctccaggctccaagtctgtcgcgcagggctatgccagggcaagcacccatgttgacttgctgtgaagtgctgggtcatcaagactacggttgaaataatccgctcttctgtgacagtttaccggcccatgaccctgtccaaggtcatgggccctgcttacaccatgatcatcacccctgggaggaacaagctcgatcaatatcagatcctggagtacccgcttaccactgagtctgcactgaagaagatcggggacaacatcacatctcgtcttgatcgtcgacctgaaggccgactggaagaagattaacgccgctgtgaagaaaatgtacgacattcaggccaagaaagttaacaccctcatcatgcctgttggcaagaataaggcgttcgtgaagctgacaccacactacgatgctcttgatgtgggcaacaagatcggtgtcatatgagtcacacggagggtcctgcaataagcgcttgtgtcgtgggtgcttgcgctattggaattctgtacacgttacttagcacaagggctcagtggctccattgtc

SEQ ID NO: 56880 - DNA, 718 bp, Triticum aestivum
  Clone ID: PAT_TA_56880
agcgaccatgtcgagtggcctgaacatgtcctagacgacctcatcaagcaatccaagtccaggcccaaagccaaccccgccttctcttccgggcccacccgccgggcggcgccgtccgcccggaccatgccctacccgccgtctgctcccaaggccgccaccgccgactctctgtacggtgtctactccgagcacgttgccgccatggccacctccccgccaccgccggcggtggccgggccacaggcactcgagacgggcacgaagctgcacatctccaacctcgactccagcgtcaccgtcgaggacgtccaggaactcttttcagagattggtgagctcagacgttattctgttaactacgataaggatgggaagtctcagggaagcgcggaagttgtctttgcaagaaaagtagatgctttggatgctattgagagatataatggtgttctgcttgatgggaagccaatgaagatagagctcattggaaataagaccgagccacacccaacagaacctttgatggacaacgacacttcttctaactacaatgcaactccaaacagtttgcttcagagaggtgaccagagagggccatttcatggtaatggtcgttctgggagcagtggtcagggcggggctggcaaaagaggaatgtttcaaggcaacgttcgtcctgggaaacactgtcaggaccgggggtgggcggggacag

SEQ ID NO: 56881 - DNA, 478 bp, Triticum aestivum
  Clone ID: PAT_TA_56881
cccacgcgtccgtcttcctccccattcccctcccccacgcgacatcaccctccagatcaccaccccccaccccagatcccgaccggctatggccttcgactcgctgacctcctccccggcggccacaccgcgcgtttcatcgcaccgacagggcgcccaggggcgagccgccgcggcgcgtgggcgggctgagccgggcgttcgcggacgggcggcaggtggcgtcgtcggcgccgtcgaggtgcccgcgtggccgagccggttcgccgacctggagcttccgccatgactgtcgcgtgctgcgtagcaacgtccgccgttgtcgccggcgctccaatgaagcgcgcccggtgctgcaatggagcgtcgtccgggtcgttggagctccgccgcggctgcaatggggcctcgtccgggtcgttggagctccgccgcggctgcaatggagcttcatcggagctgcaatgaagccctcgtc

SEQ ID NO: 56882 - DNA, 124 bp, Triticum aestivum
  Clone ID: PAT_TA_56882
atcgattgctcctggagattcctggagattattctagaaggttgataagttaaaggtcctgtcagattccctttctacttcatcctccaaagcagagcagcgtattatggaccacaggcgtcag

SEQ ID NO: 56883 - DNA, 536 bp, Triticum aestivum
  Clone ID: PAT_TA_56883
cgattaacgaaagaaggccggagcgatatagaggagccaacgttacctacgagaggatacgaggcggtaatgtgtcatgtacgaggagccggagataagttctctgcctggggacgatactactcgggcgttgggaaaagcctgactgaccggatcttgatcgtcgttgacgacatgcgccatttcaccaggcgctgctacgtcgactaggccgacaccgatcgccttttcgaacacgcgggcaagatccatggcgacaggaacccgacctgcaccggcttatttgccaagcgggtggtggggaggacgctcactgacccctcctcgcttaccgacatgatactgcgggctttttaggttatctttggtcctgttgacgagaccatgatcggctttaactacaaagctgtagataagcagctcgctttagaggagatattcaccgtggtgctgatcatgatgacggagatagttgatgactttgtcggctaatgtgtcgagaactccgcgtgatccgcggcggtctacttttcgac

SEQ ID NO: 56884 - DNA, 355 bp, Triticum aestivum
  Clone ID: PAT_TA_56884
cgtcttcctcaccagttcccctcccccacgcgacatcgccctgcagatacccaccccccaccccagatcccgaccggctgtggccttcgactcgctgacctcctccccggcggtcacaccgcgcgtttcatcgcaccgacagggcgcccaggggcgagccgtcgcggcgcgtgggcgggctgatccggtcgttcgcggacgggcggcaggtggcgtcgttggcgccgtcgatgtgcccgcgtggccgaaccgtgtcgccggacctggagctttcgccatgactgtcgcgtgctgcgtagacaacgtccgccgttgtcgtcggcgctccattgaaccgcgcccggcgctgcattgg

SEQ ID NO: 56885 - DNA, 509 bp, Triticum aestivum
  unsure (1)..(509): unsure at all n locations
  Clone ID: PAT_TA_56885
aactcctccctgcagcctgcaggaagcagctagagtacgcacctacctagcagccatggtgaagctagccacggcgcgggactgccgcgcgtacagcctcggcgccacgggcggcgagacgtcgcgcaaccggcggtgggagtacatcaacgccggggtgtacgtcttcgccgccgtcctcctcgtcgccggctttctgtggcacatttgtggccgtgggcggtgtccaccggcgcgtccttgagaggcacggcctgaacctgctcatcgccgggccggcgctgtggtgcctcgggtccatacacaacatgtgccaagtctacgagcgagccaacgggcacgtccagatcctccagaagagcgtgcacatcccgttcctgctcggcagcaccctcttcttcatcggcggcgtcgtcaaccggaacgacgtccacggncgctcctcccacagctccaccctactggggaggagctgggcgtggtactgcctgtttcggagcttgctgttc

SEQ ID NO: 56886 - DNA, 737 bp, Triticum aestivum
  Clone ID: PAT_TA_56886
gccatgttgaagctgcccatcacgcctccagaccatgtcgacgtcgtggacggggagccccctgccttcttcctaaagagcccctgccacctccggccagcccccgcgcgctgcaagatgagccaccagaccagcccatcgatccgccccggccgccgagccacatacctactgcaccagcagaggagaggaaggctgaatccaccaccgctgcgccgccacggccagcccgcaccaatcggatcctggatcaggcagaccgctgccaacaacacgggccgggcaccaccgacccgcagcccatctcgctgccaacacacccgtgcgccatgacctgtgccgatgcgagtccgcgccgccggcgccctacgacaatgccatgaccagatctggaccccccccccctctggtggtggcgagagggaggaggggaggactgggggtgacgcaggaggggttaaggctctgtgtatggtttccatatatgcgataactactaattaggccattttctaccattgattgtgctgaaattcagagttcattttgagctagctaccatgtacattggatttgcacctttggggtagcctttccaaattaggctgttgtacgaagcaagaaaaataggctctatatgctgagtttcgatcagtgtattctccatcaggtctgaagttccacataacccttccactcttgatcctcaaaatctctctcagctggggtagttgcag

SEQ ID NO: 56887 - DNA, 385 bp, Triticum aestivum
  Clone ID: PAT_TA_56887
aaaaaaaaaaaaaaaaaaaaaaaaaaaaaaaaaaaaaaaaaacgaaaaaaaaaaaaaaaaaataacgaaacgcaaaaaaaaaaaaaaaaataaatcgtgctgtggggtccaaaaaattcaattcttctgtccgggggactttaaaacgacttgactggtgcaatcggtgaccctaccctacttgcggaggcccggggcgtatccccctttagacggctggcaccatagcgactttgcccgcacgggtcttccatcccatcagccgttcaccctgggggcttaaaaggaacgggccctgctgcgtggcattttgcacgcgccctgtaggggttaatggaaaagggcccgcgccttttgccagcgcattaaggcccggctcctttgg

SEQ ID NO: 56888 - DNA, 228 bp, Triticum aestivum
  Clone ID: PAT_TA_56888
cttgcgccagcatgcacatttgaaaacgatatatgtaaccgaccccacattggggcaaataacaaaccacccactatttcggggcgttttttaaaagagcggcaggaggaaccctctaaggcaaaatagaaatagctatgacccccggcgagaccaacagggggcgggtcaatgggggttaacccagcgttttttttttttacccacaggttatatattcaacatatt

SEQ ID NO: 56889 - DNA, 787 bp, Triticum aestivum
  unsure (1)..(787): unsure at all n locations
  Clone ID: PAT_TA_56889
agaactaatattgcttgcaaataaaccactgcttctgcttacttgtccccaaattagaagacagtactggccatcttcttaatatattttatggatcttgaccaacaggagaatttgtcattttatttatttatcgaagatcaatactgtatcgtgttatcatgaaccaattttttagcactaataatgtccttttagtgacattatatctatgcaatatttcaagtgcagtacccacattgcttctcaacatgtcagctgggtgctcaaatgacagtacccacacagttgtcattgtatttgctctccagattggctgtttagaacaactatgaagtaatgcatgcttgtttttttgacctcaacaaataaccattttgcaataccaattacttttggcaagttaattctaaaaatgtttttttcttagttagccattctccgcctttttgtcctttggacacagtgtctgccaatgaagtttgaattgctgctctaggaggctaggagcaaggttctaaatcatgaatatctggttggtagcttattgtcttcagcatattatttttttgtggcaaagagcatattagatatcagccaatatattnggtggtgatatggtccagtatcagagttgaaaaatatttataatttctagttaagcatgatgtgtgccatgacttccaagtgtcaccctgataatgacatatgcacacatcatgcgatttggattttcctaatctcatggggactataaatactagcgtgtagcttctccctatctaac

SEQ ID NO: 56890 - DNA, 185 bp, Triticum aestivum
  Clone ID: PAT_TA_56890
caaggatcggcagggtggccggaaacaggacctgtacctgggaactttcagcacgcaggaggaggcggcggaggcgtacgacattgcggcgatcaagttccgcgggctcaacgcggtgaccaacttcgacatgagccgctacgacgtcgagagcatcctcaacagcgacctgcccatcggcgccg

SEQ ID NO: 56891 - DNA, 817 bp, Triticum aestivum
  unsure (1)..(817): unsure at all n locations
  Clone ID: PAT_TA_56891
gtcgccttcttcgaccgcgacgtgctgctgcagcacgctcatgttgtggtgctgcagcacgtcgccttcttcgaccgcgacaacaacggcatcatctatccctgggagacttacgatggtacgtactacgtgtgctgcaccgcgcttcggattgatttgtgatttcagttcggccggtgcggaggacatttaacgtcttcctttttgtccgtgtacctacgattgatgtagggtgccgtgcggttgggttcaacgtgttcacgtccgccttcatcgcgtttctggtgaacctggtcatgagctatcccaccctgcccgtgagtgagctatcaaagaacttcagaaatcacaccgtgcttcattcagtctttgtatatgtattgactgcggtttgtggccgtggctgtgcagggctggctgccgaaccccctcttcccgatctacgtgcacaacatccacaagagcaagcacgggagtgactcggggacctacgacaaggagggccggtatgttgtagtcgatctaatttacagcaagcaagttacacatgcgtgagaaacttcagacatgtgtgtgttgtgcaggttcatgccggtgaacttcgagaacatcttcagcaagtacgcccgcacgtacccggacaggctgagctacagggagctgtggcggnatgacggagggtcccggnaggtgttcgacttcgtcggctggtaactgactatatataattacacgatcttcatgaatgaagcttcagtttcagtcgctacatgctgcgggctatgttggtgnatagctaactggtgtgggatgggat

SEQ ID NO: 56892 - DNA, 606 bp, Triticum aestivum
  Clone ID: PAT_TA_56892
cggaatctcccgggctcgatcccacgcccgtccgaatttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaagggtcccatttttcctccccggggcgggcaaggtaaaattttttttttggggcccccaaatttaattcccgggcccgggttttaaaaccgggggggggggaaaaccccgggggtcccccatttaattcgcttggaaaaaatcccccttttccccggtggggtttttagaaaaaggccccccccggttcccctttcccaacgttgccccaccctgttggggaatgggacccccccttgtgggggccttttagcccggggggggggggggttcccccccaggggccccttttctttggccgggcccttagcccccgccctttgggttttttccctttcttttccgcccgggtgggcggttttcccccgggagcttttaaaggggggcccccttttagggccccattta

SEQ ID NO: 56893 - DNA, 360 bp, Triticum aestivum
  Clone ID: PAT_TA_56893
tgacgatcgtagtatcttctatagtagtcgcctaatattaatatactaggcgcgcgtttttcaacagtggtgactactgaaaacacctggtgttaccacaacttattacgtcttgtagcacatcctcccctttttcagctggtgtagtatagaagaggacgccaccgatggtccttcttaacagctgcgcagcctgcttggtgaatgggacgcgcccctgtgcggcgcattattcgcggcgggggtggtggtgtctcgcagcagtgaccgcctctcttgtcagcaccctattacccgctgcttctgcttttttcccttccttcttcgccacgttggtcggcttttccccccaagctgcta

SEQ ID NO: 56894 - DNA, 717 bp, Triticum aestivum
  unsure (1)..(717): unsure at all n locations
  Clone ID: PAT_TA_56894
gcgattacagacacctcggaatgcaaaatttacattctcacatcttgtatttggacacaaccaatccccctctcgctgccatgattttgcagtaccactaccacatcctttacctctacctgaaccatcgtccctttgcttaccaatcccggaaaacagagcctgatattttccatccataacgctgcaaattccctggccttccactaccagaatgcacaccttcacacaatcactcacaactccactaccaatcgaaacttactctgaccttcacagcctcaattgcacaccgctctttggtctactgctttgttcttctctccactccaaggcagcaacaacaacccacgaacaaattcagatttaggcaacacacctcttctctatttgttgaagccacaagtcatcttcatcttcactacctcaccagttcaccttttctctgctcgcacacacagcaggcaccaggcaccaggcacctccctttcttctcccttgcaacctaccagcagccacagttgaaggggacctcaccttctaccttctctacactcctccactgctcctcctctgccacacagttccaccagtagcagcagcagccaggacaggagcccttcncagcagcagccgcagccacaccccacagagcagcagcagatccagatgcaccagcagctgcccttcttcttggtcaatcagcagcaggacagc

SEQ ID NO: 56895 - DNA, 103 bp, Triticum aestivum
  Clone ID: PAT_TA_56895
cttacttttgcttgattatccaaaggacggatgcagctagctgttgagatgattgatcaccgtacaatctccagcactagctaccgtgtggtatttacttgcc

SEQ ID NO: 56896 - DNA, 462 bp, Triticum aestivum
  Clone ID: PAT_TA_56896
gcccctgcacctccatgtctccagccacccgccggtcgccctcctcctcagctctgctgccgccagcgcttgcgtcgtcggagcgaagagtggggggtccttggctcgccggcgccgcccaaccaccacgggcgcgaagatggtgtactgctgctcgagatatggacccgtggagagaaacgcgcttcaccggccatatccgaggcttctcctctaagtgctacattgacggtttgcctccggtactgaatcttcagcggcaaggagtttgagttcgtggggctcgcgctcagctccgatattagggaaaggtaccaatcgctatggttcaaaacaaatggttgtgcctgttacctaatcagatcaggctctgactgaagctactccagtatgccccatgttgtgtttactcaacatcacaacaagtattttgtctatgcatcatgacattttctgtttttt

SEQ ID NO: 56897 - DNA, 775 bp, Triticum aestivum
  unsure (1)..(775): unsure at all n locations
  Clone ID: PAT_TA_56897
ccagccttccagccgagcacaagccggcaagaaacacccaccgatatccgcccagcagcagcaacagagctcgggcgactcccttccttccttgctcgctagctctgcgcgccatggctccggcgacggcggacgcggcgggggcggcggtggggggtcgggtgaagacggcgctgggggtggcggcgtgcgagcgggacgcggagaagctggagctgatcgagcagctgaccaaggggttcgacgacgagcagcagagggtgctggcggcgatcctggcgcgcaacaacggcgccgagtacctccgccggcacggcatggagggctgcaccgaccgggacgccttcaaggcccgcgtccccgtggtgacctacgaggacctccggccggagatcgagcgcatcgccaacggcgaccgctccaacatcatctcctcccaccccatctccgagttcttgaccagctcggggacgtcagccggggagaggaagctaatgccgacgatcgaggatgagctggacaggaggcagatgctctacagcctcctcatgcccgtcatgaacctgttcgtcccggggctggacaagggcaaggggctctacttcctcttcatcaagtcggagaccaagacgcccggcgggctgccggcgaggccggtgctgaccagctactacaagagcgaccacttcaagtaccgcccgttcgacgcgtaccaggtgtacaccagccccacggcggccatcctctgcaccgactccttncagtccatgtactc

SEQ ID NO: 56898 - DNA, 617 bp, Triticum aestivum
  Clone ID: PAT_TA_56898
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaataaaaaattaaaaaaaaaaaaaaagggggggcccgttttttggtttccggcctcctattccctggcttggggcggggtttttttttttttgggggggggaaaatccttgggttggcccgcgtttttcccttggggggcatgggcaattcccgggggtgccccacttttttggcttggcgggcacttcccctttttcccaggggtggtatatccaatagggcccagccaaacccccttttccaggggttttcccccctggtggggggtggggcccccccctgtggccggcttttttgcccgggggcttggggggttccccccaggttttccccttttttttttaggcccttagccccctttcctttgggtgttttcctttctttgccccccctgtgggggggttttccccggtttgctttaaccgggggccccctttttgggcccgggtgagggcttttagggggcgccctcccccaaaaatttggtttgtgggcccctttcggtgggggcccccccc

SEQ ID NO: 56899 - DNA, 729 bp, Triticum aestivum
  Clone ID: PAT_TA_56899
cgactttgcacgagttcttgccttcaaagctaagatgaaatggctcttctcatatttgcctataaactgtttgatgaaatgcttgtgtcgtaacgagttctttttcttcagtttgttcttcctgctgctaagtattagtcctcttcttgatcttgcctgattttctcgtcggtcttgcatttcaagccaggggctgtgactctatgaggatgttgtttagtgtgaactgcaactttttttggttggtagagttcctcgagcattgcttaacttgaatgataaactactgagcaagttggcctgagagcagagaggttagagctccagatggttcttggttgcaatggggggagatgcaggggagggtgaggaggctaacgatagggtgaagtagcccggcgacgagtgcaagcagcatgaggcattgtatgggatggatttatcatgctgggattagctgtagacttccttgctgaaccctacagggagcaatgcatccccagtttgcttccagagaaggaaggggaagagggttttcttgttgctgctattcctcgtggatattcaatatgcaacttggcacctaatgtcagcaacgtgcttatcggtgacgagggaaatgaaagaaggctgcaatggaatttgtactagatcagattttggccatatagtttccggtgactagaagtctaaactggagatagggcagattgtttttgattccgatta

SEQ ID NO: 56900 - DNA, 403 bp, Triticum aestivum
  Clone ID: PAT_TA_56900
atgacgacgacggcgatgagaacagcatgctcccaatgcacagggactacaaattcctcgacggtttccccattgtcgggggcaggactgctacttcccaagaacctctggagagggaaaaatggaaggaagagatgtccagggggaaccaggggcttccaggagaggcatcagaagaaagtaatcggtcctcccctcgtgttcccagaagcatggagatgctcgagtctgaggacgacgacgacgatatctcatcatggttttctggtgcgaacagtagtagaaacctgaaaaagtagtaaacaaatttgtgtaaatgccggtaatttgtggaatttcacatgtaaaatctaccgttgtccagaggtacagaattcagtgaagacatctttactgctgttca

SEQ ID NO: 56901 - DNA, 719 bp, Triticum aestivum
  Clone ID: PAT_TA_56901
acagccaaagatggtgaatgggtccctgtaacagaattcagtttccttagtgcaagacaaacattgaagagaaattttgtgtaccatacaactggaaagataggcaaaaagtttacacatgcctttaatgaatcttataaggatgtttgggaggggcttatctagatattggctatcactaacacagggtgcagaatctcctcccttttttgtgcaagttacaatggaagtaaaacattggccagaagatggaatccaaccagagaggatagagtcagcaataaataaggtacttgtgacagcccatgaagaaagatgtcaatctaattcgccttcatcatgccattcttctagtcgagttcggattcaaagtattgaacggagcaaagaaaatcctagtatggcctcttgctgtgctagaagttgtttatgctgctcctacagaatgccagtcagcaggatggttcaaatcacttactccagcagctgatgtagaaagggaaattcatgactcacaaaaggcaggcctttttgaagaaataaatttcccctacccagttgtctctgtaattggcggcggtaaaagagagattgatctttatgcatattattttggagctgacatggcagttctctttcttgttctcatgttctatcaatctatcctaaagacaagagtgaattcttgggagcttatcagctggaagaacaattcccta

SEQ ID NO: 56902 - DNA, 750 bp, Triticum aestivum
  Clone ID: PAT_TA_56902
agatcatccatattagcatctttgcctttgccgtccactaccatgtcatcctctctccttcccgtctcctgatgagctgggaagttgttcatgtcggcctcgcgtcgattgcctgaacgcccccctgtccggcctcccctacggccacctctccgacctcggccctctccaggaccttggcttgcgcgcatggcccagctagctcataaatccttgaagactagagccgaagggggatgaatcctagtaccgtgttccttataaagatgacccaacatgccacacatggcgcaccaatcaggcagcttctcatactttactctatagatctgtcttcccccccccctctgatcatagacacagcgttctgcaggggtttaaacacattcagccggatccacaccctatggaagttccccacaaaatcatgagacggttgttctgtgaatagcacttcccccacctttgcggctagtggagtaaccaggtgagcaaacagatctggaacatgatccatatgtcaatcgtctccagcttgatggatgaaggttttgagaccccatcataaggcgcaagaagcactgcatcccctcggaaattccaaggtccctcatgcataactctctcccaatctcctaaacaggacagttgaactgagtacagattatcttccaagggcttaaatttggcctcctgtgctatattccatgctgaccgcatgtttctgtagaaccacgtctgactgtatga

SEQ ID NO: 56903 - DNA, 150 bp, Triticum aestivum
  Clone ID: PAT_TA_56903
tccgtaggacaggatcaatcagcatgagcggaagagcaggccagtaaagagggagccggcttgccgtagacgaggatgggtgagtggcttgacatgtgaaggcgtaagccggccactggccagaggtgaattataactatgaggctaggt

SEQ ID NO: 56904 - DNA, 321 bp, Triticum aestivum
  unsure (1)..(321): unsure at all n locations
  Clone ID: PAT_TA_56904
gcaggacctgttggccgcgggggtgatggcgaaagagctcgctgccgaggctgaagcttccggtccgatcctcgacttgctgcgccgtgtgccgcaggctgtgtgagagattaaactgtctgtttacttttgatactactagttctgatgatgctggtgtcttaaattttggttgccgtgatgagttgtgtgctctagcaaatcgttgccgtaattctgaattgtagtggttccttctgttgtcgttttacatgatgtgtatcactatcagttgaaaatgaatatgtgaaagcagtacttttcatatccaactccaannna

SEQ ID NO: 56905 - DNA, 754 bp, Triticum aestivum
  Clone ID: PAT_TA_56905
gttgtacaagttttaaggttctcatttgtggtgaagcttcttcatttgaagtcatcccataggatcacaaatagtgcatttactgacatattgaagctattggctgaagctttccctcaaccaaatacactcccaaagtcgtatgaggaagcaaaaaatcttctgaaggaattaggccttgggtatgagtctatacatgtgtgcttcaataactgcgttctgttcagaaagcaatatgccaagcatgacaactgcccagtttgtggcatgtcaaggtggaaagaccctgctagaaagaagattccacagaaagttttgaggcatttcccattggtccctaggctgaagaggatgttcctttccagaaaaatagcagaagaagcgcagtggcacaagctaaagaggtagcccagcgagaaggaaatgagtcatccggcctacggtgatgcgtggcaggatttcgataaaaaatataaaaaaattgcagaagatgccagaaacatgaggcttggcattgccactgatgggttcaatcctttcggaaacttcaacacaagctatggtatgtggcctgtatttgttgtgccatacaactttccaccttgggcatgcatggatcagtcaaatttcatgatggctcttctaattccaggtcccaaatcacctggcaagcacttcgatgtctttctacagccttgtagaagatttacttgagctttggaaggggtgtgcgtacatatgatgcttatagcgg

SEQ ID NO: 56906 - DNA, 755 bp, Triticum aestivum
  Clone ID: PAT_TA_56906
taaagatctgtgtgatgagaagtaatttacacttgaaaaaaatgcggacaagaaatatcgtataactggccttacgtcacaagggtcaagccaactaccttgcccatgtgatgatagtggtactgggaagacagtattagagtacttcaaggaaacatatcgatgtactattcggtctcgtgtaccatgtttgaaagttcgtgatcaagagaagccaacaacttacctaccaatggaggtctgtgagatttctgacgcaaaacagatatcgtatcttcttagtgtcgcttgccagcaccctatggaccgtgagaagaccattttacagacagtgaacccatacaatgaggacccgtatgcaaaggaatttggcataacttttgagaacaaactcacaatagtcaagggtcgtgtgctacctcctcctgtgctcaaatttaatgaccaaggcaaagtgaaggaattcttgccaaaagttggcaagtggaatatgcggcttaagcaaatggtcaagggagggagaagttaacacctgggcatgcattaacttcgcttcagatatcacgcatgctgctgctgtggctttctgtgatgagttggctgtgacgtgcctaatctctggaatgaaacttaagggtgaccctgtgctccctctagtgaatgctaaacctaatcatgtacgaccgtttctcaagatacattaccaacgtttcatggcaatactcagaccactgcacaaagaacttgacctgctg

SEQ ID NO: 56907 - DNA, 222 bp, Triticum aestivum
  Clone ID: PAT_TA_56907
accactgctgttgtatgcctgtaaccctgaagctgtttttgtgcgtaacaattacccttgccggtggcaaggcctgactgaaccccatcatttcttagtgcgtttggacaagactagctgttgctgccgctggtgtgtcgtgtctcgtgtcaagttcggctactgttgccgtggtaactttgtctttgattttgtactactgctacaataaaccttgcctcc

SEQ ID NO: 56908 - DNA, 733 bp, Triticum aestivum
  unsure (1)..(733): unsure at all n locations
  Clone ID: PAT_TA_56908
gtggtggccctggccatgccggctgggtgacggcgtcgtgccactggcggcgactccatctgcgacgccctcaactcgtgctgccgcccttgaccgtggtagacggtgccgcccccgctgattgaatgatgaccggatctgcgtgctgttgtacgccactgctaccatccataaggatgacaattggaagaaaagcatatcgactttctctagccatcaaacctgtgcctgctactcggaacactatgatggatacgtaagagtttcagatctacccgctgctattccaaataatgaagaccgacctgctgggaagacaaataccaccgccgccggttccaccttctcattcactttctcctcgtggatctccacaacgatctattatccaagaaggcaggaacattgtgttgcctcaagtcttcgtgttgcagacgatgaagggatgtttgggggattatttttcagccagtcactattgagcaaccagttgggttcttgatgttaacatggtggtacatgttttggtgtaacattttggtgcatgtatagttaacatgttttgtgatgtagaaaactctagttgacctacatcaatatatacgtgctaattaagatgtttactcagttagatgtagcaaactctggccagcgtgcctattttttgtcanacatttgatggctggtgatgtcttggcatctattgtatgcatgtgacgattgatatctatca

SEQ ID NO: 56909 - DNA, 789 bp, Triticum aestivum
  unsure (1)..(789): unsure at all n locations
  Clone ID: PAT_TA_56909
cttccttcgagtttgcttcagccatgggtaaggagaagactcacatcaacatcgtggtccttggccacgtcgactctggcaagtcgacgaccactggacacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccagnacgtttacaaaattggtggcattggaactgtgcctgttggccgtgttg

SEQ ID NO: 56910 - DNA, 719 bp, Triticum aestivum
  Clone ID: PAT_TA_56910
tagatcgttgcgtatcttctgatcctggacgagccagggggtatgggcagggttgggagtgacctgatctttgccgtctttgtctttggtggtaagggttttgggaggctcgacggtggtgccgtcgatgtagccatagaggccagcgctcagtatctgggatcgggcttgagctttccagagaacgtagttcgtccgggtaagtggttcagaggtgttgtaattgagggtggaggagacggcagcgcttgaggaagacatggtggaggggatgggtggcggcgagaggagatgcgtgggttggggacgaagaagatggatgggtgtcgagaggtgggaggcatgcaattggaagagcctgctctgtataccatgtggagaatgatagaagcgtctcaatctccatacaggagacccgcgtgatatatattgatagcatggtcgatacaacgtgcggtagctcgaggcttaaccgatcagaggagattaccagggaggtttagagagataaggagataagaagataaatgagatctctaacctaacctcctaacaatatctccaatgcacatacgtgacatgtctaacacacattacagttgttgtagaacaaattaatatgcatgtactcacttttaagagactctcctctactccgtaatatctgcattatgtgtacaaataattcattccatttcagcttcaagagcctcaatggc

SEQ ID NO: 56911 - DNA, 252 bp, Triticum aestivum
  Clone ID: PAT_TA_56911
gcggttgagccatacgaacacaacctacacacccatcgaccggcggcggcagaggataagcccgggagtgttatggcaatatatgaggcccaaacctgttgtggcattgaataagccgagcagggaagaacgaagagaaaggagcacagtgagctgggatggtgacgagtcaggaacaggagggacacttgcaggagaatgaggtgcggggcggaagaaagagacggcttggggggagaggtagaagaaggc

SEQ ID NO: 56912 - DNA, 729 bp, Triticum aestivum
  Clone ID: PAT_TA_56912
cccagctcctccttcatcctcctgtgccccctcccacatctcatccaccccctcatctctggccggatccatgacatgtgggacggaggcgagcttctccagcgtcgacgacttgcaggcgaagggcgagggcatcggcgcttgatttgaggcagcgtcatggatcggtcccttctaagccacgagattgctggactgccaccatccctcctgcactgtgcgttgcctcctgcgagtgccacctcgccgcactagcttccagtgccatggatccgccggagatggagggaacaagtgagagggagtaggagaacaggtgaaccgagggagtgaaagaaggatctcacacgggaaggggaagagggagtctggcggcgtatcctcatctcatccccggctgtagatcttttgacgccatggcaccagtggtggctcctcgatggagcgcctcctcccatgacggcatgaccagccgctcttgctcgacgccacgatacacaacgaggtaggctcgactgcctttctcctctctcccatgtgatttgttctctgttgatttcccctcttgcctattctaattcacgggcaaaacaatggcggatttcttcattgttgatctgatttggggctgattttcctctagattccttccttttacagttcctttttgacttgttgttcatcacgtcgatggcttccgcggagcagaggccctcttcatctcggcag

SEQ ID NO: 56913 - DNA, 451 bp, Triticum aestivum
  Clone ID: PAT_TA_56913
gtgacaagatccagttgtggagataatggtcgtgtcgcaaaaagaaagaaaaggaagatcctgccgcaaaaggcaaccatgatatatatagagtatctcttgttaatatggatcatcttgttcgctttaataattggagtaagacaacgagggcccggtgccggcttctcttgttcaggccacatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaagaaaaaaaaaaaaaaaaaaaaaaaaaaaaaaaggggggggccttttaaagggaccaagtttaacccccgggggggggaaaccttatattttttttttggggccccctaaataaaaaaaccgggccggcgtttaaaagcgggggga

SEQ ID NO: 56914 - DNA, 789 bp, Triticum aestivum
  Clone ID: PAT_TA_56914
cggacgcgtgggcagctgctcctctcccggggctacgccgtccacgccacgctccgcgaccccagtaagtgatcccaagaacgcgcatctgatgcagctggacggggcggcggagagcctgcggctgtttaaggccgacgtgctggacagcgccgcgctggccgccgccgtcgaggggtgcgagggcgtcttccatgtcgcctcccccgtccctgcggataagatcgtcgatcctgagtcagaagtcatggtgcctgccgtgaaggggaccttaaatattcttgaagtttgttcatctctgaaggttcataaggttgtggtggtgtcatccactgctgccgttcattatgatcccaactggcctcagggtaaacccaaagacgagagttgctggtcggacagaaaagtatgcaaggataatgagagaagaacaggctaaatgctgttacagtatgcccttgtattgttttggggccacaattgcaatctgttgtcaatactacaagcgaactcctcctctatgtcataacaggaggtcctaatgcattgaatgagatgctgtggcacatagtcgatgtccgtgatgtggccgaggccctgcttctggtatacgagaaaccagaatcatccgggagatatatctgcgcaccaaattacattagcacaaaggctttgctggagctgctaaagaagacgtaccctgactacaactatgtaaaatgcaaggcggatgcgcagcagaactctcgtatcacgccgatctcgtcgggaaaactgagtaatctgggc

SEQ ID NO: 56915 - DNA, 744 bp, Triticum aestivum
  unsure (1)..(744): unsure at all n locations
  Clone ID: PAT_TA_56915
catgcatatacaggagctcatcagtctggcgacctaaatttctccccacttatctctttttgttcagtccagaatttcaggtttcctgtggtttctgttgccaaggtttgatctttatttttgtgttgtgcagatgattgcagctgatgccgagcctctcgagatctgagggccgtagtattcagaattacctacagcttgagtagatacacattattcactgcatattttattccaatggttttacttccacaccactggtttgtctatattaaatcacaagaacttcatgagcttaattggttactgtgtagaagggcattctttcaaggagctgtagattttttgaatatgctccctgctggaccattttcggtatgtacagaatttgttgagaatgggtgtgaaaaaattgaccatccagtggatttatacgcacggtatgtacagaattctgcaaccacaatagaagtaaggccatggagcaagaattctgttgggcatcctttgcatttatcttgtcaggttcccatgcttcatagcatgtgtgtaagcgtagcagtacacacatacactgcagttcatactgccatttaataggggatgcattagggtactttatttccattataaactgantatagttatgagtttagtaaggtaacaataatttgggttatagcagaatagatgtggtatgcttgtatgagtagaatgcagagtttataaatgaactanaatctg

SEQ ID NO: 56916 - DNA, 712 bp, Triticum aestivum
  Clone ID: PAT_TA_56916
gtatttttgtgattggtagataaaggctggcacagttgcacttagcgtttatagtactatatatttagctaatcgtacaagaaccatctttgtagcagatctaggtttttatgtgtctctctatacttaacggctatgttgtaaggtttagtggtcaattggaggataatttcgtagttgtagctctaaataaggtttcctttgttttgcagtatatacatattataattagaggagaggagttgtaccgccttgcacataatgtgttttaattgaattggttaaaagaacacaacaactgttcaccttgatagaagttaatcttttgaattccttgggaaattggagtggctcttgtgcttgcagaagcgctcttttggtgaataatatactgtcctcctgttacaatatatactatgtcaatatttttctatttgcttaactgattaatggtctccaaaactgggccatagtagatgtcatttccttgcttccctttcaaccaatgtatatccttgttatttgctatgatttgtcgtcccttcacttctatgtttctagtgtcttgcaaaatttgtagccagcaagaagatgattgaaacatttgcagtttcttggtaggcagagaagacatgttcatgttgaattgccaaggcccatgcttcaagtgagatcattcacttgagttctcaatggtttattccaatttttt

SEQ ID NO: 56917 - DNA, 769 bp, Triticum aestivum
  unsure (1)..(769): unsure at all n locations
  Clone ID: PAT_TA_56917
gccaaccccctctctattaccctcttcgcgccaccactcccatccccacccccctcgccgtctcccttcccatcctctcccattccccgccgcgtccgcacccacccgcccacgcacgcgcccgtgcccctctcctcgccgccgccgccgccatgtcgggctgggacgagggcgccgtcttctacagcgaccaggcgcagttcccgcagggcgaccccgccgccgccgacatcacccgccactccgccctccgcaagttcaaggagttcctccgcggcttcaccggccccaccggcgacttcccctaccgtgagagcctcgtgcacaaccgcgaccatgtcaccgtcgccatcgaggacctcgacgccttcgacgccgagctcgccgacaggatccgcaaggcgcccgcagactacctgccgctgttcgagacggccgggtccgaggttctcgccagccttaggtcgaaggtcgcgggcgagaccggggagatggaggagcctgtcaccggcgatgtgcagatcttcctgtcctccaaggagaattgcgtctccatgagatctattggggcggattacatgtccaaactggtgaagattgcgggtattgcaattgccgcatcgagggtgaaagccaaggcaactcacgtgacactgctctgcaagaactgcaggagtgtgaggactgtgccgtgcaggccaggcctaggtggggctattgtccacgatcctgtgatcatgttcctcagnctggagaagagcctgccccc

SEQ ID NO: 56918 - DNA, 762 bp, Triticum aestivum
  unsure (1)..(762): unsure at all n locations
  Clone ID: PAT_TA_56918
aagaagtcgtcaacatgcataaatagacggtgcagaatgtccgcccaacctcgccgtatttgggtaagcagaatttgttctctacgcctacaaggtgtttgatgaaaatcacagaaggctggcaggggaggattggtctatgagctttgataaggctgctcaccaatgagctggacgtgtttttgtcctgggtacttgcatgatggaagaagaaattgggtattcctaaatgtgctactgcagatcaaaggttggcggcttaattgacccaggttttgtaacatatcaatggcagatttgattttgtcttgggagtaacaaggaagaagggtcagtttatgttctggactaatcacaaaaaaggatgccactgaatatatttgacctgatgtgaggaaaagatttgattttgtcttgggagtaacaaggaagaagggtcagtttatattctggactaatcacaaaaaaggatgccactgaaaatatttgacctgatgtgaggaaaagagagcatttgtactggtgggtttgatttgttaatccagtggggtacagcctggtggaaccatgcaaatgacgatcttcgtttctcaggctgtattagcgcttagcaaacttctttgtgccgccgcctgcgctttccccttccatctccgccgnctcgtctnctccttcaccaccacccccttccctgccttcgtaccccaagatgggagagctccccaggccattgtgtggctgctgctcaagggacagctcgcc

SEQ ID NO: 56919 - DNA, 661 bp, Triticum aestivum
  Clone ID: PAT_TA_56919
ggggtggggtcagcgggggctcagtcgtcgggcgggggattctttcgcgtctggcatgcggcggcgcgaggtgggagatgcggggaggacaaagaaaaaaggagctcgatcaaacggctgataagacgcgcatctgacggctgggggtcgaccggccgaacggttcggccggtgcgccggcgcctagcactgccctaccatttatgatatttgttgtaaaaactttcagtttttttactttttataattactattttaaaaaaaaatagcggatgcactcgcatcgtccgagagccaaaatctgcttcctttggacacaccgctattagtttgttctgcggtagtcttaggtattcttttttttgaaacttagtcttaggtattctcttggtcacgtcagctggttagggagcagcggccaccagcggaaagctatgggtaatcacgtacagtatgagtcaatgaaccatatattcgtggtgcgcggaagcgtcatgttgtcgatactatgccattgtaatagtgtaactggtgtcttatttttcataattagcgtacaacaaagtttcattcagaaggaaaaaaaaatcccttcctcaagcaacttgccatttgccaaagcctaaatgacctcgcacaacctaagctgctttgcaaagca

SEQ ID NO: 56920 - DNA, 632 bp, Triticum aestivum
  Clone ID: PAT_TA_56920
gttcgggatggggctcgtggaccaggcgatacagaggtacgagcccgaggagcacaccatcatcgaggcccacccggaggtttacgcccggatgctcaagcttgggtggggtgagaagaagaacgtcaggatcctcttcgggcgatggcaggatgtgatcccgcagctcggctcgtatgatgttatattcttcgacacctacggggagtactacgaggacatgagggagttccacgagcacctcccgaagctgctgaatccgggaggggtctactcctacttcaatgggctgtgcggcgacaacgccttcttccacgtggtgtactgccagctggtggcgatggagctggcgagcctcgggtactcgacacagttcgtccctctccccgtcagggactgcctcaaggcggaggtgtgggagggggtgaagcagaagtactggcagctcgacacctaccacctcccggtctgccaggccgaatctgaatcagagtagaatttctaccgtgttgctactgatcgagttttcgctagctcttcgctgctgctgtaagtttgttcaggtcttcaggatcaggtcaagcttgcctgcgtgcgtgtttgtggattgcagtcgatgatagaactcccgt

SEQ ID NO: 56921 - DNA, 578 bp, Triticum aestivum
  Clone ID: PAT_TA_56921
gggaggcggaggccaaggcggacgaggagacgatccgagggaagaagaggaacggaggagggaggaagaaggaggccgtggcggcagaggcggagatgacccgtgggaagaggaggaaggcgactggggagactcctccaagtaccgcgcggccacgaacctgaagaagcgctaccgtggtcgcaagggcgccgtgttccagagcgcctgaacaagaactgttccagtcaccttgcacgctctctgctccaccctttccccgcgtaccgctgtacgaataatggtggccatcctagttgtgtggctctgttcagtctactgtagtctctacgtagttttgttgggtccgtcgttgccacaataccactgtgtcttgctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttttaagggatccaagtttattacccgggggtgggaaggttaatttttttttt

SEQ ID NO: 56922 - DNA, 109 bp, Triticum aestivum
  Clone ID: PAT_TA_56922
gctacacatgcccgaccagaatctgaccttcggcaggcccgacaggaacttgcaggaggtcttccgcgccactgatcagcgggcacgatgacttagtggcccgacccct

SEQ ID NO: 56923 - DNA, 742 bp, Triticum aestivum
  Clone ID: PAT_TA_56923
cctcccccaagagacagaggagattgagattgatggacgagttcatcagtctcggcgacgaacctcagcctcgtgcctcggaagatctccaccagcccctccaagtcgatgccgtcgatctgaatctgaatctcaatcacgcaccaccacagccggagccggagccggagcctctgccatcccagcaccacccacaaggcaccaaggccagtactagttccgtcgtcgtcgaggtcatcgacctcgaggaaggccagatcgcctgccaacaatcttcttcttctgctgctgctgctgctgcccaagatgcagcagcagataacccccaggccaaggccaaagaagaagccttgggtgccaatggagtggggcctcctcctcccccatcccaccaacaaccgcaagatgatgacatcatcgacctcgaagaaggccaggttgaggacatggacctctccgacgacaatgccctagtcattgttacaaagcagcatggcttgtgtttcagcagctgaaacacccatgggcaacaatgacgggcctcccctttcttcaagaccgagcagcggcgcctttatcgaccaaagccccacaagaggagttaaaagaccccgcacggaatcagccgaaccttctggttcgtgtagtctacaacaacttgacaagggaaagcaaaaggaaactcgtggaactgatgcagcaatgggtccgagtggcaagctagaaagcaacacgccttgac

SEQ ID NO: 56924 - DNA, 769 bp, Triticum aestivum
  Clone ID: PAT_TA_56924
agcatgaatgtggtattggtggactattggatcatcttggatttactagtgtgattataggtttgagataacttcaacacttggatttgtgataattttacctaagcttagtagcttgtatgtgccccatatggacatgagcatgaagatgatacaaacggatcatagttggtagattttgatgattttgctagccctcaccaagaatgttacgagtacaagatcatcatgggaggatggtttcgattaattagaatggatgacaacttcagtggtatgagccttgttggagcagctgatcttttattatgtgtttgtgctcctttagatgcaatagcagaagggtagtacttatgaagtgatattatattggtgaataagtagatctttaataaccttggaacagttcggatttacttagatgtttgtgatcttgaaaaaaaattcggcggataaataacttataatttttggatctatagtaatccagttgaggctgaggtaggtttagaggagcgatgagaaagcagatgagaagctttactcgatcgcctgaagatcaacattgccgcaatggcttggcacaaagcccgatgtggctataagggttttcatcccctcccacacctcccgtgcgttgttcaattaccgccaatttcttcttggtgtccttccctatttgcgggttccgtgccactaacttgatccgacatcacacgttctcccgccgtgcgtccttggccttggcgggtagtaacgccgtgctctc

SEQ ID NO: 56925 - DNA, 561 bp, Triticum aestivum
  Clone ID: PAT_TA_56925
ccgtccggtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaccgttttcttaatcgacagtttgatcgttgtagcggtgaaaaaataaagtgtcatgcactatcatgtaagaacccgactatactagttcaaacttggga

SEQ ID NO: 56926 - DNA, 551 bp, Triticum aestivum
  Clone ID: PAT_TA_56926
gacaattgcaacaatcagcacaagggcaaaaaggacagcaaccaggacaaggtcaacagccagggcaagggcaacaaggtcagcagccaggacaagggcaacaaggtcagcaaccggggcaagggcagccagggtactacccaacttctccgcagcaatcaggacaagggcaacagccaggacaatggcaacaaccaggacaagggcaacaagggtactacccaacttctctgcaacagacaggacaagggcagcaatcaggacaagggcaacaaggctactacagctcataccatgttagcgtggagcaccaggcggccagcctaaaggtggcaaaggcgcagcagctcgcggcacagctgccggcaatgtgccggctggagggcggcgacgcattgtcggccagccagtgatagaactctctgcagctcgcatggtgcttaggcatgcatgcactttagctatacaataaatgtgaccgtgtgttcacagtttttcatgtaactagagtaaagcccagtaataatgcaaaatgaaaagcttttctggct

SEQ ID NO: 56927 - DNA, 657 bp, Triticum aestivum
  unsure (1)..(657): unsure at all n locations
  Clone ID: PAT_TA_56927
gtcaaaggatgaattacatctcaagattaagagtaaggacaagtcctcggtgaatgaggaggacgagaagaaggagatcgagatagaaattgacgccaaggttgtggagaaggaagaggtgtccagtgatggttcaaagtctgcaggcaaagtcaaggaaactaaaaaagacaaagaaaaggaagggaaaaacaagtcagagaagcatgtagatgaacatgaagacgatcagaagacaagtaagaaggataaaaaggagaaggatgagaaaaagaaagaagatggcgaaggctcagaaaaggacaaggccaagaaagggaaagataagaagagcgagagcaaagagaaggataaaaatagcgccaaggagactggacctgatgcagatgacagtagccccaagaacaaaaagaaggataaggacaaggcaaagaagaaggatgaaagcgatgaaaaacaagagaaagacaaagacaaggaggaacatgagaacaagaagaaatgtnnanaaggtgggatcagacaagagaaatcaagctacaagataatgagtcgggcgaagaaaggaactgatgcttctgaaaaagaaaaaggatggcacggacaaagcanaggataaaagaaagagagaacagtgcgaagaagcaagatgaacat

SEQ ID NO: 56928 - DNA, 660 bp, Triticum aestivum
  unsure (1)..(660): unsure at all n locations
  Clone ID: PAT_TA_56928
cttttactgccagaaggaccgcaagtaccccaccgggatacgaaccaaccgggccacgaaggccggctactggaaggccacgggtaaggacaaagagatcgtcaacccacattgcatgtccatgctcatgggcatgaagaagacattggtgttctacaagggcagagctcccagcggggagaaagaccaactgggtcatgcacgagtacaggctcgagatcggcaagcagtcaacatccggcctgcccaccaccatcgcaaatgccgcttccaataacgtgtcttctaaggagtatgtggtttgcaggatcttccataagnaacactggaagtnggggtgtcatccatggtgtcacatgaggacgttgggaccggtcctggcaacaacgaccagggtcaacggcggtgcaacaaccaccgacaagatcttgttcgatgagcatgcgtacaggtggggcatgttnggaagtactaataatncagatgatccaagaaacatatatgtgngnggtctgtgcatttaattaatcatccatcagaaggatccggtcgatatataccaacatctataatttggtttgcaccgcattttaattttttcagtgtgattccaagaagagtttgcatgcgctggctcatctggcttgcctctcttgtgct

SEQ ID NO: 56929 - DNA, 599 bp, Triticum aestivum
  Clone ID: PAT_TA_56929
ctctgtttgcaccttgcaggtgttaagccaagatgagacacccttcttgtacagtttggtgtttggtgaaggtgttgttaatgatgcgacatcagttgtgttgttcaatgcaatccagaactttgatcttggaaatttcagtagcctcaaattcttacagttcattggaaatttcctctatctattcggcgccagcacctttcttggagtagctagtggacttctcagtgcttatgtcatcaagaaactgtactttggcaggcactccactgatcgtgaagttgctattatgatgctcatggcttatttatcttacatgttggctgaattgcttgatttgagtggtattctcacggttttcttctgtggtattgtaatgtcacactatacctggcacaacgtaacagagagttccagggtcacaaccaagcatgccttcgccacgttgtcattcatctctgagacgtttctctttctctatgttggcatggatgcattggatatagagaagtggaagattgttagtgaaacatatagcccaatgaaatctattgccttgagctccattatttttggcattggtactggttggaagagct

SEQ ID NO: 56930 - DNA, 165 bp, Triticum aestivum
  Clone ID: PAT_TA_56930
cggacgcgtgggtggccctatggccgggtacggagtgcaatggaagtcatcaccttaagctgagctatctggtgtggctgctcaaaggtaccatgtgccaattgtttcatctccacgttgttcggccacgttgttgatctcatcaatattctcaatagcaagttc

SEQ ID NO: 56931 - DNA, 617 bp, Triticum aestivum
  unsure (1)..(617): unsure at all n locations
  Clone ID: PAT_TA_56931
tgatagcacttttgaaaagaagccccgccaaagcaaggttggtgctgacaatcagactgatttgcccactgagaaggaccatgcacgcatgggcaaagaacaaatgaactctacttctcagacaaagcatcatggtaagaatagaaaacatgacgggtctattgatgggagggaaaatgcaaatcctaaggttgtaagcaatgttgttcagagcagtcccatcagcccacaagcatcaaatgaaagcacttatggcacaccagctgttaaccgatttagagtagcagttcggaaagttccaagaaaaaaatttgaacagctcaatgacaaatccaagaaggatactagtaagagaggcgctggcgcaattttcagtgacaccataagtgaagactctgatgaactattgaacaccatgggtgaaaaggttggcaaggaaaactcatcagatgattcatccacatctgctgactcaggaatttcatccacggcctgggagggaagcgacgtacctgatgatgaaggcattgattcgctgtcacagagggagtgacatcaacttcgtcctccgaggctccagtagctacaaagagggcgaggctngaaccaaccgagct

SEQ ID NO: 56932 - DNA, 581 bp, Triticum aestivum
  Clone ID: PAT_TA_56932
cacatgaagatgattgcatagcatggcattatgaaaaaaaagatgaagatcatgtggttttaattggccaaagttgtggtcgcttcccctccccaacaaggttcttcacttcttatggcgcatgtccacaaataccttaccactgcgcatgaagctccagcaaagaggtaaggcaagaagggagaatacaagagcaacaacaaaaagaaagatggtccagacctccaccgaagatcttgaaaatcaacactgacggcgcctacctgaaggaatcaaattctggaggttggggctttgttatcaggaacgattgtggtatggtaatagcagctggtgcaggaaatttggggcaagtttcgaatgcgctccattcggaggcaatggcaatgttgcatgccataaacgcagctattcagatggggttgtcactgtgtcataatggagactgactctgtgcaacttcagtcagcagtgaacaatgaagactatgatctctctacattaggagctattttcaaagatattaaatttaagctgagagtaagcttcaatatggaactggtggggcttggcctagaact

SEQ ID NO: 56933 - DNA, 714 bp, Triticum aestivum
  Clone ID: PAT_TA_56933
gagtaaatggacgcccgtgagggctgtgcccgtgctccactgctgctgatgtagcacctttcgatgcgcaggcctgtcaccgacggcaagtgcaagaagaaggccccgaggatgatccacaaggccgagagggagaagcacaagcgcgacctgctcaacgatctcttcagcgagcttgacgaaatgctaggtgagttgagtaggtgtgcatgtttctgaattctgtcacggcattgctccagtgaccctgttcctgaattttggggttgttttcttttccttgtggttatttgggatgttacggttgagcgtgcgtgggcatgtgtgaatctgcatcatgttgttatcatccatgtccaagccaatgtttttgagtgaatagtaggggttcagtatgtgtaatggatttccttagtaatagtagatcccaatgaatgtttatgctgatgaaaacgtggatgaacttgacaacttgttacaatccgtcaagcttcaccttcgacattcacttacggtgtaaagcagcctcagacaatggtgaatgtgtactgcctgtttgtcagcagcatcttactggtcttggatttttcatgccactcaactaaatttgccacattaagcattggggtttattctgatcgaattcaacatcattttgcaagaacagacaggcagaccaatgggaaggcatgtatatttgactgacaccactcg

SEQ ID NO: 56934 - DNA, 604 bp, Triticum aestivum
  Clone ID: PAT_TA_56934
cattttcacagcaaccaaccaccgttttcgcaacaacaacaaccagtactaccgcaacaaccaccattttcgcaacagcaacaaccaattctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaagtgatgacttccattgcgctccgtaccctaccaacgatgtggccgtgtcaat

SEQ ID NO: 56935 - DNA, 453 bp, Triticum aestivum
  Clone ID: PAT_TA_56935
gtgcaacttggcgaccattcacaatgttcgatactgccccgccgtggaacagcctctgtggatctagagataaaatcagtcgctcgtgaataagcatgcatgttgcatccataggcgtgtggtgtgcatgtatacatatgtgagctccgcgcgctcaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatagaactctctgcagcttgcatggtgcttgggcatgcatgcaccttagctatacaataaacgtgacgtgtgttcacagcttttcgtgtaactagagtaaagcccaataataatgcaagatgaaaagcttctccgactaa

SEQ ID NO: 56936 - DNA, 714 bp, Triticum aestivum
  Clone ID: PAT_TA_56936
ctgacgcgggttgcgtcgccgagacgttggctgctgctgctgctgcattatgacgaaggtgacaaggattacgtgggggttcttgtatgcttgctttttaaccgtcgaaaattattgttttttattcaagtatataagtacgtttggctagcgagtaggagtaatttacaagagaacaaaacagcttaataaaaatatgaaacaaataaatgaattgggttgctttataaagaggagtttttgtttcatcagatgaagaaagctgaaccgcaaacactttcagaagcattctttttctgttactgtcagcacagttaatcagattcccaaggacagtttgcacggcaacactgccgtattttgaccgcaactgtttctctccgagaaaggaatgactgatgaaggtgacctctgtcttacggtttgacactattatttcaccccactctgaaaataagataaacaaaaaaggaggcaaactttgacaccgttacttctgaaatagtaagacaaaaagcaacgagacaaactttgataatacaataagacaagcattctaccgtagcacaacctgggctgttttcatgaaaaaatttgtcttgttcttagaaagcaaaacaattaagacagtcagttttgggggtgacgaaaaacatgacaaaaaatttcagctccgacttcattgagccatgacatctgcaatattaattcata

SEQ ID NO: 56937 - DNA, 559 bp, Triticum aestivum
  Clone ID: PAT_TA_56937
gcaacaagcacaacaacaacaacaacaacaacaacaacaacagcaacaacaaccaacaacaacaaatccttcaacaaattttgcaacaacaactgattccatgcagggatgttgtcttgcaacaacacaacatagcgcatgcaagatcacaagttttgcaacaaagcacttaccagccattgcaacaattgtgttgtcaacagctgtggcagatccccgagcagtcgcggtgccaagccatccacaatgttgttcatgctattattctgcatcaacaacagcgacaacaacaaccatcgagccaggtctccttgcaacagcctcagcaacaatatccatcaggtcagggcttcttccagccatctcagcaaaacccacaggcccagggctctgtccaacctcaacaattgccccagttcgaggaaataaggaacctagcgctacagacactacctagaatgtgcaatgtctatatccctccatattgctcgaccaccattgcgccatttggcatcttcggtactaactgagaagagaaacaacattttcttagtcccat

SEQ ID NO: 56938 - DNA, 269 bp, Triticum aestivum
  Clone ID: PAT_TA_56938
cggattagggccaaggagatcgaggaggcggccagcaaggccaaacccgccgccgctgtcgacgacgacgatgacaacggcgaagacgcggaggaggcagacgatctaacgatgctggtggggatggaaatggagaaggagctctgggccaggatcggcatccatcatgacgacgacgacgacatgccgctgggcgacaacgacgacgagcaggaggccattgagaccgcccgcgccggcatacggaaaggccgcgtacgagcggatca

SEQ ID NO: 56939 - DNA, 673 bp, Triticum aestivum
  unsure (1)..(673): unsure at all n locations
  Clone ID: PAT_TA_56939
ccattgtccagaactagtttcaattcgtggactaccgacttgcaaaatcaaagaggctgaccatatcaaagtgcccaaagttgaagcaaaggagatgagatgctacaaaaaagcggccaaatcccggtgcacctggtagttcaaacttacaccagattgctggtgaccaactgccccgcctctacaagctcctcggggatgacatggtagtagctgggatcccctacagtggccaaatctcggtgcacccagccgccggtcgtgatcccctctactgaggctccacttcgaggcaccgtcagtccacaggagncaggggcggtgtgctcatcaacaaaaaagaacagaaggtattgtgcttggaaacttaaaattctgtacacatttgggaaaacagaagttgtagncttctttcatcaaagttcaaaacgaataattnnatttcagttcaacttgttctagcaaaccatgtgcgagacaccatagaatgaaaatgttgnntgcgttgccaggtctccaatttgttcaactacaaataaattacattccgttcgactacatatattacactagttcaactgagtgcgtcacaccaattgaccttaagttttacatatgtatcacttaagaaaaactgtagattttgatgatgcaagcttaattcttttttcta

SEQ ID NO: 56940 - DNA, 175 bp, Triticum aestivum
  Clone ID: PAT_TA_56940
gacacggacggcgacggccggatctcgccgtcggagctggccgccgtgtcccgggccatcgcgccgccggccaccgagtccgcgcagggccgcgaggtggcgtccatgatggacgagctcgacaccgaccgcgacggctacgtcgacctgggcgagttcgccgccttccacggcc

SEQ ID NO: 56941 - DNA, 714 bp, Triticum aestivum
  unsure (1)..(714): unsure at all n locations
  Clone ID: PAT_TA_56941
caagctgtcatcgaaactgagacaggtgaccaacgggcttaagctgacgaatccgggcaagaaggtgccaccgacgcctgcaccaaagaccgtgaggaagagatatgaccgaagcaagagcagtgctgcagtggcactcaaaggcttgcagtttgtgactgccaaagttggcaatgacggctggactgcagtggagaaacggttcaatcacctacaggttgatggcatgctactccgttcaagatttgggaaatgcattgggatggaagggtcagacgagtttgcgatgcaaatgttcgactcgttagcgaggaagagaggaatggtgaagcaagtgctgactaaggaggagctgaaagatttctgggagcaactgagcgatcagggtttcgacaaccgactccaaacgttctttgacttggttgacaaaaatgctgatggaagaatcacctcanaggaggttaagggagattattgcgcttagtgcatcagcaaataaactttccaagatcaaagagcgagctgatgagtacacagcacttatattgggaagagcttgacccaaacaacttgggctacatagagctcgaggactttggaggcactcttactgcagtcaccatctgaaagctgttgccaagatcaacgaccacccacagctcgaaacttagcanagctcttagcatgaagctcgcacctagcaatgacacgagt

SEQ ID NO: 56942 - DNA, 657 bp, Triticum aestivum
  unsure (1)..(657): unsure at all n locations
  Clone ID: PAT_TA_56942
cgccgccctcgtcgaggtcgtcgtcccccccctccccttcttggcattacccagcttctctgcagcaggtaggacaaggacaacaaataggacagctaggacaaaggcaacaaccaggacaagggcaacaaacaagacaagggcaacaactagaacaagggcaacaaccaggacaagggcaacaaacaagacaagggcaacaactagaacaagggcaacaaccaggacaagggcaacaagggtactatccaacttctccacaacagtcgggacaagggcaacaaccaggacaatcacaacaaccaggacaagggcaacaagggtactactcaagttctctacaacagccaggacaagggctacaagggcactacccagcttctctgcagcagccaggacaaggacatccaggacaaaggcaacaaccaggacaagggcaacaaccagaacaagggcaacaaccaggacaggggcaacaagggtattatccaacttctccgcagcagccaggacaagggaaacaactaggacaaggcaancagggtactacccaacttctccgcaacagccagggacaggggcaacaactgggacaagggcaaccagggcactgcccaatgtccccgcagcagacaggacaagcgcaacaactaggac

SEQ ID NO: 56943 - DNA, 712 bp, Triticum aestivum
  Clone ID: PAT_TA_56943
cgcagaacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggcttctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaaccgttttcttaatcgacagtttgaatcgtggtaagcgggtgaaaaaattaagtgtcatgcactatcatgtaagaacccgactatactagttcaaacttggga

SEQ ID NO: 56944 - DNA, 649 bp, Triticum aestivum
  Clone ID: PAT_TA_56944
cgctcttgcggcggcaagtgccgttgcgcaaatttcacagcaacaacaacaaccaccattttcacagcaacaacaaccaccattttcgcagcaacagcaatcaccattttcgcaacaacaacaacaaccaccatttttgcagcaacaacaaccaccgttttcacaacagccaccaatttcacagcagcaacaaccaccattttcacagcaacaacaaccacaattttcacagcaacagcagccaccatattcgcagcaacaacagccaccatattcgcagcaacaacaaccaccattttcgcagcaacagcaaccaccattttcgcagcaacaacaaccaccattttcgcagcaacaacaacaaccaccatttacacagcaacaacaaataccatttgttcatccatctatcttgcagcagctaaacccatgcaaggtattcctccagcagcaatgcagccctggggcaatgccacaaagtcttgctaggtcgcaaatgttgcagcagagcagttgccatgtgatgcaacaacaatgttgccagcagttgccgcatatcccccagcaatcccgctatgaggcaatccgtgctatcatctactccatcatcctggcagaacaacaacaggttcagggttccattccaact

SEQ ID NO: 56945 - DNA, 525 bp, Triticum aestivum
  unsure (1)..(525): unsure at all n locations
  Clone ID: PAT_TA_56945
gaaaacatattgatatagcagtgatgcaaaatggaatgcaaggaagtacatggccggacactcaagtggcttcgtggcctactcaaagactatgaagtgccacagcaaacagatggctgttcctgtgctctctgggtgttgaaattcatccaatattggaccggagtgagattgtcggctatattcaaccaggatgacataagacagttcagaagatggcttgctgctgccttgctcaattcacctcacaatgagtnntgaaagttcggaaggccataccagcagttgatttagaagatgatttagaagacctcgacctcggaggtgacgacggacacaacgacagcgggagatgtctcaggagacgatggttccgcactatagttgtatggcgctagacttagggtagagtaataggattgggcgtggtggtgggttttttgccccgaagaaggtttccacaccgtttttcagtttttattaactttatctatacagcgggagatgtatcaaacaatttttttt

SEQ ID NO: 56946 - DNA, 709 bp, Triticum aestivum
  unsure (1)..(709): unsure at all n locations
  Clone ID: PAT_TA_56946
caccatatctgcagctgcaaccatttccgcagccgcaactaccatatccgcagccgcaactaccatatccgcagccgcaactaccatatccgcagccgcaaccatttcgaccacaacaaccatatccacaatcgcaaccacagtattcgcaaccacaacaaccaatttcgcagcagcagcagcaacaacaacaacaacaacaaaaacaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcacaattgtgttgtcagcagctgtggcagatccccgagcagtcgcggtgccaagccatccaatgttgttcatgctattattctgcatcaacagcaacaacaacaacaacaacaacaacaaaaacaaccattgagccaggtctccttccaacagcctcaacaacaatatccatcaggccagggctccttccagccatctcagcaaaacccacaggcccnagggctctgtccagcctcaacaactggccccagtttgaggaaataaggaacctagcgctagagacgctacctgcaatgtggcaatggctatatccctccatattgcaccattggctccagttggcatttcttcgtactaac

SEQ ID NO: 56947 - DNA, 613 bp, Triticum aestivum
  Clone ID: PAT_TA_56947
tgataactggagtgagcaattttcactccttgagcttcatcctttccatccttatagaaaatggccaattggagttgctacttcaaaagtattcttccactgacacagccacagtggcacctgcatcagttcgagggtttaggttggctgttattacatcactgaaacatttcaacccaaatgatgatgaagctctgtctctggtatacaagcactttgacatgaaacatgaggcggcttccctccttgagtcgcgtgcagagcagtacatggaaagctggttagatcggcatgataaggaacgacggaatgatgagctccttaaggctatgcataaccttgtacagacggctgagattctttcaacaattgacgctggccaaaggacacatcgtgcttgcgctcgtgcttctctcctatctcttcagatccgaatacctgatcttgtatgggattggtcttacagaaaccaatgcgcgccgaattttcggtggatcaatctaggttccaggaggccctcattgttgctgaagcatatagcataaatcagccaatggaatgggcaccagtcttctggaaccagatgctgaagcccgacctcatcgagctattt

SEQ ID NO: 56948 - DNA, 769 bp, Triticum aestivum
  unsure (1)..(769): unsure at all n locations
  Clone ID: PAT_TA_56948
taacttgataccatgctttggatttggggatgtttctacatgtgatcattccgtcttagcttttacaaagattaccgtccttgttgtggttttgaggaggttcttgacagatacaaacaaatgattccatatttggacctttcaggaccaacttcctttgcacctcttatctacgcggcgatttcagttgttgaaaacagtaactaccaacatcatgtcctcgtcatcatagctgatggacaggtagccacctcaaagtcttacagcatcgtaagtccacaagaagaggcaactatacaagcacttattgatgctagcttctatcctctttcaattgtgatggntgggagtgggcgatggaccatggaaggaaatgcagcctgctgatgaatgtattcctgccagggctttttacaatttccagtttgtgaactttactgacatcatgtcaacaagcaaggatatgggcgaagaaggaggctgcatttgcctttgcagctctgatggaaatacccactcaatacaaagcggcccaaggcctctaccccccagagtggcacgaagaaatggctgatcctttggatgatccttccgccaccaattgaagtccttgaacgtgacgatgctgttgcagctacctatgctccagccgcaaccttcctgccaaaccgacgttggcaatgaggctttcagttgaaacaaggtatgccccatctgcttaaggaatccgaaggacatggcttttccaagggcggtcatctgacatgca

SEQ ID NO: 56949 - DNA, 710 bp, Triticum aestivum
  unsure (1)..(710): unsure at all n locations
  Clone ID: PAT_TA_56949
cagaattctatcaaagacttctctaccaataattgcagcaaaattctctctttgtgtgtttcttacttcacacctgtgtatgtgatgaagttgaaagatttctttccaaataaagagctcaagagaggctccatattttgatgggcgagttgtatgctatccaaatatgaagacgattcatgattatttggcatggaggcaactggaccgccacaacaggatccagtacaagacatgctttttggatgctagtgaagtccggaaagggcgaaaacgaagcttacgatatcnctgaagtcttctttcatcatctacgtcaaaggacaagaacgagttgctagaacaagttgctctttcagccgtttgaaatgaactacaacaacgaaccggccatgtactgaaaggcttcatgtgcttaccgtgaaaagagcggatggctgcaggtggacgatgctgcgagtgnggcggtggcgcacgtcgacatgaaggccagagttttggagaacgcatctttggtggtcgcccttcatcggcagcagcaccaggcggcagccggccaccggccacgagcccctccaccacggagctagncggnngggggggttcacgaagcacccacgctttgcggtgccgcnaaggaggtgctgctgctgcacccaccccgtgtgcaccacgtccttgcccttggtcctcctggcgaagaacggtcg

SEQ ID NO: 56950 - DNA, 106 bp, Triticum aestivum
  Clone ID: PAT_TA_56950
ggaaggttttgaaaaagatgaattatgaaaccgttgctgaggcggttatcaaggactattattctcgtgcatctgcaaaatgacaaccacgcaaagtttaatcttt

SEQ ID NO: 56951 - DNA, 730 bp, Triticum aestivum
  unsure (1)..(730): unsure at all n locations
  Clone ID: PAT_TA_56951
gaaaagggaacgtgcagactaatccgggaaaaactgaaaaaaacttatgggcagagaaaaaagaccagagggagtacatggcgagttaatctgttggtgaaactttattggttggaaacctggaagatgagtcacttggatgctgctattgaagtgattgtgtctgttaccttagtcaatctgttttcttgtttgctactttggttaagtcaagtattttgttaagtactcgtgctgaaattttaattaaatatatcatgtcttatcattgttcatatggttgatccaccgtcgtaccggtagtaaagattcacgttcctcgtttcatggtaccgtactggattcatcgtaccagaattganttggttcgcgtttccgctttagaaaaatcgttctagagatgtataccncccgttgtaccctactttttccagcctccggctctcgtcccccgttcccgttccttgttcccaccgtaccggaaacatggcaactatgattgcgcctgcctaccagcagcgaaatgcgtttgcttgccttttctttttcattgagatgcggtgactgaaggattcatgaactggctaacgtttgatacatattatgagttggccttcctctctaatcatctgccccttgctcccaaaatcaccttcgccgccccactctggttctggcctcctccaccgctaatcggcgatgcctggcgtctaggtcagcctgcctttcc

SEQ ID NO: 56952 - DNA, 720 bp, Triticum aestivum
  unsure (1)..(720): unsure at all n locations
  Clone ID: PAT_TA_56952
gcggcaacaaccatttccaccacaacaaccatatccacaggcacaaccatttccatcacaacagccatatctgcagctgcaaccatttccgcagccgcaactaccatattcgcagccacaaccatttcgaccacaacaaccatatcctcaaccgcaaccacagtattcgcaaccacaacaaccaatttcacagcagcagcagcagcaacaacaacaacaacaacaacaacaacaacaacaacaacaacaaaaaatccttcaacaaattttgcaacaacaactgattccatgcatggatgttgtatagcaggaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaataaaaacaacaacaacaacaaccatcgagccaggtctccttccaacagcctcagcaacaatatccattaggccagggctccttccggccatctcagcaaaacccacaggcccagnggctctgtccagcctcaacaactggccccagttcggaggaaataaggaacctagcgctacagacgctacctgcaatttgcaatgtctacatccctccatattgcaccatcacgccatttggcatgcatccttcggtact

SEQ ID NO: 56953 - DNA, 332 bp, Triticum aestivum
  Clone ID: PAT_TA_56953
gtctgatcccaattccggcgtgctcaaggaccttcccggatgccccagggagccccagagggacttcgccaaggtgctcgttacgccggggcactgcaacgtgatgaccgttcacaacaccccatactgcctcggtttggacatataaagatggatagatccgtctctcatgaatgaataagcatgttccatccatggatgtgtggcatgcatatatatatgaacaagaataaagggaatcattttgtgattcttaaatttcaactcaatcttttgttcatatgtctcgaggtttaatagccttgtgagtatcttattcattgcttgtgacc

SEQ ID NO: 56954 - DNA, 347 bp, Triticum aestivum
  Clone ID: PAT_TA_56954
cacaggtcttgtctaaaaaaaaaaaaaaaaaaaaaaaaaaaaaaaaaaaaaaaaaaaaaaaaagaaaaaaaaaaaaaaaaaaaaacagacttacataaaggaagcaaagcaacgtaatagattcttgctatagagaaacctatattcttttggcgggccgaaattttacatcggcgggcctgggaatacccgggggttgcctagattaaccggcttgcatcccatttccctttggccagctggcttattatgggggaggcccggaccgttcccacttcgcgccggttgggcatcctgaatgttgaatgggccgcgttatggagcggaacatcacccccggtgggggt

SEQ ID NO: 56955 - DNA, 751 bp, Triticum aestivum
  unsure (1)..(751): unsure at all n locations
  Clone ID: PAT_TA_56955
tcgagctgctgccgctgcttgcacggcgtcgagcagccgcggggccgagcactcccgccgccatggagctgagggtgccgctgctgtccttctctactgaggatgtcgccgcggcggctgcacgcagacgaagccatcatctgggcacggcggctcaggacatcgacggcgacatcgtcaggttggagcaaggcacggcggcggtgacgggagccggcgggatcgagaacagggggattgagagcaagggggttgattgcttttatttttagatccaggggtgtgtatgacattagtttgccaagtcagctcttgacagccgggcctcacttgtcagaaagcgatcaaagggaccaaatcacccgatcagtgctttttgcaataagattagagatttacggtgttttttgcaacaacaactgattccatcattggatgttgtattgcagcaacacaacatagncgcatggaagatcacaagttttgcaacaaagtacttaccagctgttgcaagaaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttc

SEQ ID NO: 56956 - DNA, 567 bp, Triticum aestivum
  unsure (1)..(567): unsure at all n locations
  Clone ID: PAT_TA_56956
gcggcgctgcggcagctggtcggccaggtgcaggagctctgggacctctacggcgccgtccacgcccacgcccacggccccatccccaggtggtatttacttgactttgagcatggttcggtcaaggatgattattgtggagaaaggactgggtacaactcggaattattgaagatcatggaagctaaccaatctcctcctcgcaagcgaccacgcagagacagaaaccgagagaaagcatccttcctgaactcggctgaagcaatgaagctagatatttggagcgagttccctgaagacctttttgaaactgtcattgcaaggcttccagtggctgcaattttccgattccgctctgtttgncggaagttggtgttctctggtaggctcagacaatttctctcagcagtactctgaagtcccacagggaatgccatggttctatacaatcacacatgagaatggcaacaacaatgntagcgatgtatgaccccttcgctaaacaagtggcaccaccccttctggtccccttgctcctgcaaacatagtaatgccagtggcatctgc

SEQ ID NO: 56957 - DNA, 679 bp, Triticum aestivum
  Clone ID: PAT_TA_56957
cggacgcgtgggaaaggaatgtaggtataaaactatggaacagcgaaccggaggaaactctcaagagaatgtgttcggatggactacaaaatgtacagatttgtttttttagagtagcatgcttggcagtacgagatgctatttgtttattcggctgcacagtgactactcttgtcctcacctcatgtaccacacataggttgatttttttattccggcaacatagcacagcaacgtgtctaacgcatggcagcgagcgcctgcctcgggcttccgcccaaaaaatgagcagcgcgtgggatgtttcttatcctatggaatcagtactaccagaccagctttcctatgaaacactattcacctttcccatgttccgaatggttggaagggaaagaataccgtaggaatttgtgttcctacgaaaatcctgcaccaaacctgtgaaccgaacacagctttagctgttcttaaactaatgtccttggtaaaaatgaagccatgccactgttataagccatgacaagcttagccaaatggtttttgcctgtaatttgtttgagactctgactgtttcctctgtgccttttttgtgcaaatagggatatccgattcacctggttgctggttgtgacccttttggtggcactgcacaaaactcttcttaaaagaagtgactttt

SEQ ID NO: 56958 - DNA, 712 bp, Triticum aestivum
  unsure (1)..(712): unsure at all n locations
  Clone ID: PAT_TA_56958
caaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtcaacaacaacaacagggntcttgggttctagccagccacaacaacaaacacaactggattcagggttggatttggcggtgatagggacaatggggtggatttcagaccatcccggcaatgtgccgacgttgccattgttccaccattactgctacanccaccatatcaccatcagattgacgtcactaccgacatggggcggctactggagaaagaacgagagctctagtatcccgaaaaatggaccacccatggnttagttcatgggtccg

SEQ ID NO: 56959 - DNA, 685 bp, Triticum aestivum
  unsure (1)..(685): unsure at all n locations
  Clone ID: PAT_TA_56959
gccgggcggtttgaggccaatgccggtggtgccattcgtgtttaggtgtgcggctgtcagatttggtctttcgctttgctattgtcactgtctttgtgtcacctaggcagagttcgtcctatggtcccgctgattttcttttagttggtcttgctgttgtgtggtcatgtcgttgtatttggttgagctctaggctagatggagagcggtgcggctggtcatgtctggcactgtcagaagcgcgctggtatacttgattgtggccatacggccttttatgtttcatcccttttgtattcccgttgataaaaaaggcggagccacaccttaaattggcatggtgatgttggatggcagttggccagtcagttaggttgattattcaagaaatcaatgtgtgtatatctgacaaaatgataatcacagtaaactaaaaagcttagaggttgagtttaaaagaaagttcagaagcactgaaggctcatgtttctacggtcatatttaaagctccagttctgagtgggtgtttctgaaaaagagattatcaacatctgcatatgtaccatgtgttcataatagcattcatgtctcattcttttggttgncattattttttctctctgcatatggggggagggtccgggttcaaaatattgataattttcatataaaattttataactta

SEQ ID NO: 56960 - DNA, 715 bp, Triticum aestivum
  Clone ID: PAT_TA_56960
caagtcttcatccagaaataggactcacaaaagttaatactcgagccaaatggagtcaccaaatgaagttgttccttgttagactcttaaaagattatgatgtgcctggttttcggacacataatgcttggagtaaggaggcatggacaaatattgtttctcgactaaatcaaaggtttgatcaatcatttactctcaaccaagtcaaacaaaaggagcaggatctgaagagagactatcgaaatgttaaagaattgttggatcaaagtggctttggatgggataaggacagaaaaatggttgatgcaccagataatgtttgggcaagctttgccgctcgtaagaacagcaaggatgtcctgcaatggaaagaaaggtcattccccctttatgaagaattagctccactctatgaaggtcgttatgctgaagggagaactcgtcgaggcttggaccattatctaaggaagaggaagcatgcaccagttccctcatcacaatcgacacaagtgacgggatctgtatcaatcaccatcacctaccatgccagctgccgggtgaagtcagataatgcaggtttacatttagatgaaaaacttggacgagttcaattttgggattctcccccggcacctatctacaccctattcagcatgtggcaagcccccggccaagatctacaccaaatggaagaaacatgacacttaggctgggg

SEQ ID NO: 56961 - DNA, 618 bp, Triticum aestivum
  unsure (1)..(618): unsure at all n locations
  Clone ID: PAT_TA_56961
tgcttgttgtgcgaggtttgcagaagggtggtaatcaaggattgttgaggagccttgtgctttgagtacttaacaaatccttaaacaaattttgcaacaacaactgattccatgcatggatgttgtattgcagcaacacaacatagcgcatggaagatcacaagttttgcaacaaggtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccagttctccttccaacagcctctgcaacaatatccgttaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactngagaagaanataactctagtactagatatatgaaacaccgttttctcatccagggtttggtccgtgtaaaccggggaaaaa

SEQ ID NO: 56962 - DNA, 449 bp, Triticum aestivum
  Clone ID: PAT_TA_56962
caacaacaacaacaaattcttcaacatattttgcaacaacaactgattccatgcatggatgttgacttgcaacaacacaacatacgcgcatgcaacgctcacaagtctttgcaacaaagtacttaccagctattgcaacaattgtgttgtcaacaactgtagcagatccctgaccagtcgaggtgccaagccatccataatgttgctcatgctattattatgcatcaacaacaacaacaacaacaagaacaaaatcaacagttgcaacatcaacaacatcaacatacatgcaactgctacaactacatcaacatctacaacaacaaccgtcgagccaggtctacttgcaacagcctcagcagcaatatccatcaagccaggtgctacttcccagcccatcttaaacttaaacccccacaagggctttaaagggggggtttttttttttt

SEQ ID NO: 56963 - DNA, 741 bp, Triticum aestivum
  Clone ID: PAT_TA_56963
ggcgcttgaggcacccacccccaacagcagcaacaccagctactagcactccaccctgaacaccttcacttggctctgggctcctctcctggcagcgcacaccaggatgacctcagctcagaggtggagaatctttcacttgccctggcgtgccctgacactgatgtgcacgagccattgcgacgacagctaaaaccaccactacagccacctatttgtcagttcgaccccaactatgtccctactaacaagtgattggtcgcatacgtcataccatccgatttgagtgcacgcgaacgaatccactccatattgtgattatggcaccatcgcagatgtgctagaccacatgacaagccagccacttcatatgcaggcagacgacaccctggcctatactcagcatgcatcacactcattgatcacagcaacaacataccggtgttacctgaccatgctcctcctgtcacactcaggctgcaacaccaacaggtgtggcagcaacaaattcctgttgttcaaccatccattttgcagcagctaaacccatgcgagctattcctccagcagcagggcagccctgtggcaatgccacaacgtcttgctaggacgcaaatgttgcagcagagcagttgccatgtgatgcagcaacaatgttgccagcacctgccggaaatcccccagcaatcccgctatgatgcaatccgggctatcatctactccatcatcctgcagaacaac

SEQ ID NO: 56964 - DNA, 205 bp, Triticum aestivum
  Clone ID: PAT_TA_56964
tagatagatgatagcacggattggctcatggcgggattgctcggggtatttgccgcaacctgctgagcaactattgtttgtgtgcatcacacggcatatgctctgctgcaaggcatctctccaccatcctttcattcctgtgtaagtgcagcgcaggattgattccgcccaaaattttatgggggggggggagcctaattttttt

SEQ ID NO: 56965 - DNA, 456 bp, Triticum aestivum
  Clone ID: PAT_TA_56965
gtgagagcatactcaaatggggcaatcccagccaaaacacactcaggcatagcaacctcaaatgatgtggcctcactcacaacactctcacggagaccaccctgaataagggctggtaggccaaactcaagaacaacaactctcaggcatgagccatattcggtatgccaacctcatgcagggcagtctgatgacatcacaatcaatctcatggtggttgaaatgcgttaaaggacaactattgtgatcatacactaagtgtgaacatcgacagactgcccacgcactctgtcatatacaacccctgtgccatgacgataacaccgactgaactcgccaacacgttcctcatgctatatcatcgtgcacactattgctacaagagtacatcactaccataccaccattatttcaccattatgaaacattaatgaccatagtggagaagaacatgat

SEQ ID NO: 56966 - DNA, 409 bp, Triticum aestivum
  Clone ID: PAT_TA_56966
gcaacacacggtacatgacggactgttgaacggataccgaagcgtttcgacatgcttccgtcacccatgatgggaatgacggccgatgatgatggccatccacacactctgttgccagaaatgggaggtaccgtagtttggacacgatgcgacagcatcctggcgataggtctagagataatttgccttcgggcaggatcagggcggcctaatccgtgcattgatcttgaggagaccagcctaaggagaacatattggcgactgcagctctttgcgaggagaggcgcatcctggaggaaggacgacgaatcatgatgctgcctgttgctactagtcgcatggtgctgcatcgcgacctgagctatgggctatcgatgttgactggatcatgaacagatggctggctcag

SEQ ID NO: 56967 - DNA, 592 bp, Triticum aestivum
  Clone ID: PAT_TA_56967
gcgcgttgctagtgaaaagacaaagcattcctttaccttaatagagtagtatgttccttccgtcgtttacccgtgctggtgtgaatcgctctattttgcctgtcatagcactgctcacaactcacactgtagttactgtccgtgaggaccatcgcaacgctttgttgtaagtaacagctggattcccgttgacgtcccatctctgatcactgtgtcatgctgaccgaaagcccgcggaggggcattcccggaccgtttcgacgggcggctcgcgacgacccgctctgaccgggggagtcgattctagcattctcgtaagacaggctgaccgctgtcgaagacgtgacccccgagcccagtgctcagagccagtgcttttaccaaaagtacggatacgtaatgcacgactttcttctctgagatgacgctcccgtagctccttataagccttgaagagctttctgcccctgattacagcgcctttttccttaagaagctcatcacggcttgctatggacagggaagaacagggcttacggagacggcatctggcacttctttcttcactcagctgtggaactattttccgcag

SEQ ID NO: 56968 - DNA, 430 bp, Triticum aestivum
  Clone ID: PAT_TA_56968
gacaagggcatgaagcataagaggcacttcgactccaccctcggtagcgcgaacctgcgagaggtggcccgcctgtctgataggagaggatctcaacgagtggctcgatgtcaacactgtccacttctgtaaccacgggagcctcctgcacggcaccctcatggaattctgcacgcccgctacctgccccaccatgataaacggctgaaagaatgactgcaggcgtgctggggtggtgcagatgcaacaggcctattgaagggatggcaccatagcacgtttagtacctggtggactggatcggaggccaccttgatgaagaaagcatcttgcctcaaaagcttggggctcccttgcctccaaacatccagggacgtcggcaatgccattattctagcgtcatgttcaagcgagtacgcccacatatgcc

SEQ ID NO: 56969 - DNA, 429 bp, Triticum aestivum
  Clone ID: PAT_TA_56969
ggccgggcttccggctcggcggtacggtgatccaatgcagggtgtacctagagtcctagactgccgagggcggcggaggaattatagattcaaatgatatgaaacaatatagtcaaaaataaactgtacatttgggaaacaaaaggaggctgtgtaaaggcgatcaaagatgatcagtatgccagagagataaaccctcagaatcgaagttgctacttgataataagagtagaaagaaagctatttatctttttgattttagttgtggcttgtgtacaagggagtgttcttgattgtagcgttgtacaaaggttcagagaggcgtgttctaacattgtcaaagagttactaatactactaccgctttcctagttttgggtaatttatctgttgatagttggatcaagttgtgctgatatatacagttat

SEQ ID NO: 56970 - DNA, 704 bp, Triticum aestivum
  unsure (1)..(704): unsure at all n locations
  Clone ID: PAT_TA_56970
cacaacaaccatatctgcagctgcagccatttccgcagccgcaactaccatatccgcagccgcatctaccatatccgcagccgcaaccattttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaacaacaacaaccgttgagccaggtctccttccaacagcctcaacaacaatatccatcaggccagggctccttccagccatctcagcaaaacccacaggcccaggngctctgtccagcctcaacaactgccccagtttgaggaaataaggaacctagcgctagagacgctacctgcaatgtgcaatgtctatatccctccatattgcaccattgctccagttggcttctttcgtactaactgagaagagaagaactctagtagtagacatatga

SEQ ID NO: 56971 - DNA, 212 bp, Triticum aestivum
  Clone ID: PAT_TA_56971
cccgagcgacaagtccatttttttgaaaaaaataaaaatatcccgtagagagcctcttggacgacatatttggcgccccgggccaccgcagccgacaagcaagaggacagacggaggagcaaactatcaccggggggggggggggctgatgttagtatgagaacttctcctgagaggccagagacctagaggggccatcctatagagatatt

SEQ ID NO: 56972 - DNA, 680 bp, Triticum aestivum
  unsure (1)..(680): unsure at all n locations
  Clone ID: PAT_TA_56972
cggaaagtgtcgctttctgagaatcgaccttgtctgcctccctaatctggagaagttggtttgcgatacttgggtatctcagtgtgccccgttgacctttggttttgtcccttctcttggggaattagaactctcatgtggttcagattgtgagcaacgcggatttaaattaagtgagcttctacatggagtaacaagcatacatagtctcacattggatttccaaggagaaaccctttggttgcatcctgaaatggaggatctccgcaccgcattcagcaagctaaggaagctgtctgtacttggtatctttgttgaatttgacattttatggacaacggcctttcttgtagcagcaccatctattgaaatgttacatatntgaggtatgnggaacatacatgcgatgtggggtgaggccagacctgcttccttccatgacagaaggagccctcagtgggaaatgcacttggatagcagctccgagaacaagcttctgaaagagctagaatttgcntggatttaaatcgctagaacaacagtttacatttataagatccatgtttgggatcatttttgatcaaagaaagaaactgaatactgannaagatntttntcgggtgaaaatattttgatgctaccaaactttgtccaaagatttagaaacttgactgcaattg

SEQ ID NO: 56973 - DNA, 582 bp, Triticum aestivum
  unsure (1)..(582): unsure at all n locations
  Clone ID: PAT_TA_56973
gcgaagggaggcatgggcctgctcgcggccagactacggccgccaataccggcgagaaggacaaggggaagaaggcccccatctcccgctcgtccctgcgcggtgctgcagttccctgtgggccgcatccatcgccatctgaagcacaggactcacgccaatggccgcgtcggcgctactgctgggggtctacatctgcctgcctatcactcggacgtacactcgaccagactgacggtctctcggacgaccgagctggataacgccaccnaaggtatgtcacggcaaacgcgatatcactcgctcgtatgctgcatctggacatcccagcataccacgtgctcgctaacctgatctgcggcaccatagttagcggctgttgcatcacttgcgttgacaacaactggtgcagatccctgagcaggcagagtgccaagccatccataatgatgctcatgctattattatgcatcatcatctacaacaactgcaagatcaaaaacaacaggtgcaacaacaacaacaacaacagcaggcactgcaacaacaacaaccacaacaacaacaacaaccgtcgagcca

SEQ ID NO: 56974 - DNA, 231 bp, Triticum aestivum
  unsure (1)..(231): unsure at all n locations
  Clone ID: PAT_TA_56974
caaccatttccacacaacagccatatccgncagccgcaaccatttccatcacaacaacnncattgnnnccgcaacnnncgcaacncattntgttctttggggcccncccccanaccccnanaananaacccctctttttaaaacaccccccccccaatattttttatatatatnnncccccccccccgcgggggccccccccggagaggagccccacaaaaccccaatttt

SEQ ID NO: 56975 - DNA, 707 bp, Triticum aestivum
  unsure (1)..(707): unsure at all n locations
  Clone ID: PAT_TA_56975
caatggtgaaagaggctgcggaaatctccacggacgaagaatcagatggtgttgttatatgcccaccagatggcaacactcgtgattgcgaggaagttgttagtggcagtgatcatgatagttctccagagggccaagtaacttctgtagaaccggccatagacggagaaacaggggaagacaagcttataaaccaagattcactgaagttgattgatcaagaaatgtctgctcttcctaagtcaccaacaaagcctagtatgtctggatcagagaagtctaagcgtactgttcctcaccttcgcactttcaactcaagaaggtctctggtggaggaagggggggggtggctcatccatccagcantggagaaaaatctggcaaggaagtagtgcctctccagcaagcatgataaagaagagtactctggtgacacccaagaagatgccgcaacctggccttacatttcaacctcaagacgacgactcctgttcagtgacttcttcaaccacagcttcagcacgagctggcagaactaagacaactgttgcctttgctcctactttgtatgtgacgaccgtgctgacaagaggaaagagttctacacgaaattagaagagaagcacaaagctttgggagctgagaagaatgaggctgaaacaaggaaaaaggatgaggcaggaagcggctttaaaacaactaaggga

SEQ ID NO: 56976 - DNA, 287 bp, Triticum aestivum
  Clone ID: PAT_TA_56976
gcaccttaggctggagcgcacccgcagcgagaggcactgtgataagggtatttaccctccagcatacgcaggtgctcatactactggcgatgacttttcaatgcatgacataacatgcggctgcctttggccctagtaatgactacgatgaccgacggctgcacgccctacagacacaaatccgtccgtgaacctgctgcacctatgaggtgctgataacgtacatactcggccttgatcactgctaggcttacgatacaggggtatgtgtgctagctagcacatct

SEQ ID NO: 56977 - DNA, 765 bp, Triticum aestivum
  unsure (1)..(765): unsure at all n locations
  Clone ID: PAT_TA_56977
gtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccatttccaagactggtgagaactacaggcttctttatgacaccaagggtcgcttccgccttcactctgtcagggatgaggatgctaagttcaagctctgcaaggcaagngtctggtccagttcggccagaagggcatcccctacctgaacacctatgatggccgcaccatccgctacccagacccactcatcaaggccaatgacaccatcaagctcgacctggagaccaacaagaantgttgacttcatcaagtttttgacgtcggcaaatgtggtcatggttacctggtgggcgcaacactggggcggngttgggtgggtgatcaagaacagggggagaagccataaggggaaccttcgagaccatccacgttttgaggaatgcgcaggggcccaccagttttgcccaccccgtct

SEQ ID NO: 56978 - DNA, 494 bp, Triticum aestivum
  unsure (1)..(494): unsure at all n locations
  Clone ID: PAT_TA_56978
gatcaatcttgcacacccagttgaaggtcgaccagacgagggtgccaagcatggcgtccaagggtctcattgtggttgctttcctgcttgctgcggctttcctcgtggccacagctgaacaaactcaggccaacaaggaagagacccaacccggtgttcagggcggctaccctggacacaacggaggcggtggcggcggttatcctggacacggaggaggcggtgctgcttcaaatccttaaaatccaacacctgcagctatcctttatcgcatatactagccgccaccgccaaagctgctgcttcaaatccttaaaatccaacacctgcagctatcctttatcgcatatacgtagtatgtttgcttgtttctacgtacggtaccttgtggttaataatgggagggtggccnctgctgtgcatggttgccccgttcgtgtatatttcctaggtgatgtttgccccgtttgggtagtaataaattcactgcctgc

SEQ ID NO: 56979 - DNA, 623 bp, Triticum aestivum
  unsure (1)..(623): unsure at all n locations
  Clone ID: PAT_TA_56979
gcacatcgaggaagaggccagtggaagtggaccactccgacgtggggggctacggtagcaggaccgccaagaagatcactgcagagaagcatgcattacttcacaaagtggccaacaaccggatcaatggaacagaaggcaatctcggtggttcaaagatggagagtgatgctataacctagaggtgttggtagttgcacaacgagttgaatcatgagaagtcgaactcaccaattcgagttactacgaaatatttacgtagttatgatgactcactattcatcttctggcaataggacaatagnagatgtcatcaagggaaatgatgtcattggtgagggtaagaaagaccacatatgggtgccgtatggnnccgcgggttgtgcgatggccgatctcgaacgtgatcacattgcaatganccactagaccactgatggtttgtacatcgatgggttgtgcatgagtcgacatggttattaggggattctaactgatgggtgccagtttcggcctaacgctacgcacctcaatcaatgtggttgaagctttagaaactaaagccaattctgttggncgaaagttcacaatctgggcgatgattgcctactaataggcggata

SEQ ID NO: 56980 - DNA, 661 bp, Triticum aestivum
  Clone ID: PAT_TA_56980
caacaaccacattttacagcaacaccactatttacgtagcaacaacatccagctataccgtatcgaccatacattttggcagaaacaactaccaacattttgagcagcacaaccaccgttttcgcaacaacaacaaccagtactacagcaacaaccaccagtttccgcaacaacaacaaccaattctaccgcaacaaccaccattttagcaacaacatcaacaaccagttctaccgcaacaacaaataccatttgttcatccatctatcttgcagcagctaaacccatgctaggtattcctccagcagtaatgcacccctgtggcatatgccacaaagtcttgataggtcgcaaatgctgcagaacagcagttgccatgtgatgcaacaacaactgctgccagccagttgccgcacatcccccagaactcccgctatgaggcaatacgtgctatcatctactgcatcattctgtcaagaacaacaacaggtgtcggagttccatccaaactgagaaacagcaaccgcagcagctgagccaatgtgatttccaaccccaacagcagtcacagcagctacgtcggcaacatcctcagcaacaacaattggcacagggtaccctgttgtgcatgcacaccagatagctcagcttgaggtgatga

SEQ ID NO: 56981 - DNA, 716 bp, Triticum aestivum
  unsure (1)..(716): unsure at all n locations
  Clone ID: PAT_TA_56981
gttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccngagcagtcgcggtgccaagccatccacaatggtcgttcatgctattattctgcatcatcatcaacaacaacaacaacaaccgtcgagccaggtctcctaccagcagcctcaggaacaatatccatcaggccagggctcctttccagtcatctcagcaaaacccacaggcccaggggctctgtccagcctcaacaactgcccccagttccaggaaataaggaacttagcgctgcagacgctggcaggcatgtggcaatgtctacatccctccatattgctcgaccaccattgcgccatttggcatctttcggtacta

SEQ ID NO: 56982 - DNA, 656 bp, Triticum aestivum
  unsure (1)..(656): unsure at all n locations
  Clone ID: PAT_TA_56982
ctcattaacaacgtgtgtcactagagcggggacgcatcaacaattctttgcgcagtgtgtatcaggaactcggcgtgcgtgagggaaaggaggtgctcccaggttgtcgaaaggaggtgatgaagctcacggcggcgagcgtgtgtggcgcatccagcataaactcaaggaactacaccagcgaaccagacttggctagaataccatggcgtgcaagtccagctgcagcctcctcctcttggccgccgtcctgctctccgtcttggccgctgcttccgcctccggcagctgcgtcccaggggtggcttttcggaccaatcttctgccacactgccgcgactatgtgttacaacaaacttgtggcaccttcacccctgggtcaaagttacccgaatggatgacatctgcgtcgatatactcccctgggaaaccgtacctcgccaagttgtattgctgccaggagctcgcagaaatttctcagcagtgccggtgcgaggcgctgcgctacttcatagcgttgccggtaccgtctcagcctgtggacccgaggtccggcaatgttgggtgagagcgggctcatcgatctgcccggatgccccagggagatgcantgggacttcgtcagattactcggtcgccgggggcagtgcaacttg

SEQ ID NO: 56983 - DNA, 576 bp, Triticum aestivum
  Clone ID: PAT_TA_56983
gtactacccaacttctccgcaacagccaggacaagggcaacaaccaggacaagggcaacaagggcactgcccaacttctccgcagcagacaggacaagcgcaacaaccaggacaaggccaacaaataggacaagtgcaacaaccaggacaagggcaacaagggtactacccaatttctctgcaacagtgaagacaggggcaacagtcaagacaggggcaacaatcaagacagggacaccaactaagacaggggcacgattcaagacaggagcaacataggctacgacaacccataccatgttaacacagagcaatgtacggacagaccaaaggtgggacaggtgcaagaacccgcaacacagctgacgataatgacatctatggatgatggcgacgcattgtcggctagacacagatagaactctctggagcttgcatggtgcttgatatgcatgcaagctatccaatatacatgacgtgcgtgcacagggttttatgtgaatagagtttaatccaattatgatgcaaaatgaaaagcttgtccagctaaaagactacccagctaaaaaagggcgg

SEQ ID NO: 56984 - DNA, 725 bp, Triticum aestivum
  Clone ID: PAT_TA_56984
ttgactgttgcaaagtttacctggtcttctatttatattttccagaatacagtcctagagatgttgctttatttgagttctgcttattgcatttattggagcacttgcaatgggcacattgaatgtttaaatgttcctcttgctgctgaccacactacagttcattatatctcattgagaccttaatcatcttccatgtttattggaaggtagcatagtactggttgaacccgatagttacctgaaaccattgcttaacaccgagcccctctactttctaaaaggtttccattttggtttactgaatattttttcctgcttgaactatatcagttgggcaagtgctagaacccaggagcatatgattttgctgctcatgacatacgcgtcaatattgcaatcaactctgactgcaattgtatagacaagggcctgcattctattatggaaggttcgacattgaagctgctcgcattgatctgcaatagatcttgacttcagcggaaaatgaggtttcatggaggcagtgccttattctacatgatgggaattcaacgcatttatgggttttgttcttaaatactactgggtggtgctgtctattcacaaatgaagtaatctgaacatctcttgcagacaaaacgctcgggggaaagttcccagtcgtgcacctgtgaccgctgaaaaggcatactgttctaggaatgcatgacagactggtcgcg

SEQ ID NO: 56985 - DNA, 607 bp, Triticum aestivum
  Clone ID: PAT_TA_56985
taggagctcagcaggagccgcagtaggagctacagccgctctgtttccccaaggagggatgaaaggcgatcaaggagcccccgtgacagtcgcagcccaaggaggagcccccgtgacagtcgcagcccaaggaggagcccccgtgacagtcgcagccccaggaggagcccccgcgacagtcgcagccctatgaagagcccccgtggcagtcgcagccctatgaggagcccccgtgacagccgcagccctaggaggagcgcttcacctgccaaggggagggcccggagccccacccctcctggcagcaggagccctgcaccaagggaaaacagcaggagcccaatgaaggctgacagccctaataacatgagcccagctgcaaatggtcgtagcccgagccccagggacggcgaagacaatggcaaccaccgtgcacccagtggaagtgcatcacccggtggtggttgagagatggatcgaaatccttccggtgttcacccagtttgaagttcacctggtgaggggtcgagagattgattcaaattcttcctactgctacgaaactctctaaacatgttgaacaaagacttgcctgttcgaagtttga

SEQ ID NO: 56986 - DNA, 691 bp, Triticum aestivum
  Clone ID: PAT_TA_56986
gggggtcaccctgccgcagccctcttcggtgcagaaacggcatgcccggacatccattgagaaggaccctggaagaggacgtggagagcagcaacgcgatcatgtcagtccacctctgcccaaagccaaaacctttcgaaacttccaacatgtagctccaatgcacggagtcaaacgctttggcaatatccagcttaagaaaaatgagcggtgagtttcttgtgaaggccctcctaatgacattctggacaaacaggaagttatcttggatgctacgccccttgaggaaagcactttggctagcagaaatcatgtgttgcaactccggagctagcctattggccatgattttgcaaagaatttttgccacactgtgcatgaggctaattggccgaaaatcagatgctcgatcgacattccctttctttggcagcagcactataaaggcattgttcagcagcttccatgtattgcctctcagatgaaaaaactggttgatggcctccagaagatcgttcttgatgagtccccaacattttttgaaagagccccgaatgaaaccatcagggccagggggatttctcagcatagtaaggtcgaaaaccgccttctttaattcctctatgggtgaaaatggcatccaggtgctcaagggttgaatgaaggaagctgcagatactcccaattcagc

SEQ ID NO: 56987 - DNA, 623 bp, Triticum aestivum
  unsure (1)..(623): unsure at all n locations
  Clone ID: PAT_TA_56987
gtagtaaataaatgtcttcatacggaattatacatcaaaggtgtgctacagtactagagatatatttattttcccattttttgataaccgtcgcaaaggacggacacatatacaacaagtatattatttcacctgttgagcactcataattgaacccatacaacaagtatttgtagttctttcttacaagttgaatatttgcatagtgattttgtattaactatagattcccctcagctactggaaggtcctaattgcaattctgagcactcctgattgtacccatacaacaattcttatagttctttcataacagttgagtattttcatatagattctgtactaatagagattgccatcagccagtgaaatgtccatttttttggatcacctcaattttgcaactctgatctatctgtaatatttcttcgagttatcaagattgtatccatgacatggggaatacttcgttgaattaaatctgagtctacacgtgatatctttaatctctgtttatcccatttgttgagcagtgatattattttttaatgctgcttgntgagcaattccatcgaagacccgtgttcactgaacattgtattcatatgcttccatgtattaaa

SEQ ID NO: 56988 - DNA, 286 bp, Triticum aestivum
  Clone ID: PAT_TA_56988
acttctccgagttgagctgcctgctcctgcctcagctgcattagcaatctggtttccttggctctgctgcttgaagtataatactcagtttatccatgttatcttgttattgcttgcttgtgaacttcatatattgctatattatatcctggttttaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaagaaaaaatgaaagggcccccct

SEQ ID NO: 56989 - DNA, 104 bp, Triticum aestivum
  Clone ID: PAT_TA_56989
gatgatctaagcagcgggtgctctttcatatgctctgtaatacaataagcacggctgtgtacatatatccaataaataagaacgaacggcgcttcttcctcctc

SEQ ID NO: 56990 - DNA, 163 bp, Triticum aestivum
  Clone ID: PAT_TA_56990
cgccttctacgtgtctacacgatcgagtgtgtgtgtgtgttcgtgcgtgtacgtgcgtgtgagatgattctactgtatgactagctgctcgggttcgtccgatcgatcggtttatgaccgatttgtgaataagaataggcccgggccgattcggttgtccaat

SEQ ID NO: 56991 - DNA, 361 bp, Triticum aestivum
  unsure (1)..(361): unsure at all n locations
  Clone ID: PAT_TA_56991
gccctaactaaacccaccccacccccctcccccgcggcggcggcggcgcagctggccgacggcggagggctatggggaggttcccgccgaggactcgcctacccggccctgcgcgctgncgtgatgtcgggcacggaagacaccccgacggccgcatnagcaaggggctggcggagtgccgggagcgccaaggcggaggcgcccgacgagatcgacaaggccccggaggagaaagccagaggaatcaccatctcaacggctcatgtcgagtgtgagaccgctaagaggcactatgctcatgtggactgtgcaggccacgccgattacgtcaagaacatgatcaccggggctgcgcaaatgg

SEQ ID NO: 56992 - DNA, 338 bp, Triticum aestivum
  unsure (1)..(338): unsure at all n locations
  Clone ID: PAT_TA_56992
ttattttctatgttcaagtttgcacttggatcataaaaaaaaaaaaaaaaaaaaaaaaaaaaaaaaaaaaaaaaaaaaaaaaaaaaaaaaatataaaaaaaaagaaaataaattaaaaaggcctcccatttaatggctcccctcttctgtcccctacctttgcttcactgtccgctcctttncttcccccgggggggctttaccctgcccttgcctcccccatccggggtggggcccatccctttctcttcccatntctttcccttttctccccccgcccctttcccccttgccttctctccggtagccccccctnccttcgcccctccccccttttt

SEQ ID NO: 56993 - DNA, 542 bp, Triticum aestivum
  Clone ID: PAT_TA_56993
aaaaaaataaaaaaaaaaaaaaaaaaaaaaaaaaaaaaaaaaaaaaaaaaaaaaaaaaaaaaaaaaaaaaaaaaaaaaaaaaaaaaaaaaataaaaggagaggagggttttttggataaaaaatttttttacacgggcagggcgccttttttgggggccctttttttgggccccgttatcgtttgattgggcgcggggggggggggggcccgtcttgggggttaccggggggggggccttcctaattacgcgtggtgggaaatccccctttttcccccggttggggtgcggggggggcccccccctttggccctcccccccttttgtgcggcgggctgggcggtgggggcccccccccgcggcgccccctttttagccgccggggggggggcttctttcgcaagggtcccctaccctgggggggggctttttaccggcgcgttacccttttttccggcctttcctttacgggcgggcgggggttctccggggtttccttttttcggggctcccccctttccccccgcgattggctttttggg

SEQ ID NO: 56994 - DNA, 549 bp, Triticum aestivum
  unsure (1)..(549): unsure at all n locations
  Clone ID: PAT_TA_56994
gcagcggcggccatgacaagcagcattggcatgcggcccgtgtcgctgtcggcggcgtcgtcgtcttcgatggaggagctccagagcgccatcgagggcgctatcgcgcactgcaagaacacaatgggcggcgtcgtgtccctgtgcccgcgcaaggtgccggcggcgacggcggccggcgagatcagcgcgttctgagcgcgccggtgcatgcatgcatgcactatgattcgtgcggggagctaagtaaggctgattaatcagtggtatccatccatgtgttaatttttgttcgtttgattagctttgtgtcctttgggcaagactttaagatgatgttggtaaataagggtagttcgaaggggtgaaatgagactctaatccttcctttggacgtctcttctcccgtagtgtgaaatttgcatcggcggcctccaaatattgcgtctaaaatccgaatacgtcaaacccatctaagaagcgtaaaagttgcaggaaatgttataagataggttgggtgtnttttcagtgaatttgcccttgagagtc

SEQ ID NO: 56995 - DNA, 270 bp, Triticum aestivum
  Clone ID: PAT_TA_56995
cgccatttcgcctctcgtcttcgcatcgcgcgccccgcacgcacgccgcctcctacctcctcccccccacgcccgtccagcgcggcgcatccgcgccgggcccgggcttgctccgtgcggcgagatctcggccggggtttaccagcgcgtgccgtcgtacagttggaggaggcggtgggggtggttggcgggcggcggctggcggagtactaaagatgcccgctcggctcgcccttaccatcaggtggagcgaccgtgctggcgatatgc

SEQ ID NO: 56996 - DNA, 527 bp, Triticum aestivum
  Clone ID: PAT_TA_56996
tagagtctaacaaggctgagaagaaggtgcaagatttgaactcgaagcttgagtcacttcaaaaggcaagtggcgagcaaaagcgtatgatccataaaacggagcgtgctcttaaagttgctgaggtttgcaatatgctttctaactgttactgcactgccctatgttggttctgtggtttatctatgttccatatctgttctttctcatctccaggaggaattgatgaggctgcaattagaagcaacaacgaaggcaaaacagctgacagaggtaatcatatgtcccatcattgcagcttgttgtaacatttttaaccaaaatgataatttctgctgatctacgaagttattgctttgtggcaattcggtcgttttattgtcagttctcaacaaggagaactttcagcatatcttaacttgcacattatctacatgccttgagaatgcaccttggcatctatttgttgtggtatttcatcggtgtggtggaatttctgaggctaacttgtagttacaattcttcta

SEQ ID NO: 56997 - DNA, 478 bp, Triticum aestivum
  Clone ID: PAT_TA_56997
gaataatgtggcggagtgccaaggcggagtgagtgatgtgatgatcctgggatgatgattatcggcggatgatggatgatgattattgtggcggatgccattgcggacgatgatacgatccgagggatgattatgatcggagggggatgatatatgatgatgattgatgccgtggcgggatatgatgatacgacccgtgggattatgatgattgcgactggggatgctcctccatgtaccgcgcggccacgacgaacctgattattcgctacctccgtggtcgcatgggcgccgtgttccatatcgcctgatcaagatctgttccaatcaccttgcacgctctatgctctaccctttccccgcgtaccgctgttcgactaatggtggcgatcctatttgtgtggctctgttcagtctactgtagtctgtgctcgtatttttgttgggtccgtcctttcctctttgcctctgtgtcttc

SEQ ID NO: 56998 - DNA, 640 bp, Triticum aestivum
  unsure (1)..(640): unsure at all n locations
  Clone ID: PAT_TA_56998
cccacgcgtccgcgccccgccgacgcctcctccctctcgtatctcgatatgggcggcagcgttgatatcgtcagccgcggaggacggaagcgatctccccttccctccagagcgcgctccccaccaccgcgagctcgccgcggccgctgcctctgtcgagcgcgcctgccgcctctgcgtagacgtgaagagatcacttctttcaggtggaaggaagattcttgaaaagaatgaccaaagtcctgtgacaattgcagattttggagttcaggcccttatcagcttcgagctccagcaactgtttccatcaatacctctggtggcagaagaggactcaacatttctgaagtcatctaatcctgatgataacagtggtaatgtactcattgagtcaatttcaagtgctgtcacagacaaagtgaaaaatagtggttcacctttaactcatgatgatgtgttgagagctattgatagaggaggcaaggatgctgtctcctttgattcaaatcctgctacttattgggtacttgatccaattgatggcactaaaggtttcttgaaaggagatgatgctctgtatgtgggtcgggtttggctcttgtggtgaacggaaaggtagcagtaggagtgtggnggatgt

SEQ ID NO: 56999 - DNA, 621 bp, Triticum aestivum
  unsure (1)..(621): unsure at all n locations
  Clone ID: PAT_TA_56999
ctccgcagtctgaaaagtacagtagacacatcttcttaccatggacactctgggacactatcaccagtagataatctcccatatgtttctccactagatggcagccctgctacgccactctctccagccaatagcagcgattctagctatggtgatgtttccatggctcatcctgttatgctagagcaattctttgtgtttcgcaggtccgttccacgtggacagaatttctatcagccctctactgaagaaggagatgccctggttcctgttcagggagcagggtttctcataggaaatgagcacaatggtgaaaatgaagtagtgaacgtgcccgttcttgtcgcagccagtcctatctatgttggcagttctgatgatgacgaagcagacaatgaagcaggtgatgaagcaggcatggaagccgaagatgaaatcattcaagcagacccagaaccacgtgaagtcattgtcatctcttcggacgaggacgagtccgaagatgagtgataacatggtttcaacaagcaatacgtcttcaggccggcaagcatgtagacttctaccactagnntttctgtttctatgtttacgttaatctgtctacgttttttttttcct

SEQ ID NO: 57000 - DNA, 102 bp, Triticum aestivum
  Clone ID: PAT_TA_57000
cctctctctcgaatgactgtttcaatctactgtaagtatttgttcactcaatcgtctactgtatctgctattcccaatgcaatattagctgttctagagctt

SEQ ID NO: 57001 - DNA, 767 bp, Triticum aestivum
  Clone ID: PAT_TA_57001
ggttcctcctgcgttcgccaccatgcgatcggcttcctccctcaggttcttgtacggaatataccaccagatcctgatgaatcagttagcaagcttgtggaacatttcttccttgtcaatcatcctgatcattatctgaaacatcaggtaatcactaaattttggaacatctcccatttgaagaatcatctgcaaattcaaatgtaaggaagtgtgcagtgcaagcaattatcaggtgttggctgcccaggaagaaggaaaggtcagtccagacatgacatttaactctaataatggaggtatgtagtgcctactgctcccttgtcccttgctaccgtctggggatgctcggctcgcagtccctgctctcattttcctccagcctctggtaaccctcctcctcacccgcctcgccgaagcgggattcacagggagcatcaggtacaacttatgtgggggatgaaccatcagctaaagggagtgataggaaaatattttgttgaatgcaatgggaaggcgaaaaacgacacgccttggcgaagcaactctaagattcggtaaggctaatcaagtctgcaatcaaatccaagagcaggggcagagaaaaccggtaaaatactttttagctattgattgaagtgactggtattcagtagcaggagcaacaggtgtggtaagaacctacctaggcatatttttctctctttcctatcacatgggacattgaataactttatagtgcaaatcccttcacatatggctttttt

SEQ ID NO: 57002 - DNA, 174 bp, Triticum aestivum
  Clone ID: PAT_TA_57002
gcatgcatgcatgattgtacatgtgattgtgacgggaataaatagctagcacggtactgcgtactatagtacgagcgtgtagcatatgatatgataggagatacgatgccttgagctcgtgacgcggctactgcatgattgcatgcactgcacgtgatgtcttctatgcactgt

SEQ ID NO: 57003 - DNA, 729 bp, Triticum aestivum
  Clone ID: PAT_TA_57003
ctagtttttaaaaaagaaatgtaacaaatgtccaaatgataaacgagcatggaaacctcaaggttcagaacactttgcagattggtaatgcgataaaagagcatggaaacctcaaggttcagaatgaacgtcttctgacagacctaatccggacatacgtagttctctgtacctaaatatgaattgaatgaaccaggaaaggaatctaccgaccttgataggtgttgggcatagcagtgcaggatattaccttttattctcaagctcacaaatcgcagcattgaaaaattgcaaacaatagaacagagaacatcaacaaatcttgtgctttaccatttcaggtacacccaaactgaaattgtgtgaacttttctcttgagaaaaggtaaaaagcattttgtgtggatgcatttcaggtacacgcttccacccggccctctcctcgcgcctgcgccctttggtagccatggatctcaaatggatgcatgcagcagccgacatccacgcgtcgccctggccaaagctcgctgtgtcggcttctgcgcgctgccccaaccaccagttgaagctctgccttggacaacgcacatcgcgcatcgccccagtctcctgtcggctgctgatgcacgtcgctgctggtcttcatgatgcgtccctgaacttgctccggcttcaagacctccacagcgctgccgaagctctgccttgggagtattttgggggagggat

SEQ ID NO: 57004 - DNA, 675 bp, Triticum aestivum
  unsure (1)..(675): unsure at all n locations
  Clone ID: PAT_TA_57004
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaaggccccagttttacgccccgggggggggaaggaaaaattttttttttggggcccccaaatttattttccgggcccgggttttaccccggggggggggggaaaaccccgggggtcccccatttaatccccttgggaaaaaacccccttttccccggtggggtttttacaaaaaggccccccccggtgcccctttcccaattttgcccccccctgttgggaaatgggccccccccctttgggggccttttacccccgggggggggggggttcccccccngggggccccttcctttggcgggccccttagccccccccctttgggttttttccctttcttttttgcccgctttggcggttttcccccgtaatcctttttttgggggcccccttttgggccccntttttgggttttcggccccccggccccataaatccttttttgcgggattggttcccctttgggggcccctcccccttaaaaacggttttttcccccctttgggggg

SEQ ID NO: 57005 - DNA, 331 bp, Triticum aestivum
  unsure (1)..(331): unsure at all n locations
  Clone ID: PAT_TA_57005
cggacgcgtgggttcttttccggtgattgcttcttcgggttggttccagtaacgtcatgttgtgaggattcgttcgactacgtccgtttgtcttcttcatggactcgattcctcttccttccgggatttcagccttgcaggtgccgatgagtccgtgcagatgatgcaaccaagctcaaggaggagctcgatgaagatcttgtcctttatgttgcttcgttctatttgatcaatagaggagcccagctggggtcgatcggggaccttgtcgcattcggggctcttcttttattttggttccatagtcngaccttgatagtatttgggtgtt

SEQ ID NO: 57006 - DNA, 499 bp, Triticum aestivum
  unsure (1)..(499): unsure at all n locations
  Clone ID: PAT_TA_57006
cccacgcgtccggccgctactcccctgcctcccccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcatcctgcttttgacatgaagcagtttatctctcacatgatgcgcntcntcnagatcctctctgccntgcttngtggggatgacctagatgttttnctgatgattgttgtgtctgcctcgntgtctcttcttagcgcgctcnngggccttctgttctttgttggcgggcgcctgc

SEQ ID NO: 57007 - DNA, 541 bp, Triticum aestivum
  Clone ID: PAT_TA_57007
gtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcatcatcaccgtcaacgaggcccagtcccgccgctccggcggaggcggcggcggcttcggcggcggcggcggcggcggcggctacggcggccagcgtcgtgaaggaggaggcggcggcggctacggcggcggcggcggtggctacggaggtggccgcagcggcggcggcggtggcctcggctgcccgggaccctctgatctgggacgccgagttcgtcttggtcgaccaggccaccctcttcgacctcttcctggctgccatctacctgaacttctaggggctgctggacctggcct

SEQ ID NO: 57008 - DNA, 306 bp, Triticum aestivum
  unsure (1)..(306): unsure at all n locations
  Clone ID: PAT_TA_57008
ctcgctacgaccgatctccgtcggaggcacacttatcccacagcccatcgccagctgggccatgctttcacgttgacgccatctggctcatcatcactcagctcattggcctaccatgcatggcactgataggttggtctcgggggccgccaagctttatcggttgcgttgctcggccgacgctcgctctgcagactgcctcgtgtttgcgctgtttcgtctcgtagatgtgcttcccctatttccatcgcttggntgttgnaaggggcccgccccgaccgcccttcccaccggcccccccccctg

SEQ ID NO: 57009 - DNA, 593 bp, Triticum aestivum
  Clone ID: PAT_TA_57009
ggcatctttgttcatcttgagacattttgttccatatgcggaccgaactatgcgtgcactttcattgttacaaaagactagcacatatgcctattatgcattgtaatggtcgggagaaaaattgatgtttccataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttaaaaaaaacaaatttaaaccaccggggcgggaaagaaaaaatttttttttagggggcccaaaaataaattaccgggggggggttttaaaaaggggggaagggaaaaaacccgggggaaaaaaaataaaatcccttaaaaaaaaaccccctttcccagagggggggaaaaaaaaaaaaggcccaaaaaataccccctccaaaaaagggggcaacccaaaaggggaaagggaaccccccccgaggggggattaaaaccggggggggggggggggtccccccctgggggc

SEQ ID NO: 57010 - DNA, 215 bp, Triticum aestivum
  Clone ID: PAT_TA_57010
gtccgtttgcgcaaaagttctaactgtatactgctgtgggctactggctaggcccgaaaaacatgtctttgttatctgcaagtttatgaggagaaatagccaatggtattctatggtatgcagaatctcatgaatcttgctagaatgtggtttagtctgcttgttgtatgtctgacttgagatgaatctgtagcggcggcaaaaaaaaaaaagca

SEQ ID NO: 57011 - DNA, 327 bp, Triticum aestivum
  Clone ID: PAT_TA_57011
gccttcggcaggcccgcgagggaggtgcaggaggtgttccgcgccaaggatatcaggacgagggcttcgtcgccggacccgatcatcatcatgagcatgatcgcggggaccgccgccgtggtgaccgcgggcgcggcgacgaagccgtggaggcgttcctgaggatggcaaccgccgcgctctgaggcggcaaggccgctgttgttaagtgaatgtgtgagctcagtacgatgatgtaagttgcgtacctaccttctaccaaggcatgcatgcccatcatatatattcacaagggcgttgcgcctcatatttttttctttttaattt

SEQ ID NO: 57012 - DNA, 150 bp, Triticum aestivum
  Clone ID: PAT_TA_57012
gagtgtgtagttagtaagtacgcgggaggagtataaataatgaggggctcggcctcaccagcacgaagatgtgagtgcgcctacctacacttacaccaacgcatgcatgcgcaacatatttaagacacaagggcattgcgcctctttttc

SEQ ID NO: 57013 - DNA, 401 bp, Triticum aestivum
  unsure (1)..(401): unsure at all n locations
  Clone ID: PAT_TA_57013
gggcgtccaggagctggtgctcgtcaaccggccgtggccgttcgacgtgcccctcccggacacgctcttcggcatcagcacgctcgtccgcctctacatcggcctctggaagctcccggacacagccggcctgcgcggcgcctccttcccccacctccgggagctcggcatctgcaccgtggtgatggagcagggggacgtcgactccatcgtcgcccgctgccccgtcctggagatcctcatcatccagggatgccacntggggctccgcctacgcctcgtcagccagagcctgcgctgcgtgcnngtctgccgctctgttgtggtgagcctcntggtggcgctggctccgtgcctcgggcgggtcgggctggcggggtgccggcgcccgggtgctggcc

SEQ ID NO: 57014 - DNA, 492 bp, Triticum aestivum
  Clone ID: PAT_TA_57014
tgacacaccaaaaatcttattagaaatgttgcttgcacatttgatgaagaggaggtcattaaagagattacatatctttctcaattacatgacagtagtctaatagccaaggacacacctcagattgatctgtgagttctctaatggcatggatgatttgctatgccatattgtcaagcatttgaaataataataaaatgtgtaagataaataaggcatgcctaaaattaaattgaaacgagctaggacaggccactcatttataggaaacaatactgttgcacatagtgcataaaatgtattttatgcctgatcaactatgttttagtgtacaatgaatttgttgttagtgcacataaatcgaccataaaaaacatgtcgaagtatgacaacaccatttaatataatttaattatacctgatcaactatgtagtaggagtcacataaaactattttttgcgagaaaactttcgatctatttctcaactgtt

SEQ ID NO: 57015 - DNA, 533 bp, Triticum aestivum
  Clone ID: PAT_TA_57015
accccttcttcccttacctgagacacttctccccaaagcgaaccaacccagctgaaaagaagcgagacgcgccgcaccgcgttgcctttgtatcgtgcctctatttatctcaagaggagaggataggagaggagaggagaggcgcgcgggaaggggaaggagatcaaatcttatgaaaccatcggttgatcgagcagcggcggcgacgcataagcagcaggaagcaggaggggagggggatggcggtggcgtatcgcgcggaggaggagtacgactacctgttcaaggtggtgctgatcggggacagcggcgtgggcaagtccaacctgctgtcgcgcttcgccagggacgagttctgcctcgacaccaggtccaccatcggcgtcgagttcgccaccaagaccgtccgcgtcgacggcttgctcgtcaaggcgcatatctgggactccgccggccctgattggttccgggccttcacctgcgcctacttccggggcgccgtgggcgcgctcgtggtggtcgttgtgtcgcgc

SEQ ID NO: 57016 - DNA, 340 bp, Triticum aestivum
  Clone ID: PAT_TA_57016
cccacgcgtccgcccacgcgtccggcggttcgccgcccccgacgtcgcgagaagtccattgaaccttatcatttataggagagggaagtcgcagctgccgaggacggcgaggagcagggctaataaactattttgagtcggttgttgtagcttttatttagtacttgctgctaggttgtgtgttatcttctcttggccagcaagagataggtacttgtgtaaccaaggttcttcgtatttgattcgtttcagtgctagtttatgttcatggtatgctgtttcactcacatgataccttgtgtttgattcgtcttattatgtggtatatgctcggtagttt

SEQ ID NO: 57017 - DNA, 576 bp, Triticum aestivum
  Clone ID: PAT_TA_57017
cttcctaatacttttatcatagtccgtgtgttgtgaagaatgatggatcgtgctgctgcctatatatttcaagtcgttggctcttcggctcttttttttattatttttcttcttcttttacatctttttggttttgtatgtccttgatgtctcgactaggtattaatattgtattattacagaagccgaatgtattggtatcatctttcatatttgtcgaaaaagtgttccaaagataagttactgaaactagacatgcaagtgtacctttttcaaaccttgagccttgtatcaataaccattaatttaccttttaattctacacctgactctttaccaaactagagtttctcgaccttcaagtgttctttaatactaatcatttaagaaatttgatatggtgagaacatatcatgcgcagtctaccactctacctaccctgatttttttcgggttgtgacactttttttagataaacagggttgtgacacttgtcacttgtagttttacagctagcgcgcgcagctctcagcgcgactaaaatcgcagatgctctccacttttacgcctccctcg

SEQ ID NO: 57018 - DNA, 610 bp, Triticum aestivum
  Clone ID: PAT_TA_57018
cccacgcgtgccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggttcaaagtttacttccccgggcttgcaacgttttgggggttttttggggccccctaatttaatttcatgggccggggtttaaaaacggggggaggggaaaaacccgggggttcccaatttaaatggcttggaaaaaaatccccttttggccagtgggggtattagcaaaaaggcccgcaccgttcgcctttccaaaaagtgggccaccctgatggggaaagggaaccccccctgtagggggcctttaagcccgggggggggggggtttccccccagggggaccgttaattttgcaaggcccttaagccccgttcttttggtttttttcctttcttttttggcaaggttggcgggttttcccgggaaagttttaattgggggcccccttttagggtccgaattaagggttttacgggccctcgcccccaaaaatctggtttagggggagggtc

SEQ ID NO: 57019 - DNA, 295 bp, Triticum aestivum
  Clone ID: PAT_TA_57019
catagcttaacgttacagcagtgcaatgcggacgggccgctccttcttggtatccgtggccttcctaactccctgctcacctggccgtcggtctcctccgtcgggcaccgtaaattccctggcgtggcccatcttattcgccttgcggcctgtgcactcccgcggctgccgttttatcgaggaggcccgcaccgcccgttcttcccggtggggcgcagcctgaatgccgttgggacgcgccctgcggcggggcgttctgcccggtgggtgtgggggtcccgccctgcgtggccgc

SEQ ID NO: 57020 - DNA, 544 bp, Triticum aestivum
  unsure (1)..(544): unsure at all n locations
  Clone ID: PAT_TA_57020
cttacatctgaaaggcatcgtttcgttgtaaatcttatgtttatgctaagagctatacttaacactattctgaatgtactaataacaattggaaccaagcaaccttgcaaaagaactttcctgtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaatttaaaaaaaaaaaaaaaaaaaggggggcggtttaaaaggtccaatcttttcgtcccggggctggaaaggctaaaatttttttatggggcccccaatttggattttgggggccggggttttaaccgggggggctgggaaaaaccggggggtccccaattttatttggcttggggcaaaatccccttttcccaagtggggtttttgggaaaagggcccgcccggtgggcctttcccanctttgccccacctggttgggtaatgggaaccccccctgtgccggccctttcgggggggggggggg

SEQ ID NO: 57021 - DNA, 503 bp, Triticum aestivum
  unsure (1)..(503): unsure at all n locations
  Clone ID: PAT_TA_57021
cccttctcatgttcacgcgagggacagccgccgccgccccttccccttccaacttgcgctcgccggccatcctccccgtccgccgccgccgccgccaccgaccagccgcacccgcgctaccatcccctccccgttcctctccgagaagcagcccaagggcagccgcctgccgctcggcacatacgcggatggcggtggccgaagggggaagcggcgctgctttggcgccgctaagcgccaccaccccccgtcccttcgtcccccgccgcccctctgcctcctcccttcccgccacacaccctcccttcccctgcgccgttgcgctgctgctccactgggtacgatttccatggctgtccgggatccatggcctccgacttggcgtcgtagccgtctgcctcggcgttgtgactgtgccctgggttttccctcggggaagtggctcntccgtgcgcgtctcgtggccccgctggttccggtgctcnnctcgctcctctcgtgcg

SEQ ID NO: 57022 - DNA, 607 bp, Triticum aestivum
  Clone ID: PAT_TA_57022
cccacgcgtccgcccacgcgtccgcacggcgcttatgagaaggagaggcaatggtctccaccaaaaaacagacgaggaagaagtgagatgctgctagccccatggcctgctgcatctccaatcggcgcttgcaacaggagaaccacatccctggcctctccatgcccccccaagcgccaacctgtaggctacaacgacaagtgctcgatgtgcagcttattttgtcgacatcgcggtttcagtttgcaatattagacctacttgtatcaaggggaaaattctaatttctttacagcggtgtttgaacaaaatggcatattccgtgggctggatgatagaaggacattttgttgaagcactcaagaggagtaatactattgtgatgccaacacatggtgaatgaactttatattttcgtcttcgccgccggccgtatgctgcatcggcgactggctgcggcagcagatgagcgcatgttgccgccggccatacgctgcatatgttgcggcagcagatgacgcaacgccatcgagggcgcatgacgcggaggcaagcggccagctgtcctgggacggcgccgtgctatatgctctgctgtgttcgtgct

SEQ ID NO: 57023 - DNA, 523 bp, Triticum aestivum
  Clone ID: PAT_TA_57023
actagttctagatcgcgagacggcacgccctttttttttttttttttttatcgggcaagtgaattctgtcttatagcagaagctttaaaaatacaaacaacctggcaaaatacaatttgccaacagtgtatcaatcactcatgtacataacgagcacacacaaaccccagttcagcactcgcaatgtaaaaagtaaaaaaaaaggtatcactcatgtacataacgagcacacacaaagcccagttcagcactcgcagtgtagaaggtaaaaaaaaggcgagttcaccgatcgctggacaaataagtagatgacttttgctaacggtcgtcagctgcatcttatttcttttctccttcccccgatgacaagtttcttctcccagacacgagcacacatcagtttatcaggggacgtgtactggagacggatcagttagtgcgcctcatctactgcaagcggcacgctcttcaccagctcactgcccttcatggttcatttgatagcttggtttatgacccacag

SEQ ID NO: 57024 - DNA, 662 bp, Triticum aestivum
  Clone ID: PAT_TA_57024
gatgtggagaactgaaattaaatggctggagagcttcttctgcaccacgatcatattggcctcctcaccaactgattctgatactaatgggtacttgcgtgtccgatgcattggtggcttgaaccaacaacgtaccgcgatatgtaatgctgttgttgctgcacgaataatgaatgctacactagtgctgccagaattatatacaaactctttctggcgtggcgagaggtatttatgatgttccccacttcatcaagacattaaaatatgatgtccgtattgctacgatcgtcccatatatcattacaaacagaaaagctaagaagctgaaagcctaccagatccggccacctcgagatgcatccgaagatataaatgatccagatatccagatacttcgatgccgggtgaattatcatgcattacgattcaagccaaacatcatgaaaacaagcagtgagatagtgaataagctccgctcataaagccatttcatgtcgattatcttcggtttgagatggatatgcttgcttttgctgggtgcattgatatatttacacctcatgaacagaaaattctgatcaagtaccgcaaggaaaattttgcagaaaaagaacttgtctatagggaaagacggctcattgtggaagtgccctttaact

SEQ ID NO: 57025 - DNA, 556 bp, Triticum aestivum
  Clone ID: PAT_TA_57025
gcgatctataaccggacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaagaataaaatttttaaatattaagggggggcggtttttaggtttcaatttttgttacccggttttgggaaggtgtattttttttttttgggcccttttttttattttcggggggggggttttttaaagggggtggggggaaatcccttggggtcccctttttttttggctttgggggcattccctttttgccctttggggtttttgcgttaaaggcctggacagtgggcctttcccatatggtgcccacttttttgggctattgtttcccccttttttggggggctttacggggggggggggggggtttttccccatgggttgggtttcattttggagggtttttaaagacccgtttttttttttttttccctttctttttgggaaagttttttttgttttcccggttttttttttt

SEQ ID NO: 57026 - DNA, 498 bp, Triticum aestivum
  unsure (1)..(498): unsure at all n locations
  Clone ID: PAT_TA_57026
gtctatctatatgcgtgtggcaatgcactatttaactcacctgctccgatcagtagtgagatcctccatggggaacagatgtctcatggtggtgaccagcatcctcgctgtgatgacgatcgtgttcggaataatcagcgcggttctcttggcgatgaaacatcatcaagatgaccatggcgagttctctacataccggcgatcgccggcgatgcatgcggcgtggtagcagccgttttggcgtccatgacgcatattcttgccagcgtgaccatctgctgctttggggcgaggcggctaactaagggggccaagcgcatcgccgcgatggtcttcttcatcacctcatggnacataaataatggctgtattcgcagctcgatataccacctgctgctctgtcgctaagcaaggaatataccgncattaaaattaatgctatcctatgtggcctggngccctaagtggngaagcggcccgcgcattccataattcatt

SEQ ID NO: 57027 - DNA, 678 bp, Triticum aestivum
  Clone ID: PAT_TA_57027
atcccataccagaaaacatccttcgccccctctgttttcttaaaatttcgaggcggacaattgcaaaaattcagaggagacaacgcgggaagttcaaagaaaattcggacttgtgcagtgatgaaggaggaagcagcagtgccgccgggtccaggactccagcgccccagccgttcattgccaccatcctgggtcgtttaacatgacagcgccaagccgttcgatgcccagctcgggaggtgctcgtcgcagctttccccccacctcccattggatgttcatgctccttctcttgtgtacattcagttcaacatctggtggtttttcagttcaccttaaatgtgcattttcagcttcatcttgcagtgaagaagatatccctatgatacgtttgtcactctgatagcccgaactgaagcatgtcggcaagccgggcctcaaaaggcccttctcccgctactgcctcgatcttgaactgatgttgttgtcatctgtctacctcctcccttggttgatgaagatgttgattttacaaaaggatcagtgaagcattgggcattggacacactatcttcatgagatggtgtactccacgacatacttccattagttgaagatgatgcctgggagcattgactggtcaacactttttttgcggtgcgtgctcttttgatctgt

SEQ ID NO: 57028 - DNA, 390 bp, Triticum aestivum
  unsure (1)..(390): unsure at all n locations
  Clone ID: PAT_TA_57028
ggcggtgctgcctgcggttgcgacggcctgatggctcggtcccgtcccggtcccgccctttttggttctggatctggatctggacgaccggggctcgggcgttgctgccggcaggcgtggtgacgccgggcctccatggctgttgggcacggtggtggtgctggcggttgcgataggggcttagtgtggtggtggtcgtcggcggagcacagacaggaggcgtggagatgaggcggtcttggtggggactgcagcgatatggngaggcggactggaggcggttgcgcgtaccggaagcggcggcgcgaaccaccgtccatgttgatggcggcgctgngagggctcggctaggatgganttcctgccnatcancgngcggccgggccacct

SEQ ID NO: 57029 - DNA, 486 bp, Triticum aestivum
  unsure (1)..(486): unsure at all n locations
  Clone ID: PAT_TA_57029
cccacgcgtccgcctctctctcctccactcgtcgccgccgtccaatctccggcgagattccctcccccgccggcagccatggcttccaccttcagcggcgacgagaccgcccccttcttcggcttcctcggcgccgccgcggccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggtctcatcatcgccgtcatcatctccaccgggatcaaccccaaggccaagccctacttcctcttcgacggctacgcgcacctctcctccggcctcgcctgcggcctcgcggggctcgccgccggcatggncactcgcttcgtcgggnacgccggcgtcggggncnncgcacagtagttttagctgttggggggggtgatcctg

SEQ ID NO: 57030 - DNA, 664 bp, Triticum aestivum
  unsure (1)..(664): unsure at all n locations
  Clone ID: PAT_TA_57030
ctggaggaaaaggaaaccccacctaaacttttagctttccgtatatgtgagattacttgctgagttttcccacatgatagcttttcttatgaattcatgggattttagattttaatcaggtcatgcagttctgagttctaattcatgtgcaagctcccgcctggccgccaaagagccctctgtcttcattgatatgactactagggctgtcagggcaaaagccgcgcgcctcactgcctcggacgtcgcaaaggctctcaaggacgccatccacaacacccagctcgatgtccctgaagccccgtctgcttctgccgcatcccatgcggagattgctgcactgtgcggggctgacgacgatgttgttgcttctgttgctcacgctgatgacagcagcgatgacggcggtgctgacgctctgccatgatgctccaactatcccacgcacgcccaggtggcggcctagtggtgacttgttgtccctaccgcgaatcggccgatcgggtctacttatcccctagcttatgtgcacggggaaaaccttgtgtctgcctcaactaccccttagtctattgctccctagcatttcatatcaggtagtttgctctcggtttaagtgtctgatgtattcctatctgtntgagtaacaccaccctatctatct

SEQ ID NO: 57031 - DNA, 683 bp, Triticum aestivum
  unsure (1)..(683): unsure at all n locations
  Clone ID: PAT_TA_57031
gtaatcataatactatgatactatgtggaagccaaggtaacacattggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaagggaccaaattttactccccgggggtggaaaggaatatttttttttttggggcccccaaatttaatttcgggggcggggttttaaaacggggggggggggaaaacccggggggtccccaattttatccccttgggaaaaaacccccttttccccgggggggttataaaaaaaaggccccccccggacccccttcccaaaaggtgccccccccggatggggaaagggacccccccctttgggggccttttagggggggggggggtgggggtttccccccaggggtcccgtttctttggcaaggccctttggccccgccctttgggttttttcccctttttttcggccccggttgggggttttcccccgnaagcttttaattgggggcccccttttgagggccccttttaagggtttaagggccccttgcccccaaaaaagtgggtttggggggggggggcccccgggggg

SEQ ID NO: 57032 - DNA, 676 bp, Triticum aestivum
  unsure (1)..(676): unsure at all n locations
  Clone ID: PAT_TA_57032
gttcattgcgtggttcctttggcgagacaaatcaaagtgagttggctgcattcacatcatatgcactggcatttccaaactccttcctggccctggtggacacatacgatgtcatgagaagtggagtgccaaacttctgcgctgttgctttagctctcaatgatatggggtataaggcagttggaattaggttagactctggtgatttagcatatctgtctattgagacacgcaagttcttctgtgcaattgaaaaagatttggggttgttggctttggaaaaacgaatattacagcaagcaatgatctcaatgaggaaacaattgatgcattgaacaagcagggtcatgaggtagactcatttggcattggcacctacctagttacctgctatgcacaagcagcactttggttgtgtattcaagttagttgaaattaacaaacagcctcgtattaaactctctgaagatgtcacaaaggtatcgataccatgtaaaaaacgatgctacagattgtatggaaaagaaggttatcctttagttgatataatgaccggacaagacgagccaagcccaaaggttggtgagaggattctgggtcgtcaccctttcatcgagtcaaagagagctcatgttgttccacagcntgtcgaggagttggttgaagtgcttctggc

SEQ ID NO: 57033 - DNA, 440 bp, Triticum aestivum
  unsure (1)..(440): unsure at all n locations
  Clone ID: PAT_TA_57033
cccacgcgtccgaattgataggaggaggaaggccaaagaaggaaagaaaagagtagtagatgaggtcaaccatctgaacaatgtaggtacatcaatacatatctgattgtgaagatgaggacaatgagatactacgacagaccctacagaattcattacatgaagatcatgggagaactagtggtgttagaggaactgtaggcagctcagggggtgtcaaagggagcagctcaggtggtgtcaaagacttctttgatgttgatttggcatatagcaagactaggccgcagcagacaatggaggtgtgtattaacaaggcggactatgaatcatggattgggaaggcttgggccaaatggtttcacgctattggcctccctgggcgtcttgccatttgtccatattttgtaggagccgcgcnnttgcctcgcgaccttggc

SEQ ID NO: 57034 - DNA, 476 bp, Triticum aestivum
  Clone ID: PAT_TA_57034
ggcgccgcctccagcctagggagcacacgacgtgcgggtgcggcgagcactgtgggtccaacccgtgcgcgtgcgggcgcgaggggacgccgtccgggcgggcgaacaggagggccaactgctcctgcggcgcggcctgcaactgcgcttcgtgcggctcgacgaccgcctgatcgatggccgacgcgtcgacgcgccactagtcgtgaactaatgcactagtagtagagctagctactgagttagccataaataagtgccgctgagccgtgatgagtcatatgtgggcgcgtcgtgtgtattacctacccactcgcatcagtgtgtaagaacgaataaatagtttctgtgagttaaaaaaaaaaaaaaaaaaaaaaaaaaaaaaaaaaaaaaaaaaaaaaaaaaaaaaaaggagaaaaattgggggggctgccttataaggtccaagcttaatgaacacgggcatgcgatggtat

SEQ ID NO: 57035 - DNA, 543 bp, Triticum aestivum
  unsure (1)..(543): unsure at all n locations
  Clone ID: PAT_TA_57035
gtctcctccgcccgaatcgaagtccgtcgtctcgaactccgtccggagcccacacccacaacctgacgcccatccccacccacccacacgcgatgcgaatctggcgcgggaggcggccgacgcgagcgcccgcaagcgcaaggcggcggacggcggcgacaccggcgccgcggcaccggcccccgaggacgcggccatgggcgatgcgcccccgccggcccccgcgccgcccgtcgaggggggaggaagcgatggggccgggcctgaccctatctcgcaccggttgagcccggagaccgtgtcggtggagctctccatgggcggggactactaccacgcctgctgcggcgaccccgaccccgaccccaagcccgatggaccccatgtaccgtacatcggtaacaaggtgaggcatctccactcctctctcactctcactctacgtcgctataagtctgtcgcttgttcatcctcgtggtatacttggccggnatcatcacacattcacacttggnggtgccactctggtgcccatttttggcc

SEQ ID NO: 57036 - DNA, 606 bp, Triticum aestivum
  Clone ID: PAT_TA_57036
cccacgcgtccggggagttctagcgaagctttatacaaggagctatggcatgcttgggctaggccgttgatcacagtgcctcaccaaggagcctggggcaattgaagcagaattcgcacggctcggcacggagctggtgctaagaaagtttttcacttatcgaactcctggccctctgtttatccccaagagcggctggggctcaccagatgatgaggtgcccttgccgagctggatcacggaggaggacatcaaatactacgcgagtcagtttgacaagtctggcttcactggggcattgaactactaccgtgccctgaacaagacatgggaactcacgtcgccatggaccggagctgagataaaggtaccaaccaagtttatagttggtgatgtggacttgtcataccatgttgcaggcgcacatgattttattaacaaaggtggcctcaagaaattttgttccattactggacgatgtggtggtaatgaaagatgtcgggcatttcataaatgaagaaaaaccagaagaaattagtgcccatataatcagtttcttaaagaaattcgactgaaatgaggagtaacgaacacatcatggaacat

SEQ ID NO: 57037 - DNA, 371 bp, Triticum aestivum
  unsure (1)..(371): unsure at all n locations
  Clone ID: PAT_TA_57037
gtctgtgaactcgagagaccgagcgaggaaagttgccgtgtgagacctgagagtcagggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtgtaggtgtctgattggatcgatccttgcagccgtgttgctgtccgatttactggatgcggttttccctcgctgattctgtggatttcttgctantcgtcctggcttggagatactctagatttgtgttttttgtttgcttattgtgggttttgtctgttggatcat

SEQ ID NO: 57038 - DNA, 346 bp, Triticum aestivum
  Clone ID: PAT_TA_57038
atttgttctctcctccccagctagggttcacgacgccgccgccgtccgcgctcgtgctctctctcttcatctcccatcccgagctggacctcctccaaccacatctcccctgatcttctcgatcgatttggatctcaggagcgaaccggaggaaggccaggtgcccgttgccgagacaggggcgatgagaagtgggtcgccgccgccgccgccatcccggctcagagcggcgacccaaggaggagctccggactcacaggaggagctcaagcagcggcggtggtccacagcgccgtcatggtcttcctctgctggagcagcgcgagccatagagacgtgctgcccc

SEQ ID NO: 57039 - DNA, 242 bp, Triticum aestivum
  Clone ID: PAT_TA_57039
gtgatcgacctcatgtgcagtactctatgtacatagaaagtaggaataaactgttgtatggccgcaggcacttgttgaaaagtttaatcttggtataagtgcggctgttccgatgcatacaaaaaaaaaaaaaaaaaaaaaaaaaaaaaaaaaaaaaaaaaaaaaaaaaaccaaaaaaaaaaaaaaaaaaaaaaaaacccgctcaaaaaaacaaaagcttacgcccccgaacttgccacgtc

SEQ ID NO: 57040 - DNA, 489 bp, Triticum aestivum
  Clone ID: PAT_TA_57040
acaccattattccatcctttaagtctcacatcataggtcttcgcgctaggcataaatgatccaggaacgaagacctacctggggttatacagtttgaactttgaaacagctcacaagcaaaacccttctatatgtatcgagaacttgagctctctccagaaaacaatcatgcaagctgctcgtatagcatatgtcacagacctcatattctctatggtttctgtgcccctatcaacactggcgttcgacgccgaatacgtaccctggtactggccactaattatggcctgctcctcggggtgcctcaagcagaggctgactcaaattcctcacaggaagttcctctgcacagctccggatgagaaacgggacgacagtccttgtgccgagttctttggatccaaagcctcattttgccgcccggtggtcaagtctttctcacggtcccacggcttccatggggtggttctcctgccagtcttccttccc

SEQ ID NO: 57041 - DNA, 675 bp, Triticum aestivum
  Clone ID: PAT_TA_57041
accaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggttggaaggctgctggcctgcatttcgtctcgccctggacagtgtggcagagctgatgggtacatcct

SEQ ID NO: 57042 - DNA, 548 bp, Triticum aestivum
  Clone ID: PAT_TA_57042
caaacgcctcgtccgttcgttcctttccctccctccaccgcgcgatcgagtcagggcctgctagctctctcgttggttggtgggatgcaggagtcccgggcggaggccgtatcgccggcgccgttgacctgcgcctgtctaaggactacccggcgccgtcggggaccccacatcctcaggcggccacggcggtggcggatgcgcacggtgacctctgcccgcggtgcgagtcgaggcacaccaagttctgctactacaacaactacaacacctgacagtcgtgccactactgcatgtgctgtcgccgttactggaccaagggcaggctccctccgcaacgtgcccgtcgtgagaatgataacgcaagaactgctgctggtcatcgtcatattcgtgcagccccatgcgcgccaagaactgcatacgccgactgggcgcgccgagacggcaccggttgctatgaggccatgcgcgaggtcgacacctcactcgcagcgagccctttggttaggactttattggccgcatgctccatcgtatacgtggcc

SEQ ID NO: 57043 - DNA, 469 bp, Triticum aestivum
  Clone ID: PAT_TA_57043
gttcatgaatccagacatgtccgccacggcgctgagagcccggagggtggcggtcatgctcctggccgtagcgtcctggcggcggcgcatcgccacaggccgtgaactgggaccacataagcggagaccactgcccgggggcaaacagccccaactgtgtgtgatgcctgaaagtaccccttctgaggcagtggggacgcctactgcgtttaaggcagttgccatagacagaacagggctgccgcgaccaccctttggagcaggcgctgcctgtcaagccgaattgtaccacaccttctgcggcgtccttaaccgcggccacgggattaaactcgactggtacaaccgcatgactttgaacagcgctatctccggtgggtttgcgttgcatcgaatactttcgggaactacatagagcgtgggccctggacgaattatctcgggaggtctttttatggttatggatgaa

SEQ ID NO: 57044 - DNA, 502 bp, Triticum aestivum
  unsure (1)..(502): unsure at all n locations
  Clone ID: PAT_TA_57044
aaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggacccaattttcctccccgggcctgggaaggaaaaattttttttttggggcccctaaatttaaatcccggggccgggttttaacacggggggggggggaaaaccctgggggtcccccaatttatggccttggggaaaaacccccttttcccaggggggggaaaaaaaaaaagggcccccccggtccccctttccaaaaatttgncacccttaagggggaaaggggcccccccttttacggccctttaaaccccgggggggggggggtttccccccaggggaccctttactttggccggcccctaacgcccggcttttttggtttttttcctttttttttccc

SEQ ID NO: 57045 - DNA, 470 bp, Triticum aestivum
  Clone ID: PAT_TA_57045
cgttcgtgtagatcctgctggcctactgctgccgccggtcggcgtcttcctccgctacggcatcggcgtggagttctggatatgcctgctgctcaccgtgctgggctacatcccgggcatcatctacgccatcttcgtcctcgtcgcttagtttcagtttcagtaattaaccagttcggactcgtccaaatatatcgatcccaggcatctctgttccagttgctctagctgttcatggatgagctgctggcgcatcggtgcaagcaggatctctgcgccatgaataaccaccatgcatgccggttcagttactagaccagctactactgttgtgctgagcgctatgtactgccgttctgtgcatatgattatgcgtaccacttctccaaattaacctgtatgcacgtatgtaccttgcatttgtcatttgtgctacttcgctctgttgtgtgtgttctccgtgccggctc

SEQ ID NO: 57046 - DNA, 669 bp, Triticum aestivum
  Clone ID: PAT_TA_57046
ccgattcaaccctcgtctccctcccatcccacgccgccgccgccgccgccgcccaccaccccggcgacctccccaccggcgatccccagcctctccctctccttctcccctgcatccgtcgcccgcaccttccctcccagtcccagatcacccactcgctgtcgctggtcacccactcgctggacgctcctaggctcctaggtcacccactcccccacccagcgccgccgcggagagggaattgggcgatggcgatgtcgatgtcggcggccacccgcgcgatgcggcgcatccacgcgcgccgcacctccgcctcctgcctcctccgctccgcccgcccggaccccaacccggcggtgctgcagggccaagcgcccgtgccccgctggtactggggagccgccgcgggcgccgatccgccgtcgacccaagcgcaccttggcgtggccacagtgccgcagcgacaggtgttcgtggtcgagcgattctgccagtaccacaagatcctgcccactagggttcacttcctcgtgcctgtgcttttcttgtgttactagtgtccggccagaattagtaagatgaaaccatcggaggtcaagatgaaaattgacatgtccgcgacgtgtcctccatcagctatgcgggcacatgcagacacagggcacatgc

SEQ ID NO: 57047 - DNA, 436 bp, Triticum aestivum
  Clone ID: PAT_TA_57047
ctgatcttgtttcactataccgctggcggacgcatcagaagctgagggaggagcacatggaggatctgtggtggctacgtgcaggtgtcagcacggacaagtacggaggagaacaccacggtgggcagtagcagcacggtacgccagatgggggagcaaattaacggcatgctctaggagaaggcgccttctgcgtcgcaggcgctcacggtggcgacgctgttcccgctgggctgactgctgctggtgctgcccgggctggggctggcgggcaccgtggtggggttggccgtgtcacactcccgtgttcctggtcgttagacctgtgctgggaccggccgtgctctctatcgggctagggcggaccggcgtgctcacctccggatcgctgaggctgggcggtctcttctcggttacctgtgttgggcttcacggc

SEQ ID NO: 57048 - DNA, 352 bp, Triticum aestivum
  Clone ID: PAT_TA_57048
aaaaaatataaaaaaaaaaaaaaaaaaaaaaaaaaaaaaaaaaaaaaaaaaaaaaagaaaaaaagaaaaaaaagaaaaaaaaataacgaacgaagagagagcaaaaaaaaaaaatatgggatggcgcgttcaaggggcctcttctcttgctccgggggtcttcagcgagggtttctgtttttttccctgggggtctcggggggttattcccgggcttgctgtttccccctttcgccttgggaaatgccctgggcttacccccgttcggtggcgtggttcccacctgcccgtttgccctgggtggcttttttggccgccgggcccccccggttccttgttcccaaaggttggg

SEQ ID NO: 57049 - DNA, 672 bp, Triticum aestivum
  unsure (1)..(672): unsure at all n locations
  Clone ID: PAT_TA_57049
ctaatctcctttcctcgtctaacctggtggtggcgaagaaccagagggccacagccgctgccggtgtcgtagcccggggtgtcgagggagaggcgacggactggaggaaccaggcgagccggtcggcgggtaaccggagcagcagcgccatcgtctcctcccttcgtctttcttctagttggagcggggtcggccagctgccgcatccccgtcgaggaaggggccacggagctcacgccggagagtggcctagtgcttaggtaaggctgcagccgcgctgtcgtgtggtctgctgacaccaagggctggtccatcgccggggcgtgcatcagcagcgacgcctccgagattggccacccgccatggatgttcctctggtctgaccctagtgccatggaacaagtcaagcacgcatggcagcagatcgctgcagccatccttctcacctgggaaggaggagatccatcagcagcccaggttcgtctctctttttcctcgtccctgctcacttcctcaactctctgctcaggttctgtgtgttgctgctagatcctcaagtgtgagtttagcctgctagatgtgtatactagtttcagtttatctanaagaagaggggagtgaggagaccagnttcgctcgtgtcttgctcaattttgtactgggtttctcatc

SEQ ID NO: 57050 - DNA, 202 bp, Triticum aestivum
  Clone ID: PAT_TA_57050
gacgctatagtttttcgatagcgacacctaaattcaagtcacgtggccgtacatcgacaacgctgggactgccaaaaccctgccgatacccaacttaatggccttgaagcacattcccctttctgcagctggagtaataaggaacaggcccgtaccgattgcccttaccaacacatgctcaatctgaatggggaatggcact

SEQ ID NO: 57051 - DNA, 649 bp, Triticum aestivum
  Clone ID: PAT_TA_57051
atatgctctttctctgcctgccattttagccatcagttgagaattatattcaggttagcaaacaagtttcttgatacttataaggcgaacatacttataaggtgaacatacaaaagaaataaaatcttgatgacttgtgagctttgcctattaacttaaaattaacgctgacaagtttcttgttctgtaccatggtaagtcatgagtctgctgtcttgatacaaggaaataaggaaatattagttttctgcttattcgttcatatcttattactgaaaggattgccagtgtaatagtaattcaagtttcacctttcgcagtgtagtctggaatattttaattagcaagatgaactcctatcaactactcccaaggttttctgaaactgtacgaacatttgctaacagaaacttaagttagcaagtttgcatagctgcttagctaccaagttgctctgcagttaataacttaatatacacctatgttaaatacatatacttgttgaaaggtttttgtgtactgctccttgtcctttatgtgacatttactttcgcagtcagtcataaatggatccaggtagatgtatggatatctatatggtggatgatccgtgtcattcttttacaggtcataatatgcacccacacaa

SEQ ID NO: 57052 - DNA, 308 bp, Triticum aestivum
  Clone ID: PAT_TA_57052
gatacacttccgatgaaacaggaatgaataacgatcgagagcatatgacaaagatagaataagagagatggattaagaatgagctcacctctttgtgtagaaatggagagattaccctctatgcatgtgtacactatatgaacaaattattactctgtattttagcaaaaaaaaaaaaaaaaaaaaaaagggaagaaaaaaaaaaaaattataaaaaaaaaagagggaaacaaaataaaattatttaagcaattcccccaatttaaaaaaaggggccgagggtttaaaaaaggcccccccgggaaaaa

SEQ ID NO: 57053 - DNA, 494 bp, Triticum aestivum
  Clone ID: PAT_TA_57053
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaggggggggccgttttaggggtcccagttttccttccgggggctggcaagtttttattttttttttggggcccccaaatttaattccctgggccgtttttttccacgggggggttgggaaaacccttggggttccccatttaattcccttgggagcaattccccttttcgccggtgggggaaaaaggaaaagggcccgcccggttcccctttccaaaagtttgcccaccttaatggggaaagggccccccccttgtacgggccctttaaccgcgggggggggggggtttccccccagggggccctttcctttggccggcgccttagccccggtctttttcttttttttccttccttttcggccccggtgggcggttttccc

SEQ ID NO: 57054 - DNA, 673 bp, Triticum aestivum
  Clone ID: PAT_TA_57054
atttctttaaggacatggttgaagacacctatggctgtataataggtaacagaatcttgacttcttcacacaatgaatttgtctctctttttggagaatacaaagaattatatggaaccagttctactagtgaattagcatcacaagctcgtgctagtgaaaatgcttctgaaagttctcttatgaggtcacgctacaacaagaagagaatgagaacttgtggagagggtagcactagctcaaatatgagaactgaattagacaagtacctagctgaggatacggaagagttgactgcagaatttgaccttcttgagtggtggaagttgaatgctgctcgctttcctgtcctgtcaaaaatggctcgtgatatactagcaatccctatctcaacggttgcttctgaatcagcgtttagcactagtggccgtattcttgatgactttagaagctctttgacaccagcgacactccaagcgttgatatgtacacaagattggctgcgtagtaagcctatcaatgttgaacttgatcttgctgagttgaccaaactggaggaaggtgtgggagcccttcgattggaggataatggtgtaatatcgattgattgatcttcatgtgtggaactggagtggaaacttgtgcaagttgctgcctgaagcgatgaagtttg

SEQ ID NO: 57055 - DNA, 179 bp, Triticum aestivum
  Clone ID: PAT_TA_57055
cccacgcgtgtcgggccacgcgtccggaactagagtaaaggatacgaacgtatgcgagaagtaaaataaaagaaaaaagaaggggggtccctttgaagaatccaggtttacacctacctagctacgcaaaggatgtacatgttatttcgtgaaacctaacattaatcgatgggcggctt

SEQ ID NO: 57056 - DNA, 651 bp, Triticum aestivum
  Clone ID: PAT_TA_57056
tccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctg

SEQ ID NO: 57057 - DNA, 730 bp, Triticum aestivum
  Clone ID: PAT_TA_57057
ctcccagccagccaacttgcagatccgctcatccgttctgatgctcaccaagggcaacaagatcctccacccaggacaaatctaattaccaagccctctgggtttatcttgtggatctattctcatggagtcggttgagctatccagcacatcactggctgaagcaatgttcgagaaactcggtcttcctaaaccagtgtattttgtgcatcatctttcacaagatcgatttagaacagagattcaatttcaccgcacaaaagcacggtacgatgcttcagcgcgccggactaaagtatcaagccgtacatgtcagaatggggtagcatcaatgaatcatgcactcgataaggccatcgaatacatgcagaacagagagggtaaggtgcttgtggactataactattatcagctagagcaaatgaaaatggcacatacaagattatcaaccaggttgccagaacagtcagatgaaatcaaccagcacatcaaaaccatcaagcagataactaaagaagcatgcaactatgtggaacaagtgcgcaatgcatcaaacagaatacaagaccttgctgccgttttcttggaccctgctacctcaatgtgtgtttctaatatgaagcaagctatcatggagattcacagttcaattgtcgtgcttcaaagctctacaactacgacatctcgggttctagaggaaaaggcatgtactcagatgatgaagtgcctg

SEQ ID NO: 57058 - DNA, 725 bp, Triticum aestivum
  unsure (1)..(725): unsure at all n locations
  Clone ID: PAT_TA_57058
ggctcacagttatgcagtggctaacttaagagattccagaatgctgtgcgttttatatttccgagcagtgaaatatgcatctactgcagttgcagttcgcatggaagctgctaataaccttctttttacctgttttcaccttttatttttagaggtttgcactttaattttaaatacacttaaatattcccaaagcaggttttgacacagggaagacacaacttctaaaatacgggctatgtttcccatgtacccactacttagatagatctccatgataaatgctgttgagacttgaattagaactgtgtcgaaagctcaaggtgtcatgcttacatttacctttgtttcaactatatttttgcagactggagcacaagttcagagttcatctaaggcgggtccatggagaaaggtatgcctgaattcagcatgaaatgcagcatgcatgcgtttgcagcgtgcatttttagcttaaaaataataatgtcatgggaacattgagttcactcatgttcagcttcatgtcggcacttaagattttttttcttccagatgcttccatccaaggatgcaaattttgttggatacacctacaagaactttgaaattgtgaatgacgatgaagttgccgggattggntagtctttcttgactgcactattgcctttggccttgggattttgtattcttagttcgntagttttagaattggatggtgcttt

SEQ ID NO: 57059 - DNA, 505 bp, Triticum aestivum
  unsure (1)..(505): unsure at all n locations
  Clone ID: PAT_TA_57059
gaagcttgcgctcttagatgcatgtgcgccacatgtcgcatggttgtctaatatttttcctgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttcccaattaaaaaaaaatttccccctccctttaaggggggggaaaaaagggtaaattttgggggcccccaggcccggggcaatattttggttacttgggttgaaccttaaaaggaaggggggtttcccccccccctcccctaagaagtggggcctgtggttttttggggggggaaagtgggggttttcccccggccccggaaagggggaaattggcccataggggggggcccttaggaaaaataaggaggggggccctctttttttttttaanttgggggggaaaagggggcaaaaaaattttttccccccccggtttttgaacc

SEQ ID NO: 57060 - DNA, 578 bp, Triticum aestivum
  Clone ID: PAT_TA_57060
aaaaaataaaaaaaaaaaaaaaaaaaaaaaaaaaaaaaaaaaaaaaaaaaaaaaaaaaaaaaaaaaaaaaaaaaaaaaaaaaaaaaaaaaatggggggaccacgttttggggggtcccgtttttggggctccctccttgcgtcctcgtgcttgttccttggtggcccttcttttggggcccctgacctcatttgtggggcgcccgtttttgtacccccttgcggggccccccctgttgtgccccccttcacttgccctttttgccagccgcgtttctcacgctggggccttgccaaatgggccttccccgcgtgcccttcccttgaatggggaacgctgcttgccctggggccccccctttgggggggccccttaggcgggccccttcccgggggcccctccccttggccccccccctttggcccgttcctttgcgccctttcctttcgtttttttgctgtgctttcggccttcccccgcgggttttctctggggggttttttttgggggtttcgtttttgggtctcccgttccggcttcccgggcccttgttcccggggagcgtttttggggggggg

SEQ ID NO: 57061 - DNA, 428 bp, Triticum aestivum
  Clone ID: PAT_TA_57061
gtgagtgtagcattgctaaaggatccatgtttacgatccaaggtttgctacgcgataattctactatatagttatctaatttcagtacacttgatcgaatttatcttaaccgtcgttacagacaaaaccgtgtggtaacacaatttagttaccttgcttaatatccttgtttcacaagctgctttaataaggtggaggactacacaaaacgcccttaccaacagttgttcacactaaatgggcaatgtgactggccatggagacgcgcattaaacgcgggcattaaggggggtacgcgcagtgggaacgctacacttgaccgcgtcatatggcagggtcctatcgctctcttcttttgctttcttgcctcgctttctggctttgcccggcgggttttcacttgggggtttcctttaggggttccattt

SEQ ID NO: 57062 - DNA, 419 bp, Triticum aestivum
  unsure (1)..(419): unsure at all n locations
  Clone ID: PAT_TA_57062
tttttttttacgaaagcacagtgcatctgtacatagcgaaaacaaagcaccaatctgtgacagaaactaacactacgcatgaaaaatatacggagccaactctactagtaccacccggctgccccagcacttaagctgactgtccaattccactttcatccatggaggctgcggtttaattctcaggtttggcaaccttttctctctacggctgagtgttgtagtcctgtcaaatgaagcagtgttgtttttgcaatatagaacagatatataaggtgcttccaatttcttaatcccagaattgacgagaccttatttagtttggactcataataatgtgtcaattagaaatagagcattgtcattatcacgacggatggatgtatatcatatgttctcttgtgttggattnnggggag

SEQ ID NO: 57063 - DNA, 666 bp, Triticum aestivum
  unsure (1)..(666): unsure at all n locations
  Clone ID: PAT_TA_57063
catgtttgtttgcatttcatactttggaaaaatgttcctaatgttgatagagtattttttcctgcaataggcatgggagttcctctcaaagttaggtgatcttagccaaactctgatttttgccaaaattgagaatgtggagggcttgaaccattttgatgagatcctggaagaagcatatggtataattctgtcaagaggaaactttggaattgatcttcaacctgaaaaggtgttcttatttcagaagtctgctctgcacaagtgcaacatggctggaaagccctgctgttgttactcatgttgtggactgtatgacggacaacctaaggcctgctcgcgcggaggcaactgatgtggcaaaaatgcggtgctggacggttagtttttgcctcttgctgacatcttatactttggtgatcctgtaagtttttgcctcttgcagaatccgatgaaagttctgattccaaaagctctgactctgagaagccagctaccgaagngaagaatcctgcgggttgctactgcacacaagaaaaaccaggaattggacggctctagcagggattctgatcggctatcaggaggccgactgcaggccgactgggcccagtccgcccacagcagcccgtcggctttcaggaggccgactgcaggccgggcagc

SEQ ID NO: 57064 - DNA, 161 bp, Triticum aestivum
  Clone ID: PAT_TA_57064
caaaaccagaatagtacatagaataattgtcaaggggcaaacacaagagttcctcaaggcatggacgattgatgtttcttagtttcttctcccggcctccccccgtgtccttttaattgcactactttcagtcaattgaagttgtcttgattgcactgttc

SEQ ID NO: 57065 - DNA, 684 bp, Triticum aestivum
  Clone ID: PAT_TA_57065
ataatcacctaaggaatttgcttaaggcgatcagtgacctacatgagtgtctctgttctctgtcaatcactattcctgtagccggaccacatgaggcagagttaccagaagtcaatgtatcttacctaaaaaaacatcccaagattcttgagtctctaagcatcaagggaaccacacagaaggggcgtcttcttccattgttcataaaaggcgataacaacaaacttgccaagataactctatgtcacactctgctgagccaagatgatctggaagtccttgccaagctgcccaagttacggtgtgtcaggctccaacatattctatgcaccgagcacaagctgaacttcaagaaaggtgaattcggatgcctcaagtaccttcttgttgaggactcagacttgactaatatcacttttgaggatgaggcagccagtgagctcgagaagatggttttgtctatcaccagcaaatgttctatttcaggagttgactgccttcttaacttgaaagagcttgagttgaacagcagcttctgcggcagtttgcttgacgatgccaaacagatatccaagctaactcttcgtggtacattgctagagcaagatgctcttcaaacactcgccaagaaaccaaatatacgctctctgctgctccgggacaagtcttttcgtgggaagtcaa

SEQ ID NO: 57066 - DNA, 111 bp, Triticum aestivum
  unsure (1)..(111): unsure at all n locations
  Clone ID: PAT_TA_57066
ctcggatgttgacacgcacgangacgcggncgacgacgncagaaggagcngngaccaggaccggggccccacgaggaaggacaggaancgggcgccgaagcaaggcagggc

SEQ ID NO: 57067 - DNA, 675 bp, Triticum aestivum
  unsure (1)..(675): unsure at all n locations
  Clone ID: PAT_TA_57067
caagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttatgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttnctggtgacaatgttggcttcacgtgaagaacgttgcttgtaaagatctg

SEQ ID NO: 57068 - DNA, 685 bp, Triticum aestivum
  Clone ID: PAT_TA_57068
gtcccttttgggttgtcagatgctttacctcggcagcatgatgagattccttgctttctccatgtgaattttccaaaaagcttatctatttgaggaaccattttttttctcattgatgttgcatcgaccaatgcttataatacctaatagaactaaaagtcggttacccggtcaacacaccttataaaaaaatatgaatgggcaagatgtggccatctagagtagaatttggttcattgattaatgtagaaagacacgggtcaaagtgatccttttccaaggtaatcaccactgttttgttttaggcttatgtgcctgatgttttttaggatctctgtcaataaggggatatatcaaggtagtgtgttgtgttctaattataaatgaagagaaagttaagaacttcatagttacaatgtaatcatggctagagcgtagaggttagagatgtacaaatgattgattaaaaatatatatttgtatttgtaacaacacactggatcacgtcaggtaaatattttcgtagaatataagtaagatttagaactttgaccatgacagctgaaaaaccaaagtaaatccatcatatatattcaatgttcatggcactgcacaagcataattcagttcccttgggagcactagctgctggcgtatagatgtatttcttggatctaacaagatg

SEQ ID NO: 57069 - DNA, 750 bp, Triticum aestivum
  Clone ID: PAT_TA_57069
cgtccgaaaaaaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggacccaattttactccccgggcctggcaaggtaatattttttttttggggcccccaaatttaattcccggggccgggttttaaaaccgggggggggggaaaaccctgggggtcccccaattaaatcccttgggaaaaaatccccttttccccggtgggggtaaaaggaaaagggcccccccgattcccctttccaaaagttggccccccttaatgggaaaggggccccccccttttccgggccatttaaccgggggggggggggggtttccccccaggggcccctttccttttgccgggcccttagcccccgttcttttggttttttccctttcttttttcccccgtttgggggttttcccccggaaggttttaaaggggggcccccttttggggtcccgttttgggtttttccggccccccgccccaaaaaattttttttgggggggggttccccttgtgggccctcccccctgaaaacggttttttccccttttgcgtgggggcgcccgcttctttttggggccttttgtttccccagtgtgccccctcccaccgcttgggggtctttttttttgttttt

SEQ ID NO: 57070 - DNA, 234 bp, Triticum aestivum
  Clone ID: PAT_TA_57070
acacaataaaggtttcatggtggcagtgccttcttctacatgatgggaattcgacggcattttgttgttttgttgttaaatacaaactgggcatgtcgtttgttcatagatcaagtaatatgaccatctcttgcagacaaaacgctcggggaaagtcccagccgtgcacctgtgatcgctggaacggcatactgttttaggaatgcaatacagactggtcaggaggtttgtgtc

SEQ ID NO: 57071 - DNA, 619 bp, Triticum aestivum
  unsure (1)..(619): unsure at all n locations
  Clone ID: PAT_TA_57071
agctaattaaacacagctagcagcacggcctagcatctccggtgaggcaggcaagcaagagcagagagtgatggcgtccccccgtcccatggccgccgcgcccgccgtcctcctcctcgtcctgctcctcgtcgccacagagatggggacgatgaagacggcggaggcccggacgtgccagtcgcagagccacaagttcaagggcgcctgcttcagcgacaccaactgcgccagcgtgtgccgcaccgagaagttcccccgcggccagtgcaacacgcactacgtcgagcgcaagtgctactgcgagcgggactgctgagcttccgccttcgtcggcgcctgttcgttcgtgtcttccgtgccggtcgatcttaggattgaccagaaataaaaggagctccatcgatgttgcctcttcatctgcatgcatgcacgcatgcatccatgcatgtggtttgggtgaagatcggtcgtggctccggcgtgtttgcggcttcaattagtttgtgcggntaatgatgcatgttgcttctctctgtgtctctgtgttgggntggattcagacacttagttggctcgtctcttttttctttttaaaaggatcagatctatttacgtt

SEQ ID NO: 57072 - DNA, 596 bp, Triticum aestivum
  Clone ID: PAT_TA_57072
aaaaaaaatatataaaaaaaaaaaaaaaaaaaaaaaaaaaaaaaaaaaaaaaaaaaaaaaaaaaaaaaaaaaggaaaaaaaaaaaaaaaggaaacaaaaataacaaacgcaaggaggcagacgtcttagggttttctcttgtggtacctattttctagttccctggcctgtttttttacaacaaaagggggtgggggggggggggggttccccttttttttcgccttgcggggcatcccctttttttcttttggggtctccccgaagaggccccccccgttcgcctttcccacctgttgggggggcaacctggggggtgcccccttttttgttgtggggccatttcgcgcgtttggggggggggggcccgcgcgggggggccccccccctcgccccccccctaaagcccgctcctttcgttttcttctttgcccccctccccggggggccctttttcccggtgggggtgttttttccccccccctttcgcctttcccctttagggctttttggccccggggcctttgggttctccctttcgtctttggccccccgttggggcctttcccccggttggccgtttttggggccttttt

SEQ ID NO: 57073 - DNA, 650 bp, Triticum aestivum
  Clone ID: PAT_TA_57073
gctgatgacaggcttagaaagcaacagaagaagagaccaagatgaaggagtctgagctaatgcgaggcaacccgctgatcaatatgaataacttctgctccttcgacgtggaagtaacaatgctgcctactatattatattatgcagggtcatggagagaccaagacaccgaaacggttcatcaactacaccgtcataagtgatttccaccgcaagtttctgcataggtactatgcctcctgcctagtgagctgcaggtcttcttcccccatcacctgcaggcattgacgaccaccatggcctgctggagctcctgctcaggtgatgacgcacccgtgctcctccgaccatgttactgccgacgccatgtagcggcaacttgcagcaggatccccgaccccttcccaacgagctgcctgcaggattcaagcaggcatgtgaagatgagaagagcagcaagctggtgggcaaagtcttcttctgcagtgacaacaacctcatgagcaccgggctgcacgaccgcctgcagctgcaacagaggagcgggaatgagctgcaggcactagacgaccaggacctggctaaggtacgccctccttttctttcttcctcttcctgtcaaatcttgtcatcgcatgcaaagctatcaa

SEQ ID NO: 57074 - DNA, 709 bp, Triticum aestivum
  Clone ID: PAT_TA_57074
ggtttaagcacttccatcccatattggcggtggcatctggtcaggacctgaaggatgagctcactctcggtggggagttgacattgaatttgtggaggtgcatccatcacatgcttagtcagaaggagaagataatctactgcgggtggcttgataggaagagctttgcagggatgctggtgaaactaactgggattacattagcactatgatgcaccctgatgtgatgggatgtagaattgattgggtgaagaagttcatgttcctggtgaatttcatggattgttggtcattgtacattctggatacggagaagaaaattatgatagtccatgaaatgactgagaccgatccggcgtgtgagatgaaaatcaaacatgaggctttagccaagaagttccaacatagtttctgcaccttattcaacgacatgttcggtgctggcttggttgagacccgtggattgtcgtttgtgtatccgttggtggctcaacatgggcaatgcagcagttaatgtcatgtttaatcgcatggaagacagtggagtgtatatcttgcactacttcgtcgagttcatcagactacctacaatcaacactaacccaggctcatatcgagcacttgcgcaagaagtttgcctacgaaatagtgaccatgaagggaaacaatggggatattccggagctcttatcgacataatcattgactg

SEQ ID NO: 57075 - DNA, 744 bp, Triticum aestivum
  Clone ID: PAT_TA_57075
cggacgcgtgggcggaggtgctggattttgttaatgatgcaattattactctggatgcctttgctgatgcttaccagcctgctgcattatcattatgtgcttcttttgaaagaggggatcgagctgaggaattgttgaacacccttgcaagtttgtatgatttgttgttaccatctttgcttcaggggtttcaagttatgtccagttcccaaagcaatggagagacttcgtctgaaagtatacttaatgacatagttcttggcataagaatgctatcaaagagagctgttggatttggttggagattattagagttctgctatttaaatgatcaacttaaggaggaggatgtccaagcatctactaagatgtttccagctaaagtcgaagatcctatgatcaggggagaaataatagttcaaatactcaaggatatcaatagagaagctacttactcttctaaagggaatcctggaaagacgtttctgcaagctcttcaaaaggaatttcagttgatgagccggattggcgatattcggaacaaaggatggatatacatggaggatgagcagttccagttcatatcacgtctgtgcggatccactgtcacttcttggaatagtggccctgatttgccaattcttcccatggtggtgaaccttcacagtaagatgaggaagctgctgtcattgagtccagtattatcagataagggaccttcttcctcatctgggaaaggttccc

SEQ ID NO: 57076 - DNA, 628 bp, Triticum aestivum
  unsure (1)..(628): unsure at all n locations
  Clone ID: PAT_TA_57076
gcaggatgcagtaccactattttggagatgcaataacatttgacacaacatatagaacaaacctatatgatataccattcagactttttgttggagtaaacaaccacttccaaagcattatctttggtggtgttcttgtcagggatgagacatcagaaactttcgagtgggtgttcaatgaattcatccgcatgatgggtggcaagcatccccagaccatacttacagatcaatgctgggctatggagctggcaatagagaaaacaatgcccgaaaccacacaccggtggtgcaagtggcacatacttaagaaggcaaaagagaaacttggtacatactacacaaagcgaagcaacttcagagcagaattccataaaattgtcaatcacatgttgacagaagatgaatttgaaaatgcatggagagagctgcttgataaatacagtttacaaaaaacccgtacatggcaagcatatatgaagtacgtcagaagtgggcaaaaccataattctggggcaaattttgtgcanagatgacaagcacacagcgaagtgaaagcgcaaaccacatgctcaagggatacgtgccagcaagctgccccatgcacttattcgttcggcaatacatg

SEQ ID NO: 57077 - DNA, 672 bp, Triticum aestivum
  unsure (1)..(672): unsure at all n locations
  Clone ID: PAT_TA_57077
caaggagaaggtcccacttatcaagggataacaactaattggtcagactttgtgaagacaggggttggataatttggagaatgtctttgcattcaaggctaaaaggggcaaagtgtcgctcgttgtctacctgttttgacaaggaagctgaaggtgttaccattcatggacatggaacagaagctgcccggatattgtgacaacaaatggaggttaaatcgggaagcgaaagccaggtgataccttgatcactatctttactactctcatgcatattctactgtcgaaatctagatgcagtatttccacattggaaaactttgtatggtccatggactgaaagtttatttgttttggggaactctcattggtaggattttgcactaggacgctttttatgggcatatacaacattattttttactgatgtctgattattgtagcttcaaactattccctgtgatgtttttcttgaactatattcactgtggtgtttgtactactgcatttattcctcagaacattngacggcccagtaataatagtgctaatacaaactttatgaaggttcaagtatttgggttctagctccagattggatatggtagctgcttattgattttcctattcatctggcaggattaaggcattggtgttacttgcctaccaatt

SEQ ID NO: 57078 - DNA, 467 bp, Triticum aestivum
  Clone ID: PAT_TA_57078
acagcgagcgagactaggcctatgacacatggtaaggaccgacaggacaggcagaggcttcgttgttgttccaccatcgtctgcgccaccgccgagtccaactacgacgagatcccactggacgccaacaaccagacgcgatagggtcttctctgctgcatgctagctgtgcgaagactgcataagcggcaccctgagagcgatgaacgcgccttggacagatgacagagctgtaagcgtggatgaagcactgctaattgatcctaacaaggttgatgcactctggtgctggctgaatggcttgacctatgcgggatttttgatttatgaaaccgtgcaaactgatgaatgcttggatgaagcaattgggtgcttgcagaaggctgtggactctgaaccattatatgatttggacaccaagcaatttaatgagtgattaaaagcacctgatgtgtgtatgcagatgc

SEQ ID NO: 57079 - DNA, 133 bp, Triticum aestivum
  Clone ID: PAT_TA_57079
ctataaattctttccatggaccatggcgaacctccacagctcacaaaccctcaccactcacctacagccagctgagaagaacgacttgctagttgcaaccacctctagccgccgacgggctctgccggcgggg

SEQ ID NO: 57080 - DNA, 459 bp, Triticum aestivum
  unsure (1)..(459): unsure at all n locations
  Clone ID: PAT_TA_57080
ggcggcggtgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcnctgacaagacctaccctgctggtttcatggacatcntttcctttcccaagactggtgtgaactactggctccctgtatgacaccccgggtcgncttccgccttctctctgtccgggacgcggctgctttcttcatgctct

SEQ ID NO: 57081 - DNA, 511 bp, Triticum aestivum
  unsure (1)..(511): unsure at all n locations
  Clone ID: PAT_TA_57081
gcaccaggaggggcgatgcacactctggggtcaagttcacatacaacaaacagtcagggaactcgcacaacgtcaaggcattcctgtacaagcctgccaatgttccgctgtactgtagctgaaatgtgtaggatgggttcatgcccgggcctgatatataagtaaacatgttgtaagatctgaaagggaaggtgttggtcggtccctatgcttgtaatggtctgcgcatctagaatgtcagtcgtttgaagggatctgatgtcgaatgcctacttgttgtaaatcattatatgtttttgagccatataaatataatagatatgtgtaaagagttgaataattttatttccagagatttgccgagcgatcaggtgttgcgacaaanannaaaaaaaaaaaaaannnaaaaaaaaaattnnntttttattattgaangtagtnnggattttaaataaatttaaaaaaaanaaaaaaaaaaaaaaaaaaggggggcccgttttaggggttccaa

SEQ ID NO: 57082 - DNA, 540 bp, Triticum aestivum
  Clone ID: PAT_TA_57082
ctggaataatgctttgcactactttccctttctccttggaacttcttatatcaacttgttaattcattaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaagggggggccgttttaaagaaccaaagtttacgaccccgggcttgcaacgtaatagtttttttatggggcccccaaaattaaattaatggcccggggtttaacaacgtgggaatgggaaaaaccttggggtacccaaattaaatccctttgaaaaaaatccccttttccccagttggggaaaaaccaaaaaggcccgccccaatcgcctttccaaaaatttgcccaccctaaagggaaaagggaaccccccctgaaccggcccttaaagcgcggggggtgggggggttacccccaggggaaccgttacatttgcaagccccttagcccccgttcttttcgtttttttcctttcttttctgcccacgttcgcgggttttcc

SEQ ID NO: 57083 - DNA, 657 bp, Triticum aestivum
  Clone ID: PAT_TA_57083
gggaaaggtttcagagagaggaggaagagcggaagaagcgagaggaggaagagagggcgaggagggagaaggaaaggaagcagagggaggaagagcagaggaaacgagaggaagaagagagggagaggagagaggagaaggaaaggaagcagagggaggaggaagagagggcgaggagagagaaggaaaggaaggagagggaggatgattattcagcgaggagggagcaagaagaggaagaagaaaggaggaggagggaggaggaagaaggtggcggaggccaaggcggaggaggaggtgacgatccgagggaggaggaagaacggcggaggagggaggaggaagagggcggcggaggaggtgacgatccgagggaggaagaggaaaggcggaggatggaggaggaagagggcgtcggatgccaaggaggacgaggagacgatccgagggaggaagaggaacgtaggcggaggagagaggaggaggaaggcggccgtggcggagacgacccgtgggaagaggaggaaggcgactggggagactccaccaagttccgcgcggccaagaacctgaagaagcgcttccgtggtcgcatgggcgccgtgttccagagcgcctgaacagccgccgttccagacttccagtcaccttgcacgg

SEQ ID NO: 57084 - DNA, 180 bp, Triticum aestivum
  Clone ID: PAT_TA_57084
cttaccaggtccagacatagcaaggaagaagacctagtgctgtgcgttagatggatgttgtgtggtgcgttagattttgggctgaatgcagatgacagaaacaacatactcagaagtttttctgcgttgttgggctttgtcgactgacccctattttgtgtcagtcattttcctatgcct

SEQ ID NO: 57085 - DNA, 665 bp, Triticum aestivum
  unsure (1)..(665): unsure at all n locations
  Clone ID: PAT_TA_57085
cagggcaagaaggttaaggttcccactttcctcgtccctgcgacgcaaaaggtgtggatggatgtttatagcctccccgtaccaggatctggtggcaaaacttgctcccagatatttgaagaggctggttgtgatgcaccagctagccctaactgtggtgcttgtttgggtggtcctcgtgatacatatgcacgaatgaatgaacctacggcaagtctcttccaatatttccaaatataattctgtaccatagacatgctgcatgatatcttctatatctaaatagctaggctccactgacctatttctcccaacatgcaaacatgcatgataattcccactcatttgcgctatttatatttaataaatatttttgcccccctccctccccgtgcgggcgactcgggcggcccccccaacgctagctagcgccgccgccggccatcgtcctcccccctctgccgctgccggaggatgtcgcgaggcaaagccgcgtggctgacggcggcggcagggacccctctcgcgtcaacgggcggctctcggggcacggncggggagtctcttgcgggccggcgcgtcgtttttgggagatagtgcctggattccggcggagcttggggatgcggcgcctcgggctcgtgggcgcgggtttgctcgttggc

SEQ ID NO: 57086 - DNA, 557 bp, Triticum aestivum
  Clone ID: PAT_TA_57086
gaattttgtcagactcttgagccctatttgtaggaggatatagggttgatacctactcaacatacatgcctggtatggagggtcagaattttcagattccataccttgtgctaatgatgacatgaatatgcatgaagataccattgaggacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaggggggggccgtttaaaaggaccaaactttaacaacggggggtggcaaaggaaaaactttttttatggggccaccaaaataaatttcccgggcggggatttaaaaaagtggggatgggaaaaacccgggggacaccaaataaaaaggcttagaagaaaacccccttttcccaagggggggaaaaaccaaaaagccccgccccaatcgcctttccaaaagttgcgaatcttaaagggaaaagggaacccccccttaacgggcccataaaggcgggggggggggg

SEQ ID NO: 57087 - DNA, 423 bp, Triticum aestivum
  Clone ID: PAT_TA_57087
atcgcctcgtcccgcggcgatctcaccatccgggtggccggctggcaccacaaacgccagaaccaccagacacccgtgggtggacatcacgaacaacccggagtgcgccaagcatgcatcgaccccgcccaggtatgctcatcttcggcaagaccaacaaggaggtgcaggtggtgttccggaccaacgatatcacgacgatgggctaccccgcccaacaccatcacttcaggaagcctgagcgcgaggaccaccagctgtttcaccccaagcatcacgacgaagacggcttggcgttcctgacgatggcaaccgccgagctttgacgcggcaacggcggtgttgttaaccgaatgtgcgagctggaacccgtgccatttgagatctggacttgtatctgcgtgctctgttgcggctacggcc

SEQ ID NO: 57088 - DNA, 594 bp, Triticum aestivum
  Clone ID: PAT_TA_57088
acctgcggttcaccaagctcctgctggccattccaggattcttgagcttgctgaggagttgtccctgccacttgctgctgtgaagtactcccgtgggacattcatattccctgaggcacagccttctccacacaagaacttctctgatgaggttgccttcctgaatggctactttggtggactcaagtctggcggcaatgcctatgtcattggtgatcctgcaaagccaggccagaagtggcatgtctactatgccacccagcagcctgagcagcccatggtcaaccttgagatgtgcatgactggtctggacaagaagaaagcttctgtcttcttcaagacctctgctgatggctacacatcttgtgccaaggagatgaccaagctctctggcatctctgaaataatcccggagatggagatctgtgactttgatttcgagccatgtggctactccatgaacgccatccatggctctgctttctccaccattcatgtcactcctgaggacggcttcagctatgctagctatgaggtcatgggggtggaccctgcctccatggcctatggtgacctggtcaagagggtgctgag

SEQ ID NO: 57089 - DNA, 102 bp, Triticum aestivum
  Clone ID: PAT_TA_57089
ggagggagttcctatagtaaccttacgaactttaatgcagtgatttggtttagacactttagaagatatttctatggaagaatagatgttggtatttggact

SEQ ID NO: 57090 - DNA, 812 bp, Triticum aestivum
  unsure (1)..(812): unsure at all n locations
  Clone ID: PAT_TA_57090
gtgtccaaaagttccatttcttcgcctttttggagaatgatgcaaataatgtgtttgttttgaacttctttcaactacatattgcttgctatttggtgtttagtttgtagtgttacttttctgcaccagttgctttgcttcttgcactaatttttattgtcttttttctgcactgattgcttgctccttgctttttttactttgtagtgtttcttttctactgaaccgtgaaattagcgtgtatgatttctagaagctatctctcttttatgcactaactgactttgtgttagcatttggtttcgaaaaatgtcattgtacaacctgaccaattcttggtgctaattgtttcatcctctcgtattttaagtttgcgaatttaaggctctaccatcatacaaaggcaaacattcatggggatttggattaagtgcacctccttttcattattctaattaatgagtgctcacagaaaaggatacggtgctaagatttgccataatagattcttgacttgccataaattcaaataaggattgaatatatttgtagttaaaccattcttgctcaggtttcagatttctcaatccatttttctgtgcaaatatcaattcttgacaggttattcagtaatctcgcacatgttcgttntctctatatatcatcagtattaaagttcatacatgatacgttatattctcggctttagaacattaaagttcgtacaagataccttatcatcagtagtaaagttcataccatgttctcctgcttagtctaaatcagatagggactttaaacataatcagttt

SEQ ID NO: 57091 - DNA, 785 bp, Triticum aestivum
  Clone ID: PAT_TA_57091
gacgacggtctagttctgtgttcaccccgctaccgcttttttgttacaaggatggaggaaaagatgacgacccgattgaagagaaactaaattgagaaaacacgaactgccttccaggcctgaaatgctactttgctcccacagagtctggatggaatatggatgaaccttacatactgcctggcaagacaattaatcaagctgcgcaactattcatgctcatacataccgctcccaccttggttaaacatatggacaggcattgctttgatactagtcgaaaactatcacaaaggatgttgatttatcagccgttcatgttatacaggcttgatgataaaccttgcagccatgaaaatgggggcattgttcaacgagatggtgaactcctgatccatactgatggaactggcctaatatctgaagatttggctgagaaatgcccaacaattatgtacaagagaaaacttttgaagtcacaagatgttcaggcttgtgatgatacacttatgacttatccccatgcgaagaaacaacggtctattgccagaaaacctcctcttcttattcagttccggatgttctataaaggatcagctgttatgggaactgctttaattgacagacagctttctcctggaactattcttatacgggccttcaatgataaaaataaaaactgatccaaaattatgtcggtgttcaagcccgctactttttgggaattggtaaaatgaaagctgatccataattttttgtgttcagtccgttaatttttggtattt

SEQ ID NO: 57092 - DNA, 677 bp, Triticum aestivum
  unsure (1)..(677): unsure at all n locations
  Clone ID: PAT_TA_57092
gttatttgttaaactgcactgcagataaaatcggatttgttggttgcaaggttctgggagaaaccttttatatggctcaggtggttctttcaccaagcaatttctttggcctccccacaattttaagataacagaactcacagctacatgactggatggccttgcaatgctgtcaaacagcagcatagagtacatggcaccagataaatttaacaagcattatcaacactgagcgccatggtttatgaaatatctttgaacttctgcatggagcatggatcaatacatctttgggccaaatatctgttggatggttgcaagttttgaagaactttgctggaggcatgaatctggtctttctgagttctgctaattcctttagtatagttttcagtgcactatgacttaatataggttattatatatgatacgcttaggccctcattgcataatataggttatgtatagtacctttaggccctcaattgcattaaattgttgggtgtgggcggnggttgatggttttagaaaaactgaatttctgatattgaagttccttccttgcatcatctatttataaatgatgtttgagatcactaagaggttctgcgtctacaagttataaacaacagacttatccaatcttttgggagttgttgatgtcatgtgctaattcg

SEQ ID NO: 57093 - DNA, 146 bp, Triticum aestivum
  Clone ID: PAT_TA_57093
gcgaaacataaatgttggtagcttgaagatctgagctagtagagggcttaatataatagagatatgtgcgcacaactgcaccgtatgagactttgtctagtaaatctgctttgcgcgtgcagtcacagtcgcatgatttagaggaa

SEQ ID NO: 57094 - DNA, 565 bp, Triticum aestivum
  Clone ID: PAT_TA_57094
actctcattacttatctagcttccctctcacgtcattaactaacgttagtaggactgtcccgatcaaggaaaggagtgatgtctgcggtgccgggtgactggcggtgccgggtccggtggatgcgcgatgtccgctgacgtggaggccacatgctgcgccacctgcatggcaatgcccgccgcctcccacatggggagctcaccgcctttcacaacgggagctgagaccggttgctgacactgggccagatcggagggtgggactgcacgaccttgatgctgggtgccgtgtgcctgtgctgctgctcaagatgccgctcagccgaggcccacaagaccgtgcggaggacgcgcacgcgaggatcatgaccgacagttagcagcaccctcagcatcatttcaccaccacccatgcgctcatggccgcgcgcccgttgtgctataggacccgcgcgcgtgatccattataatcactgcccctgttccgtatgtttgtctacccctgtcctttgtgatgcccccgctctgtacttatttgtgcctcctcttcttttgatgatatggc

SEQ ID NO: 57095 - DNA, 698 bp, Triticum aestivum
  unsure (1)..(698): unsure at all n locations
  Clone ID: PAT_TA_57095
aacctgtataagagtctccatatggctgatgaacttctctggcttgttcagaggctattttttctaaatggtgatcaagatctttcatcctttctattagtggatcttggtctggtgaaattcccagactacacatgcagcgttgttcatcgtatttttcaagaaagaaatgatttacttcagtatgaagaggcaattcgagtggcacagttcatggatgaatctcttgataacgataacatggaattagtgtcaagatgcactgatttgtctgagaatcgactatgcacttcgttaaaagaagaagatagcagtttagctgattctcctccatcattctattcatgcttttcatctacctggatctattccaaaatactcacattaggtgtctctgtttacgaacgcgaacgcaggtatgcagatgcaataaggactctaaagatactacttagtaaagttgcttctggtagacggcgaggatattggacactgagattatctattgatttggagcatatgggtcgccctaatgagagcctttcaatagctgaaggaggagtgaccgacccatggatccgtgctgggtcaaagattgcactgcagaagagagctctgcgtttaggcaaacctccacggcgctggaaaagttccagntatgctgattctcttaagagaacataaaagaggtgaacatc

SEQ ID NO: 57096 - DNA, 593 bp, Triticum aestivum
  unsure (1)..(593): unsure at all n locations
  Clone ID: PAT_TA_57096
cgatgccgctgcagcaaccacccctcccgctcccgccgcgcatgcgcccgccgacggaccgcgaggctgccgcggccgggccgcctcccccacggcagcgcctgggccaggcgccgaggccgttccgcgcggcggaggagcccgcggcccgcgggcctcccgtcgccgacagggccaggccgccggagccgcggccccgccccagcctcgcggaggaggcccgcgcgtctcacgaggctctcctcgccaacgtcgccaggacggccgggaagccggagggccgcgccgctcgggaggctcccgtcgtccccgtggccaagccgccggagcagcttcacggagcgccggagggacgcgcggctcgggaggctcccgtcgcccccgtggccaggccgccggagaagctgcacgttgcggcggaggagcgcaagactcctcgggaggctcccgtcgcccccgtggccaggtcgccggagcagctgtatggctcgccggagggacgcgcggctcgggaggcccccgtcgccacagtggccaggcctccggagccgcggncggggccgtactacntgcccgggggcggcgcggcggcg

SEQ ID NO: 57097 - DNA, 791 bp, Triticum aestivum
  Clone ID: PAT_TA_57097
ggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgcctagatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacatgaggccatctatgacatctgccgccgctcccttgacattgagcgcccaacatacaccaacctcaacaggcttg

SEQ ID NO: 57098 - DNA, 353 bp, Triticum aestivum
  Clone ID: PAT_TA_57098
gccagagaacgccgacatggagaagatctccgccgtttgccgcgacggcgtgctcaccgtcaccgtcgagaagctgccgccgcccgagcccaagaagcccaagaccatccaggtccaggtcgcctgagaatgagatgcatcgtgtgcgcgtcgaatcgaagcagagtgggtactgagtttcctgtgatgatgagtgatggtttctctgtcttttgatctcatctgctagagtgtgtgtgtcgtatcgattcgtgcgcactggtgatggtttgatgtttcgttaatgcaaatgggggtgatctccggcttcgcctgaataaaacatgcgaatcttttggccacattttctattg

SEQ ID NO: 57099 - DNA, 665 bp, Triticum aestivum
  Clone ID: PAT_TA_57099
ggcgggacggggtggatcctgttccgcgccccatgattgtaccttggagcctgcgcgaatagaaggcgatccactccaaacccacaagtagcgcaacatggtgactttagtgctgacatctacagcactgcggagacagcagtgatctgacctgaggaggattggtgtctacatgcacgacagggaccttaactatctgttggaaaacacgcaaaacctcctatgcatcaggtgctcgctaccggccaagacggacactccacctgatcaacacgcgccgcatactgaaacagagcattcgtccgcaagcgctgctgattctgcccatattgttgagatcgatgagacactgttcttgtttatggacatgaacaccctctacactatcacttccatctaaatatgctcaattacaaatttacagcctactgctgagcacgcatgacctgtatgtgtccaacccatgccacattgagctgatcttgtcggagaaggaagagccggtgaagaaggaggctgagtcccagatcgccaggaaggcctagagaaggaagctctacataacctatacgactattcgttagagcagtttgtagcatatggtttggctgagtggaaattctcggactgttatctgcggcgcctaaatactgcatagctcatac

SEQ ID NO: 57100 - DNA, 595 bp, Triticum aestivum
  unsure (1)..(595): unsure at all n locations
  Clone ID: PAT_TA_57100
cccgggntnncgacccacnngcgtccgagagaaaattaatatagataagactgaaacagaaataataaaaaaaaagaacaagatattttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaaacacatttctaaagaaaccaaatttgggggggggggcatccaaaataaaaacagctggtgtgggaactaaaaaagccaggacaaaggaaaactttttttacaaacccgaaaaaagaaaaggagggggcggatcccaattttattggctgagaaaaaaaacccggtttcccaaatagacgcacttttgaaaaaggcccttattagacgggtaaagaagaatgtttcctttctgttgctttattttttcgccacgttggttcggctccttacgttaagaaggatatcctggggtagcctcaatggaaccgttcttttggttgttgcctttaactggggggctaactttattgggtttaccctttaaagcaaaaaacgcgggattcccttaaaagtttt

SEQ ID NO: 57101 - DNA, 532 bp, Triticum aestivum
  Clone ID: PAT_TA_57101
aacaaggataaagagagctagaaactgaccaaaacacacatgaataatctgaaacagaggagaaactatataaataacaaaaataataatactacagaaaaaatggaaatatgctaaaaaaaaaaaaaaaaaaaaaaaaaaaaaaaaaaggggggggcccttttaaaaaaaaaaaaattaaaaaaaaaaaaaaaaaaaaaaaaaaaaattttttttaaagaaaaaaaaaaggaattccgttgccggggtttaaaaattatggccacggaaaaaccccgggaatccccaatttaaggccccttaaaaaaatcccttttccccacgtttgacaaattggaaaagggaaaaacctgggcgcccctcaaaaaaattgcctcccccaaaatgccatttggcccccccctttaaagacaaaaaaacccccgccggtggggcttttcaaccgagggggaccccttaattttaaagggcaccaaccccccggcgttttttttttctcgcttttttttggggcaacgcccacggtttcccc

SEQ ID NO: 57102 - DNA, 228 bp, Triticum aestivum
  Clone ID: PAT_TA_57102
attattttctacctatccttatttcttttatgaagtactcatgtgctaagttgtaagctgacttttgtgttaaccgtttatttctttttgtccacaaatctttttattgtgactagaggtacctcctaactcgggtggctgaatctccttgtatactataacttcaagtatagctatggtaccttcatagttatagtcttataaaatagatattgaccattttcactt

SEQ ID NO: 57103 - DNA, 265 bp, Triticum aestivum
  Clone ID: PAT_TA_57103
ccacgctgccgttagaaataaaataatgcagaggaggaaccagcatgttctgccttcaggctgtgcggctctattaggatgccacaggctcacgtactcgtgaacagtccatattatatattttttgataaagaaaacaaaccttatttatctgtccgtgcttacacaagactgctaacgggaacatactctgatgtaccccaacttaattttgtggcttgaactacatgttttaactggtgaattaatactgattaggaccaag

SEQ ID NO: 57104 - DNA, 484 bp, Triticum aestivum
  Clone ID: PAT_TA_57104
ccccaattcaaaaattatggagcgcaaacaaacatcatgtccatacatacatagatggatagatataaaacacagggatcgaggggctcaactgaaatcaactttgttaaggcttttaatatgaggaactccggtttttgggctcatgcctttttgcgcctcctaagtatctccaccccgaggtagtcaacaaccccctgcaccgggacggggggtttcccgaccttcacccggacgggggaaatctggggaaactcgagcagggtggtgccggggatcgactgccccaccgactccaggaggttccgggacgggccttccaccacccccttggttatcctgtaaatgtcggggtacctgacggggtgggcgatgtcgtcggagtccccggggggggggaggtccatccaggcgtccacgttgaccacaaacttttggcccagttttttttcctcctgcttccccccggggaacccggggaact

SEQ ID NO: 57105 - DNA, 643 bp, Triticum aestivum
  Clone ID: PAT_TA_57105
ctctactttcctccggcgccgtccgggagggagtggggggcggatcatggcggagcacggagaggaggaggcggcgacgctggagttcacgcccacgtggatcgccgcgcgtcgtatgctccatcatcgtgctaatatccctcctcgccgagcgatgcctgcactacctcagaaagacctttaagcggaagaaccagaagccgatctacgaggccatcctcaaggtcaaagaagagctgatgcttcgtagggtcaatgcgctgctgctgacggtgtgccaagggaagattcagaacatgtggattcgcgctagctggacactacacatgctgccatgccaaggggaggacgaggttcgggccggcgaggcggcgccgacaagaggagcatcttgttacatcccagatcatcggcagaatctgcaggcggctgctcaacggaggggcggcggaagccgacgtctgccggtcgaagggaaaagctacgctgatgtccctagaacctatacatcaattgcatattttcatatctgtgctggctattacacatgttgtgatcagggttttgacaatgcttttaggaggtgcaaagatacatcagtggaaactgtgggaggatgcaattcagatagacactgcaggaa

SEQ ID NO: 57106 - DNA, 712 bp, Triticum aestivum
  unsure (1)..(712): unsure at all n locations
  Clone ID: PAT_TA_57106
gcccccgcgccgcggtgaaaggaaaaaatatctccttcctcgccccaacccgcggtaacaaatcctccaccggcggcggcggtagatctccttcctccgcctcctccccttctcccttttcgcgaaacccccgatttattccccacgaatccgcagcgacaccaaatccgcctcttcctccccccgtcccccactccttatctcgccgccgcaatccgtccggccgactgacccctgccgccgccccgcgagccccgcggagcgctgtcaaggttgcttttttattcttctttcgttccgggaacaggtcggcggccggccatggcggcggaggaggcgagcagcagcggcggcgggggcggcgaggaggggtccggcgccggcgggtggacgcgggagcaggagaaggcgttcgagaacgcgctggccacggtggacgaggaggagggggaggccatgtgggacaagatagccgacgccgtcgagggcaagacgcccgaggaggtccggcggcactacgagctgctcgtggaggacgtggacggcatcgaggccggccgcgtgccgctcctcgtctacgccggcgacggcgaggaggggggctccggcgccggggctgggggcagcggcggnggcgggggcggnggcgggaagaaaacggcggaggagggggcgggcacggggagaagggctcgtccaagtccgccgagca

SEQ ID NO: 57107 - DNA, 724 bp, Triticum aestivum
  Clone ID: PAT_TA_57107
gccccgtcgtctcctccaccatctgccggcgccaacgcacaccccaacattcctctcatctctctcctccatggagctgatcaaacccacggccactccatcaagcaaggcccttttccagcacgaacccgccgacggcggagatgcggcgagtggaaccatcggcggcctccctttccacctcacggagaggatcctccgccgcatcagcccgctcgagtcggcgcccttcgccgccgtctgcaagtcctgggcggcgaccatctccgagcggctagcgagacccaccccgcacctgttcgcgctcgaggtcctcaacgaggacgagtacttcatcgatctcctgttcgtgcccgacttggagcgccgccgtggcgccatcttctccgtgccgaccgacgacgaggagtcgccggcgccggtgatccccgcccgtctgccggccacggtcagccacgcgaaagatgacaacataaagttgtctggcgccttgccctgcggcggcctctccttcgcggaagacaaccgcgtcgtcctcgtcaaccccgtcaccggcgcgttccagagcatcgagatgtacccgccccggcacaggcttctgattcaaccgacggtcagggccgtggccggcgccgacgcgttcttcgttagccagtatttcgagcggaccgtcactctccggtggcgcgaggtggaggagtggtccgagcagaatctgctcctg

SEQ ID NO: 57108 - DNA, 673 bp, Triticum aestivum
  unsure (1)..(673): unsure at all n locations
  Clone ID: PAT_TA_57108
gtgctgcgatatcaccgtggccgatgtcgccgcgccgtactggcagaggccggcggggccgacctggtggtgccacgtgacagcgggacacccggcggtggacgcctggcttgccggcgcgcgatggctgcacccggccatccgcgtggcgctcagggacgagagcatgctcatcagtgagaagatgaagcatctactgtatgaggtcccggttagagttgcaggtggtttgctgttcgagctattgggccagtccgtgggcgatccggccggggacgaagatgacattcctattgtgctccgtgcatggcaagctcaaaattttcttataacagcgcttcatgtgaaaggttctgcgaccaacattaacgtcataggggttacagaggttcaggagcttctttctgcatgtggaagtacagctcctaaaagtatccatgaagttgtagcgcatttggcttcccgccttgctcgatgggatgacagattgtggcgcaaatacgtgtttggtgcagccgatgaaattgaagttaaatttgtaaacaggaggaatcaagaagacctanacctgctgtgcataatatttaaccaagacattagaaggttagccactcaggttatcagggtgaaatggtcactgcatgctagagaggagataatatttgagctgctc

SEQ ID NO: 57109 - DNA, 658 bp, Triticum aestivum
  Clone ID: PAT_TA_57109
attgattgaagaatcatcacaaagagtccttgccatggttctcacatgcttgaatctgtatggaaaattttcagagttcttaaacatgcattaactatgcaattatacttggtatgctgcatgtactggttcgttcttgcaggcctgaattagtacaggatttttttatagagtccttaacatgcatcagttatgcaagtatatgttaaacagaggaggggcattttattcatcagatgggggccattttaatttggatttggctgacagagtaggaacttttttactgcattaacccccccccccccgccctcttattttgcgtcatcccccatatacatgcctatttgttcccctttaccatctgtagggctaactggtcacgaccactactctttattttctcttttttgtcgcagctgaaggcttacgtccagcacaacaatggatgcaacctgttcgtggggctgccggagacttagaagttcaattcaacaaagctgccaacatctttccgtgcaaacgacaaaaactcaaaccctcacccccatctcgttttggtgtcctttctttaaagcatggcaaaaaaatgtgtcgcctttgttttatatagaccaatttttcactgggatagaaatattgcctaccacggcaaact

SEQ ID NO: 57110 - DNA, 591 bp, Triticum aestivum
  Clone ID: PAT_TA_57110
aaaaaaatataaaaaaaaaaaaaaaaaaaaaaaaaaaaaaaaaaaaaaaaaaaaaaaaaaaaaaaaaaaaaaaaaaaaaaaaaaaaaaaaaagggggggaaggatttaaaggaaaacagaattctatactcgtgcctgcaacaaaaataacgggttctttgttgtccggcgacacccacttttcctgggccctggtgttgccccgccttagtctttgtaaagcccgtcggctttcccgttttctgcgccttgtggcacacacccccttttccgggcggccttgttatcgaaagggccccctccctttgcctttttccccctttttcccctgtgaatggggaaagggggccgccctgtttaccgcctttttccccggtgccgttggggttgtcccacagcgcgcccctcttactttcgacctttctttggcccgggcttttgggtttttcccctttttttctcgccacgggggggggtttttcccgttaagattttaaagttggggccccccttttcccccccagttttggttttacggcgcccccgccccccaaaaccttggttttgttgggggtccccgtttggggcccc

SEQ ID NO: 57111 - DNA, 717 bp, Triticum aestivum
  Clone ID: PAT_TA_57111
gacgagtcagtcagaccctctcgttcggcgctggacggcgagcgtcgggcgccgagcgacgggcggcgggcggctccggtgattcctctctggtgattgtcccgctaagtggcagccctgtttcgagcgttccgtgctgggccggcggccagcgagcggcgcggctgttacctctccggcgattgtccggccagccgtgctcagtccccaactggatttgggcccctagattgggctagatttgcaaagcaaacaaaggaggtgagtagctcgtgactcattgggttgtctcctccaagttcagcacatctaaaaaggaagtaggagagaggacgagtaactatggaatgccaaagtgaagtgagcaaggctccttcttttgctatttgtgatgtccagtctgacgcagaatcagccgtccacactaggccaagtctggacattgggtttactacaccacagaaatcctatagtgcacctttctgtggctcatcttgtactccagagtgtgatgatgccatcagaccagccattgggatgacttttgctgatttgaacgcagccaaggagttctatgaagcttatgcacatcatgttggtttttcagtacgtgtggggcagcaaaagattgtcaatggtgtcattactcacaagcgtttctactgtgaccgtgaaggtttccgtgaagagcggaaagattcttttattttgatatga

SEQ ID NO: 57112 - DNA, 637 bp, Triticum aestivum
  Clone ID: PAT_TA_57112
ctagttctgatctggctcgctttggttatgtaataagccaactattgtatctacttagtgttgatccatcagcttggcttacttttggaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttaaaaaaaaacaaattaaacaacccgggcaaggaaaggaaaaatttttttaaaggggccccaaaaaaaaaataaagggcccggttttaaaaaacggggaaagggaaaaaaccggggggaaccaaaaaaaaacgccttgaaaaaaaacccccttttccaaaggggggaaaaaaaaaaaaagccccaaacaaaccccctttcaaaaaattgcccaacctaaaagggaaaagggacccccccttaaaggggcaaaaaaaccgggggggggggggggttaaccccaagggaaaccttaaaattggcaagcccctaagcccccgttttttgggttttttcccttttttttcccccaagttgggcggttttccccggaaaagttaaaaaggggggcccccttt

SEQ ID NO: 57113 - DNA, 708 bp, Triticum aestivum
  unsure (1)..(708): unsure at all n locations
  Clone ID: PAT_TA_57113
gaacgacctcgccggcgagatcccgcaggtgggctcgctcgtcaaccagggccccaccgccttcgacgacaacccgaggctctgcgggttcccgctcaagatcgagtgcgccggggagagggatgagccaagaatcccgcagtcgaaccctggcatgaaccctggtgcggcggcgcaggttgggaggccgccgaagcgtcggtcgtcgcccacggtgccgattcttgccgtcattgtggtggcggccatcgtcgcagggctagtgctgcagtggcagtgccggaggcggtgcgctgcgacgaccagggacgaggagaaggagtcgtcgaccaaggagaagagcgcggcggtgacgctcgccggcactgaagagcggcgcggcggcggggaggaggngggagctgttcgtggccgtggacgacggtttcgggatggagctggaggagctgctccgggcgtccgcctacgtcgtggggaagagccgcggcggcatcgtgtacaggggtcgtccccggccgcggcaccgccgtggccgtccgccgtctcagcgagcccgacgacggcgatggcactgagtccgggtggcgccggcgccgtgccttcgaggccgaggctgccgccatcggccgcgcgcgccatcccaacgtcgcccgnctccgcgcatactactacgccccagacgagaagctgctcatttacgactacctc

SEQ ID NO: 57114 - DNA, 470 bp, Triticum aestivum
  Clone ID: PAT_TA_57114
aaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggcgggggggcacaagacgcagaaggccggccacgccatccaaagccgcgcggaggaggcccgccccggaggaggcggccacaccggccccaccgggggagggggcgccggcaccggcaccagggcgtcgtcgtaagctggagctagcaggccgatgccagtcggccgccccgcgcaaaagggcgcgcgcgcgtcgtctgttacctgttttatgtatgctagggccttcgtacgtgtttacacaagcgagtgtgtgtgttcgtgcgtgtcagtgtgtgtgtgtaatgtttctactgttttagaactgctcgggttcgcccgatcgatcggtttagtaccgagttgtgaataaaaaaaggcccggcccgtttcttttgt

SEQ ID NO: 57115 - DNA, 732 bp, Triticum aestivum
  Clone ID: PAT_TA_57115
gaaagaagtcgtctctctcctcccaactccgcatccgccctcgcctcgagcctccatcggcaaacctcgcccagacgcagaccgaccacgaccgcgccgccgtccaagacccagaagatccgagcccccctcaccctccctgccaacgacgggaggcggagaattccccgccccacagatccaggatctgcccgccgccggagaaccctagagggtccccccaggcccagagggctttctccctattgaatccaagttttcattgtaatggaggcagctttgaatatgtcactcgatgatatgattaagaacagaagtgggaggggaagaggaaggggaaggggacaaagggttggtcgaggccgaggtgatggccaaaggtcaggcagaggtgatggccaaaggctaggccgtggtttaggccgtggacgcggtgctggaaccttccgtggaaggggagtgccttcccaaaggccacttggtgtcaatactcgctcgtcatcgtatgctattgccaagtcattcaacaaaacaaaggattttgcatggacacatgatcggtttgaggatagcatggtggctgctggacttcctgggatagaaactggtaccaagttgtatgtgtcaaacttgcactacggagtgacaaaggaagatttacaggaacttttctctgaaatgggtcatttgaaagactgcattgttcattatgacaataatagacacccaact

SEQ ID NO: 57116 - DNA, 611 bp, Triticum aestivum
  Clone ID: PAT_TA_57116
gcgacctctctcgcacccgtccatccctctcgccgtcctatctgccgtagttctccgtggtttcgttggcccgcaatccgttccgccttgggctcctgactggtttgggacctcgagaggattccttgatctctctgctctctgcttctcatcttgttctgggtttccagtttaacatttttcttctgaggaaatcttgggcatctctgctgcctttcccctctccccttttcaatcaaccaagcgaaaaagattgttcatcctgagcagaggaacagttcgactgggaaatggctgaagtaaaaccggaagagatggtccaccatccgcccatggatcagctgcaggggtttgagtactgcatagactcgaatccttcctggggagaggcaattggtttggggttccagcattacatactgtccctgggaactgctgtgatgatccccacaatgttggttcctctaatgggtggaaatgatcatgacaaggcgaaagtggttcagacactgctatttgtgactgggataaagacactgctccagacactatttggcactcgccttcccactgtcattggcggctcatatgcatatgttgttccagtcctc

SEQ ID NO: 57117 - DNA, 528 bp, Triticum aestivum
  Clone ID: PAT_TA_57117
atcgaaacaccgatccacgacagtaaggagggaagaatcaagaatggcggatgatgaccagcagtggaagatcccacccaacgtgcaggagctggcggcagctggcccggaggagccgccgagccggtacgtggtccgcgaccatgaccgccccgcgctcgccggcgctggcagcgacgtcacggaccccatccccgtcgtcgacctcggccgcctgtcctccggcgacgcagacgaggcggccaagctgcggtccgccctccagacctggggcctcttcctggccgtcgggcatgggatcgagccggctctcctgggcgagatgatggccgtgacgagggagttcttcaacctcccgctggaagagaagcagaggtacaccaacctggtcggcgacaagaaagagtacaggatcgaggggtacggcggcgacatggtcctgtcggagacccaggtcctggactggtgcgaccggttctacctcgtcgtggacccggagtcgcggcgcctgcacgacctctggccgac

SEQ ID NO: 57118 - DNA, 581 bp, Triticum aestivum
  Clone ID: PAT_TA_57118
catccacccacgacctcatcccctgccccacgccgcccgaccacccgctcccccgcgccgccgcaccacccctcccccgcgccgccgaaccaccctcctgcccggcgaccacggcgacggcgccaaccaccgtggcgccctaccccatcaccaccagcccccttccccaacacctccttcctctcctgcccaccgccacatccccccagccacctacctccgccggccaaggaccgccagcaaccaccggatccggtgagatccggctccacctcccctcatctccccctcgtcagaatttccgccgccgcacgggtcccggtcgcccgcccctcctcacgccaccgatgcggcgccctctgctacctccgtcctcctctccagatccagccgagttgggccccagcaaccaccacccccgcccagatccgtcaggcgcgcgccagaggtgccgagccacggccggttccatggagtcgaccccgaatcccatcgtcctcaagacactgttgcatcggggccggtggattccagcaagatccgtcgcgtcttccacaggatccagactctcccactgcccc

SEQ ID NO: 57119 - DNA, 369 bp, Triticum aestivum
  Clone ID: PAT_TA_57119
gctttatcaggtgggctagagccacaaccacaaccaataatatgcttgagaagcctccgtgatgtgctccagcgccgagcaacaagtcggtggtgcaatgctgatagaacaatgacaacagcgttcgtgagaaccgagagcacccacgcaactattttcctctacgatggtagggggagaaccgggatgagatctacgaggtagctcggccacaacgaaggcgacttgaattgtgagcagaacaacgccggttatgcagccaccgattgagagtgaattagtgaaagcaatacttgcatctaggatgggatagcatactatgtcttgtgcttgtgccgatggatggtctacaatgacgacaatcttttg

SEQ ID NO: 57120 - DNA, 673 bp, Triticum aestivum
  unsure (1)..(673): unsure at all n locations
  Clone ID: PAT_TA_57120
cccacgcgtccgctagatcgcgggcggccgctcgcgatctagaacccaaggagttcgagaagcggggcgtgaagctgctgggcatctcctgcgacgacgtgcagtcccacaaggaatggaccaaggacatcgaggcctacaaggttcgacgataatctatgattgatctcgatctgaaaattcttggttgctgattcgccatggctggctaatctctgccctcgcgcgtgcaggctgggagcaaggtgacgtacccgatcatggcggacccggaccggtcggccatcaagcaactgaacatggtcgaccccgacgagaaggacgcggaggggcagctgccgtcccgcaccttgcacatcgtggggccggacaagaaggtgaagctgagcttcctgtacccgtcgtgcacggggcggaacatggacgaggtggtgcgcgccgtggactcgctgctgacggcggccaagcacaaggtggccaccccggccaactggaagcccggggagtgcgtggtgatcgcgcccggcgtctccgacgacgaggccaagaagatgttcccgcaggggttcgagaccgccgacctgccctccaagaagggtacctncgcttcacaaggtctaggcgtgcgtccgtgctagctcgtcggcgcctgcttcgttactcgtggcggtct

SEQ ID NO: 57121 - DNA, 615 bp, Triticum aestivum
  unsure (1)..(615): unsure at all n locations
  Clone ID: PAT_TA_57121
tgctcctcctccttcctcccctgcccgtgcgccgaccggccgccccaccctactcacgcgccgctgccgaccggccaccccaccctactcacgcgccgctgccgacggccgcccgccccaccctacccacgcgctgctgccgtcgaccgaccgcccctccctacccttgcgctgccgccgccggccgcccgtccatccctatccacgcgctgttgccgccagcctcccgccccaccttacccacgcgtcgtcgccaatctccccttcttaccacgcgctgtcgtgatgctgccgcgtccgtcgccgtcctctaccgcccagccagcctccttctttcgcgccgcaggcaaccttcctccgccccgcagccgcccgccatcccacgccccgccgccgcccggccatcccgcgtcccgccgccgcccggccatcccgcgtcccgccgccgcccggccatcccgcgtnccgccgccgcccgagcctcctgccggctatgcgccccgccacttcagcgcgtaggccaagaagagaagccgccgcccgaacctaaactgtacatacccaggccgttcacatccgccacgagtgccgggtcaacgccggcccgacaaccca

SEQ ID NO: 57122 - DNA, 573 bp, Triticum aestivum
  Clone ID: PAT_TA_57122
gcaagggcgaatatatcttttgttgggtgatgtggtctcctttatttcacttatataactgagcttcggagaagcccgttttatgccatttgatttcccttctcatgacttaaaggaggaggtgatattagattattgttatggtagatgtaatcttttgtcttcgatggtattatgtattatgagtatggagttatcttattccaagtacagaaggaattgaatctgccttgcatgaccaatgtttttatctacgaatgaccttattccattttctacacctcgacatacagatcagcatgtgtatgtgccacagcttgtgggagggacaaaatgggaggtcgccttgaaattgtggaagtgcaagggaggccggaagagtgcattgctacactgctgccctgtttctccttattgctgccgactcaccttcgtgtagcactatttccataggtataagagtttcagtagtttcagctcctgcaagtcgtcattttgtactgaatcttgccctatgtaaatgtacagcctgaaacatgttaccaatgaatggataagtatatattcaatgct

SEQ ID NO: 57123 - DNA, 622 bp, Triticum aestivum
  Clone ID: PAT_TA_57123
tgctgcttcaaaaaaaaaaaaaaaaaaaaaaaaaaaaaaaaaaaaaaaaaaaaaaaaaaaaaaaaaaaaaaaaaaaaaaaaagaaaaaaaaaaaaaaagaaaaaaaaaataaaataaaaaagaaaaaaaaaaaaataaaattttaaataaagagaactaaaatttaaatgggggggcgggcttttttaaactcccgggtttgggacccccctgttgttacccatttttttttttttggggcccatccctttttttttcggggggcgtttttttaaaccgggggggtgggaaaacccttggggtcccccctttttcctttttggggaaaggccctttttttgggggggggctttaaggggggggggccgcgcggttacccttttcaaaaccgtgtcccttgccattggggtaggggcccctccttttgctgggtttttttcctttttgggtgggtgggtttccttcccggggggccttttattgggggcggtctttttggcgggtctttttttttgttttccgcttttttttcccccaaaagggggtttttcccccgggatcttttattggggggtttccttttggggcgggtttttggccttttgggccgctcccccccaaa

SEQ ID NO: 57124 - DNA, 617 bp, Triticum aestivum
  Clone ID: PAT_TA_57124
cccacgcgtccgagccccacacctatggagaagggaaaaagcattagccgaacttctgcaagatctccgctgcacaagggttttagccggagccctgatatgcctcctagaaagactcaagcagaagccctcaaaggaatgctcatagaaactttagcaggagccctgtgggatcttctagaagaagcttgacccctgtacgaggtggtcgatctcgcaggaacgccagcagaagtcctagcccacctcgcagggcagtatcaccactcaatcacggtaggagcccatctaggagtgtctctcccgatggatcaaaacgcataagaagagggaggggctttactcaacgttactcatttgcaagacagtatcgttcaccttctgttgatcgttctcaccgctatggtggaagaggtgatcgtgacaggtatatcagtcacaggggctctcgttatcgatcacctccaagacgatacagaagccctccaagaagagcatcgccaaggtctagcaggtacagaaggaggagccgaagcgtgtcacgcagcccaccagcttatcgagaccgcacaaggggaggtggctacagcaggagttcagtacgtagtcgttcgcct

SEQ ID NO: 57125 - DNA, 735 bp, Triticum aestivum
  unsure (1)..(735): unsure at all n locations
  Clone ID: PAT_TA_57125
cggtgaccttggcgctacaaccatggagacagccagtctggacatgatggtggcaggggttcagcaacaagaaaaaggaggagagtctgaaaaggatggggagaacatgtgtttatgttcatcatgtggataaagaggcctttttgaaaggcaatgttgagacggacccggatgagcttgacatggtgtttgagagtagtcctagctatgcggagcttttgaaacaagtgaggaaagatttgaattggatggacccaagtgacgttgttgagttcgagggaaggcataatgttggtttaggaatgcacatccgttggaagacaatgcgtgtgaattccgagcaacgttgggttgcatacaaggagacggttgagtctactttgacaaggctcttgagttatttgcctccaagaaggttgagtctactttgaatttagacttgaaccggaacccctccccgttggttgctagcactcccccacccatgaaccaagatcaaatgagtgaacctcaattcacgcaagaagattggccaacattgagcccgactccaaacaaccaaaatgaaggttttgaagaggagaatgatgagtacgaggaggatgacaacgaagttgacctccatgacaacagtgtggggtgatctcgaccaatatcatgtgcaagagacaatggaccaatncattcctttttcccgtgcatatgcatcggactcggatgacgatggtcctgatg

SEQ ID NO: 57126 - DNA, 635 bp, Triticum aestivum
  Clone ID: PAT_TA_57126
aagcctgaaaacaaggatgtgcataaatattggggcaccccgatccgcatggagcaggggccttcgcacgtcagcccaggataacacctgacgcacgacaggtccataatacagcattccaggtacaataatattcatcaaatacatgtgcataagcttacatcattgatgaatacaatcatctggcatagccctacggctatttaaatggcaacggaagtctattaaatggcggcagaagtcttggtttggcggctcatcaactttggctgggctccacaactcacaggactggcaaggttacgacctagcacgacagatcaagcgaataattcgagtacgacctacaaaactgggggtcgacaaatactccgggaagaagtgtgaaacgatcgcgaaaagatttgccggaagcagttctctctcggagggggatgtttacgggcaagggcagaatggtcattttcgctatgtgaaaacattatgaaaataatatcaacagaacgggctcgacgaaacgaagacgtgggctttggaatcacctgattcggagctacgggtaaaaagatgtgagtgtttaactaccagggacctatctgtaaaaaaatccttacaaactggcccctgacagaaaa

SEQ ID NO: 57127 - DNA, 291 bp, Triticum aestivum
  Clone ID: PAT_TA_57127
cccacgcgtccggacagacaaggtggtgcatgtcatgccagtgcttgtcctgtgctagctagcctgtgtagtgtagggagggagaaggagaaggacgtgatctgagggtagagctgtttgtactagcgtgttcttctctgtctgtctgtctgtactaggcaaggacaggttgagtaacaagcagagtaagaccagtgatgtttgtggatgtatgaacgactacgtgctgaagctcatgtacctgtgcctgtgtgttgtcttgatgttgaggaaggagtgcagaagctggtt

SEQ ID NO: 57128 - DNA, 775 bp, Triticum aestivum
  unsure (1)..(775): unsure at all n locations
  Clone ID: PAT_TA_57128
ctagccgccggccgccaaacgccacctcctagtccggcgccgcctccccgcctcctcgccgttgctgcgccctcgccgagcgccgcctccccgccggacgccgtcatcagccgagcgcccgagcctgcacgagggacggggccacggggggagccgggctgcgcctgccggggagctcgtcgcccacgacgcctagggctctctgcaggtcgccggatccgccgactccccactggacgccggacgcctctctgcagggctctctgtatgtcgccggacgccggacaccagtccagagcagttcgaaataggttgtctgttgtctctgtctgactctgtttgattcttcttagtttagttgatagcagttgctagtttagttaattctagtcagtacgtagtttggttctagtcagtactggttctagtaacaattaattcatgaactaatttatgtccttgtttatttttttatagaaatgaagagaaagaggactctgcatagttggtttgcaagtagttcaaatacacttcctattattcctgaatccaatgttgccccaattaatgttattgttcagcctaccctcatagagaacataatccccgatgatccaacaaatgagagcactaatccctcggttgatgagagaactaatccctcggttgatgagagcaccaatcccacttcaaatgagagaaccaatccccccaccgatgagagcacanaccaaccagcaccaccaacacaatgtgcagatttttggatgataat

SEQ ID NO: 57129 - DNA, 492 bp, Triticum aestivum
  Clone ID: PAT_TA_57129
ataaactccatgtttgatgaaacaaaggttgctactaatgcacttgttcctggtactagtaggataaagagggttcatggaaatatcaaaggagtaagagttacagttatcgacacacctggtctggtacctcattaccatagccaacggaggaacaggaagattttgcatgctgtcaagcgtttcattaaaagaaacccgcctgatatcgtcctgtactttgagcggcttgaccatattaatagcagatgcagtgactaccctctgctgaagcttataactgataccttgggttcttcgatatggttcaacactgtccttgtaatgactcactgttcctcatctcctcctgaaggaccagatggtcatcctttggaatatgacgcgtacacccgttactgtaagaatgtcgtggagcgtcatatccagctagcagcttctaacacacagctggagaaccctattgttctggttgacaatcatccaatgtgc

SEQ ID NO: 57130 - DNA, 536 bp, Triticum aestivum
  Clone ID: PAT_TA_57130
agtacaccagccgcagcaaacccggtggaggcagaggcagctaatgggctccatggccgcggaaatgactgccgtcgaggaggaggcgtgcatctacgccatgcagctgtcttccacggctgtcctgccgctcacgctcaagaacgccatcgagctgggcatgctcgaggtcttgatgggcgccggcggcaagatgctgtcaccgtctgaggtggccgcgcggctgccgccgacgacgaccaacccggacgcgccggccatggtcgaccgcatgctgcacctgctggcatcctacaaggtggtgtcgtgcgaggtggaggaaggcacgcacgcccggcggtacggccccacgcccgtgtgcaagtggttcacgcccaaccaggacggcatctccatggccccgctgctcctcctcaccaacgacaaggtccctatggagagcttgtaagtatatacttcatatgtagtactctatgttgtagtacgttgtatgtagtgggaggcaatcaacattaataagtactacctctgcgtct

SEQ ID NO: 57131 - DNA, 644 bp, Triticum aestivum
  Clone ID: PAT_TA_57131
gtctggactgtattgttgcacacatttgcataaaaaggttggcttggacccatgcttagttgcacaaatatgttctttttgcagaaacactacatccagtccatctttttagttgcataaatatgtgcttctttttgcacaaacagtacacccagtccatctttctggtccgagctgtttgttgtatacattttgcaggaaagttgtccttggattaatgcttagtgtgcacatatatttactcttttatagttttggctgttggttgcacacattgcaggaaaacttggcttggatccatgatttagttgcacaaatatgtgcttctatttgcacagacactacatccactccatgtttctagtttgggctgttttgttgcacattttttgtaaaactaatcccttgtatctatttgcacacatccaggcagaagttggttttgctactgggtctagttgcacagagtggtgtttatttacacagacatcagattactattgctactccctccaattatggagaagaccggtggaatatccagaggcaaaggggaagggaaaaggacagaagggaggatctggagccagaagtgaacataccttggatgatgctgactgctctgaggggttttgggtctgggg

SEQ ID NO: 57132 - DNA, 310 bp, Triticum aestivum
  Clone ID: PAT_TA_57132
aaaaaaaaaaaaaaaaaaaaaaaaaaaaaaaaaaaaaaaaaaaaaaaaaaaaaaggaaaaaaaaatataaaagaatacaaaggttacggacgctatgcatgctaccgacctacctttcctatagtggcacctaaattcattttactgtcgcgtcgtttaacatcgattttttttgccaaaaccttgccgtttccggggctgggtaaccttgtggcgcttcccacttttagccggtttggcgtacttgcgactttggcccgcactggtggcccttcccaaaggcctgccccgcctgactgttcccatgggt

SEQ ID NO: 57133 - DNA, 609 bp, Triticum aestivum
  Clone ID: PAT_TA_57133
ggaaattacagctatggaggggaggcaacagacaacccaaactcatagaaatagagatagtggtggatcttgaaggactcgagggctctctccctgctgttttcagcggcatggtatgcctccatgaactcccggtacttggccggattccttgcctcgtgcaccgtcttcggtgtcgggcctatgcggcactccatcttgggcatgacgagggtgccaccaacaaccttgctgctatggagttggtgaccacatggtgctgtgctcgaccctcgctcagcaccccattgctctcaatgactccgtctggtgcccaagttgatgacaaatgtatcgggtactgtgggactatgagccaccttctgtcaccctgggattgggagagcatggtgaggaggtgggggtcgcagtgtgggaagaagccaagcgtgacggtgacggtcgggtctgggcatggtgggtagtagttcacgatttatctgggtcaccccctcagcggtgagccggagcatgtctgacaaaacaaagtgcgtgcatgtacctgtaagtagccgaacttcttgccagcctggatgacatggttgaatgatctcatctaattatattttt

SEQ ID NO: 57134 - DNA, 504 bp, Triticum aestivum
  Clone ID: PAT_TA_57134
gccttccttgtgagttggctccaatttttctactgactatatcttctacttttttctttgtgaatcctatgaaatggtgtaagtgaatgcattatggttattgtgtatcatatcaacagacatatgttcaatcattataagtggaaattgtggttggatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggaaatttaaggaataaccaattttaaccggcgttgaagaaaatccattttttttttaattggggcaaaaaaaaaaaaagccgggcccggtgttttaaaaccaacagttggggaaaaaaactggggattgcacaattaaattgttttggaaaataaacccttttgccgggggggggt

SEQ ID NO: 57135 - DNA, 703 bp, Triticum aestivum
  Clone ID: PAT_TA_57135
cccacgcgtccggtcgatacttcctttttccatgtattgcacggtcgaggtctctaccaaggataccctccctagggtgttccgcaacttcgtggactgcgtctgctcgcccaacgccagtggagatccgctgctgcaacacctcaaggaagcatcctgcaacacggcgcaacggccgcaggattgtccttcaggaactcggcacctggacctaggcagggcaacgtcgtctgtgctatccttgtcatcctggtccatgcttccttttttcgaagtctgcgtggtcggggtctatggcaagggcgccctccctggggtattccgcaacttcaaggactgcatctgctcgcccgacgccagtggagatccgctgctgcaacgcgtcaaggaagcgtcctgcacggcgtagcggccgcggggtcatccttcaggaacttagcgtgcgacctgctcacctagacttggtggggcagcggcgtctgtgctatcctcgtcatcctggcgagtcatacttttcccatccatctgtttggaaacggaaaagctgtattacttcgttcattcgtctatctggaggtcctagaaattgaggcatgttggatgcagtattggcggctggattaattgtgctgagcaccaccaatgtttttcttgaaaacatgtttgcatgcttctgtacagttaaatgatgtgcttgcttgtt

SEQ ID NO: 57136 - DNA, 170 bp, Triticum aestivum
  Clone ID: PAT_TA_57136
tgcgtgcgaacgaatccataactggccggaggggtaagtccatagaatggacagagcatataatttgcatcgaactaattcgcctgcgggaagacattgatactctgtgaaagggcagtatactacccaagctggaaggtcaaggggaaaaagatcacttaggcttacta

SEQ ID NO: 57137 - DNA, 539 bp, Triticum aestivum
  Clone ID: PAT_TA_57137
gggggccacaaaaaggggtcataattcaaaaagctctttcaatttttaccctggaagggtaccccctaccactgatactactactaggaaaaccgctactactactacttgggaaacaacacaggtgctactaggcaacaaaaaaaaacaaagccgttaagctggcacaaaaaacaaaaacagctggtgcagctgcatcatcgttcattcattcattattgaaaaactaatccgccggaaaaactaccagaaaaaaacaagggggagcaggcaaaaacccccaaacatctttgcctgcatgcttgcttgctaaacaagcagcaagcgagcaaaacacccacactcgggaacccccctaaactcttttctcttctcttcccccctccccgcttggtggtagctagctagggggggctgggcccgcctggatcacccgaaaatgaccccggaggaaagggccatgaggaggaaggcccgtttttccttcttgcccaaccggggcctgggccccatccgccgccgttgttttaacaccccct

SEQ ID NO: 57138 - DNA, 447 bp, Triticum aestivum
  Clone ID: PAT_TA_57138
gccaacactacagcactagcacgagcgagcaagttccagagaagttcgaccacagcgcgcgaccatgtcgtcgaggcaagaccagcgcgaggcgagggccgaggccgacgctcgccgcgcggcggacgagatcgcgcgcgcgcgggacgagcgggtgatgcaggcggagatggacgcgcgacgcgcggcggacgagatcgcgcgcgcccgcgcggaccgcgagcacggcgcactgggcggcggtgcctacgccgagcacccgagcggcggcggcggcatcctggggagcatgcaggagggcgccaagtccctggccagcgcggtcggccgcacgttcggcggcgccaaggacaccgccgccgacaagacctaccaggcgggggacgccaccggaaacacgatggacgagtacaaggactacaccggcgggaaggccaatgggaccaa

SEQ ID NO: 57139 - DNA, 709 bp, Triticum aestivum
  unsure (1)..(709): unsure at all n locations
  Clone ID: PAT_TA_57139
gctggtctgaatatctaaacaaggaagcaggctcagttgctcaccaacctactattgctgccaacaagtagccagaagcccatagaagacatttgcattgatcacagaaaaatgaagtattgaatttgtaggacattgtcatcctaatctggttcccacatattcaagatgtggagattagatctttgctccaacaaagccatgaccttcaattttgttgttaatttaacagctgttttgattgtgccgatcgatcggcttataagagccaatttggtttcttgtgaactagagcatcctatttttcatgattatattaagagcttcctatttttcatgattatattaagaactcacagatctccttcacagccacacctaacctgcacatcatctagattcaagagagccctactactgcatccatcctaaaatcaatgtaaaaacaagggaagttctaacccgatatctccgtctcctatgaacaaattttaagcccgattgatggcaagtgcattgcatgtgtaagtaatctgggttgaacgtacttgaggtcttccatcacttttattacttgaatagaaattgtgcacattgcacgaactacccattaatgggcagctgatatatatgatgcttggttcataatagctacttcaagttatcccttctgctatatttntcgtactccctacttttgcgagatctg

SEQ ID NO: 57140 - DNA, 550 bp, Triticum aestivum
  Clone ID: PAT_TA_57140
gagaagagaagagaagggagagggcggcgacgaggacgctcgacgggacggacactccgaacgctctggcagtgcatgacgccaagactcgacttcggaggtgacgttgagcatggcggcgtggtggtcgacagcgggcgccctagtacaaagcagtggcccataccacagactgacggggagaaccactcaaagacggttctgcctccttcgttgcactactccaagagcgcgtccccgacgggcttgctcgggaaccactcaagggagttgtcctactgcagcttctctggaaaggtccattacgcacgctcgtcccggcgcgtactcgcagggggacgcgtaaagtgcgcagggggctacggcggggtcgtttaggtggttccctcatttctggatgaaggaggcggctatccaggaggaggtgttactcatggaggacgattacgactccgacggacgggtcggcggcttctccgcgctaaccaagaaggtgcgctacaggctggacttagtggcccacttccttgagctattgaccttcttcgtt

SEQ ID NO: 57141 - DNA, 731 bp, Triticum aestivum
  unsure (1)..(731): unsure at all n locations
  Clone ID: PAT_TA_57141
cccagatgcgcgccatcgccaagctccgtcacggcaacatcctgcgcctccgcggcttctactggggccccgacgagatgctcctcatccacgacctggccgccaatggcagcctcgcaaacgcctccgtgaaaaggaagccggggacgccgccgatgaacctcgggtggagcgcgcggctgcgcatcgcgcgcggcgtggcgagaggcctggcctacctccacgacaagaagtgcgtgcacggcaacgtgaggcccagcaacatcctcctggacgcggacatggagccgctgctggccgacctgggcatccaccggctggtccgcggcgccggggacagcaggctgaagccggcggggcggttcgggagcaagcggtccgccaagagcctgccggacctgtcgccgccaccacccggagcaggaggggcgagcccgctggccggcgccgggccttcctcctccgccgaggcggcggcgcactaccaggcgccggaggcggccaagaacccgacgaagccgagcgccaagtgggacgtgtactcgttcggcatggtgctgctcgaactggtggccgggcgcgcgctgacgagcgtggagctctgccagtgggcggcggnggagggcgagggacagnaggcgttcctgctggccgacgcggcgctgcgggggggagatggagggcaagggagaagaccctggcgagctgcctgaggctgggggttcgcgtgc

SEQ ID NO: 57142 - DNA, 637 bp, Triticum aestivum
  Clone ID: PAT_TA_57142
gccgctactctgcttctcgaactgccgcttgaggctgtaactctgtgggtgcgaccaccaccttctgttgcatccagtgcacacccttttttgcttatagtcatggaggccaagatcacctagtaattgttgtgactcaatgaccatcaagaccgacactgccccgaaccacgtcgtcttgccggattgtcaagaccatctcggttttcgcaagtaccgctatgcccgaaggcattggatgcaccaagtttcactaccatcgccaaaacttgagacgaagtacccctacagttcatcgagaacggcaaatcacaaaaccgtcctggatatcgtcaagtaccacgacgaccctcgaagagttcgctttcgtcaagttctactaccgtggcatgaaccactactctcacgatgtcgtgtgtacccctactgtcaccccgaagacgttggagtcatgaagtacctctccgaacgaacgtgaaccactacttccgctactatcgaacccaatccgctccgaaaattaaaccgtcctgcatattgagctccacttaaattgtagtattgtttgttgcaccttgccatggcatgtctctttaaaccggacatgcatgattgtgcatcatgccatgtttatgtg

SEQ ID NO: 57143 - DNA, 612 bp, Triticum aestivum
  Clone ID: PAT_TA_57143
aagaaaaaaaaaggaggggagcagaagaattatttctcttgaaaagaatagtagtattaccaagatgtataaaatcaaacatgtttctccaattagaacatcttatttgcagcgtaaccctgtcaatgcctggaggtgtgtcagctagcaacttgactctgcaacagcacctgattttgctcggtcatcttcgatcatggctttgatgtaaaattcgcctgctttgtaagaggaccgaaccatcggaccagatgcaacataacggaatcccatttcaacaccaagggcgcggtagttctcgaaggcttcaggtgtaatatactcagacactggcatatgtcgctttgacggcctcatgtactgaccaaatgtaatgacatcaacaccagcagctcgcaccttttccattgtgctgatttacctgatcaggggagtggccattttgctgaaacagtacagaggttgaagactttaaagccagatatgcttattgaagcgcttgtacctgatttccaaggagatcgaagttgtgtagaaaaggtagcaacttccggtttgcatgtttttgcacacaatattgaaacgggggaagagctttaagaaggggggaga

SEQ ID NO: 57144 - DNA, 631 bp, Triticum aestivum
  Clone ID: PAT_TA_57144
gaacgccacggatatgttacaaggtttgtgacttcagcagaattggctctagttttcaacatgaaaaatacaaagaaaaacgtcacaacgtaaagattgaagtgcgccatgaaggcagcgaagtttaccagggttttctggcaacctatgatgtagattacaactattctgttgtcaaggtcaagaccttcctggatgttaatgttggacttattgaacatgcggtagggattctgcctgatggtaaggtggtagctctagggcgtggcacctgtggtgaactaatggcaagaagtgtgatgctggctgacgatctgagtgtgtgtgaagatattaaagatcctgtgtcgtctatgcttaatattacaaaggtacagttgcattatgatatgagcattttaatctgtttctgttgtgcgctaaactgtatcttcgaaggcaatagaaaaatgcatttccctatttaattcttgttcaatatcacttcattttgttcaaatgtaacctttgttgtctgtcaccttttatttgagttaggcttggcaaggtgggccacttttttcttttgatgggaactttgttggcatgaacctttttctcattatggaaagagcttttttcctacatgggg

SEQ ID NO: 57145 - DNA, 472 bp, Triticum aestivum
  Clone ID: PAT_TA_57145
gttcgacagatctcggttcactcaccgccggcggacgcagcgaagcgagggaggagcaatggcggaccgcgggggctacgtgcaggtgcagcacgggcagtacggcgggcagcagcacgggcgccagatgggcgagcagatgaagggcatgctccaggagaaggcgccgtcggcgtcgcaggcgctgacggtggcgacgctgttcccgctgggcgggctgctgtccgggctggcgctggcgggcaccgtggtggggctggccgtggccacgccggtgttcctgctcttcagccccgtgctggtcccggccgcgctcaccatcggcctggccgtcaccgggttcctcacctccggcgcgctggggctgggcggcctctcctcgctcaccgtgctcgccaacacggcgcgccaggcgttccagcgcaccccggactacgtggaggaggcgcgccagcgcatggccgacgctgcc

SEQ ID NO: 57146 - DNA, 626 bp, Triticum aestivum
  unsure (1)..(626): unsure at all n locations
  Clone ID: PAT_TA_57146
atcgaatttgaggtagatggaccatacaaggccatgattctacctgcctctaaagaggaagggattctgataaagaagaggtatgctgtcttcaatgaagatggaaccctggcagaacttaaaggctttgagattaagcgtcgaggtgagctgaagctcatcaaagtttttcaggcggaggtatttgataaatttctccatggctctactttagaggagtgctatgcagctgttgcctctgttgctaaccgctggttagatctactggacaatcaaggaattgatatttctgacagtgagttgcttgggttcatatcagagtcaagcacaatgagtaagtcccttgttgactatggagaacagaagtcatgtgctgtaactacagcaaaaagacttgcagaattccttggagattcaatggttaaagacaaaggactgcactgccaatatatagttgcacgagagccacaaggcaccccagtgagcgagcgtgctgttccggtggctatttttgagacagatgctgaggttgcaaagttctatttaagaaaatggtgcanagtctccacggaagcaaacatccgatttattcttgattggtcttactacaagcagcgcctaagctc

SEQ ID NO: 57147 - DNA, 578 bp, Triticum aestivum
  Clone ID: PAT_TA_57147
ggggaaaaccgataggaaaccttcctgtaatggccgcctccccttccagggcgttagggtttaactccaacttctcctagatctctctcaccgcccctctcctcgatcaggtactgcagcacctggtagcctcatggggtacctgcaggaggccagggagaatcacgtcaagaagaaggtcgaggaagctttgcgcagcaaaatgaaacaaaaggccctcaaggaatgtgatgtactgtgttcaaaatacgctgaatgtgctcgaggaagaactttctctgtggtttggacatgccgcaagcaagccaaagagttgaataactgtcttcatcaattcaccaatgatgcaatactggaagatatgaagaaggcttacatggccgaggaagagagcaaggagaagaacaataatctttatgcatccatgcctgtatgtacactgctgcttttggaatttggcagttgcttactggttatcttagttgattgatgctgaattcctagagaccttttgtgaacatttgggtttgtccagatgcataacctggtatgatctcaaggaatccatgtattatttt

SEQ ID NO: 57148 - DNA, 680 bp, Triticum aestivum
  Clone ID: PAT_TA_57148
gaccgcgcccatcaccaccaccacccgcctgacggagcccttccctcccatcggcggcggagatggtggggtggctcaaggcgctggtgtacggcgcagggggcatggcggtggtgggcctggcggcgctggtggcgctgcaggagcgcctcgtctacgtgcccgtgctccctggcctccctcgcgcttaccccatcaagccctcgcgcctccgcctcatctacgaggacgtctggctccgcgccgccgacggcgtgcgcctccactcctggttcctccgccactctcccacctgccgaggtccgaccattctgttctttcaggaaaatgccggcaatattgcacatcgtttggaatgcgttcgactaatgatgcagcggctacagtgcaatgtgtttatgctttcttatagagggtatggtgagagcgagggttatccttctcagagtggcatcacaaaagatgcacaggccgcacttgatcatctagttgagaggaaggacattgacacatccaggatagttatctttgggagatctttaggaggtgctgttggagcagttcttgcaaaaaacaatcctgacaaggtgtctgctctaatattggaaaatacttttacatctatattggatatggctggtatcatgctgcccttcttaagatggttcataggcggtagt

SEQ ID NO: 57149 - DNA, 374 bp, Triticum aestivum
  Clone ID: PAT_TA_57149
ctagttctagatcgcgagcggccgcccgcgatctagaactagatacatgggaaaatgaaaaagaaaggggctttctttttgcaaatcaatgaaggaaaagacttaaccacgggctggattcggtgcttgcggcgcccacaccaccatcttcggctctctgcctactgcatacggtgtcggtccaggtacacactgctcgaatcgctcctcattggctcccagcggtgaagatctccatgcctcccgtttgaattttcagttaatttttttattgaacttgtactactattgattcagacctgagggaagaaggcagaacatctctcttgttggcagtaattttgctctctcatctccatcttcctttgtcaatc

SEQ ID NO: 57150 - DNA, 649 bp, Triticum aestivum
  unsure (1)..(649): unsure at all n locations
  Clone ID: PAT_TA_57150
gagagggtcaagggaaccgtgaagtggttaacgtcaccaggggttcggcttcatctccccggacgacggcggcgaggaccttttcgtccaccagtcctccatcaagtccgacggctaccgcagcctcaacgagaacgacgccgttgagttcgagatcatcaccggcgacgacggacgcaccaaggccaacgacgtcaccgcaccgggaggaggggcgctctccggcggctcccgccctgtcgaaggcggtggtgaccgcgggggccgtggcggctacggaggcggcggcggtggctacggcggcggcggtggcggctacggaggcggtggtggcggctacggaggcggtggtggcggctacggcggtggcggtggcggctacggtggcggtggctatggaggcggcggtggcggcggccgtgggtgctacaagtgtggcgaggagggccacatctccagggactgcccccagggcggcggtggcggctacggcggtggtggctacggaggaggcggcggcggcggcggcggccgtgagtgctacaagtgcggcgaggagggccacatctncagggactgcccccagggcggcggcggcggcggtggctacggaggcggtggcggccgtggtggtggcgggcgcggtggc

SEQ ID NO: 57151 - DNA, 681 bp, Triticum aestivum
  Clone ID: PAT_TA_57151
atttaatcttccatttcctgtcatctgatgcaaatatttgtgctgtacttcaaactttgatagatgaaaatgttgctgattatgtattcgaggttctgaggttatcaggaaataatgatccactggtaatttcctctattcaagtactatcacttttagcgacttcagaggagatgttcaaagaaaagcttgccattggattttctactctgctccctgttcttcattatgttactgagattccatttcatccagtccagtctcaggttttacgacttgtttggacttgtattgctaattgttctggtattctgtcgttgtcccaagaagaacagatagcatgtactttgactctaattttgagaagaaatgacagtggtgaacttggaatgtgttctgaaacctttgctcttgtttgctcaatattaatagagattatgaggtcaccatctgctcatgatattcagaaactacctttattaattgaagaagcatcaaaacatgctatctcttcgacattacctcatgcgtatgactctgcatttctcgtaccacattccctttgtcttcttaaagaagcacttatattctgccttgaagggaatacagataagatttctgtcaagaaggatcttgaagatagcgtcattgaaatttgtggaacttatttactgcattggc

SEQ ID NO: 57152 - DNA, 644 bp, Triticum aestivum
  Clone ID: PAT_TA_57152
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggaccaaagtttacgtccccgggcttgcaacgtaaaattttttttttggggcccccaaaattaaattcatgggccggggtttaacaacgtggggatgggaaaaccccgggggttccccaattaaatcgctttgaaaaaaatccccttttccccagtgggggaaatagcaaaaaggcccgccccgatcccctttccaaaaatttgcccaccctaaagggaaaagggaaccccccttgtaccggccctttaaccgcggggggggggggggttccccccaggggaaccgttacctttgccagggccttagcccccgttcttttggtttttttcctttctttttcccccacgttcgcgggttttccccgtaaagttttaaatggggggcccctttaagggttccaattaagggtttaagggcccctggccccaaaaaaatttgtttggggggagggtccacgtaggggcccttccccctgataaacggtttttcccctttgg

SEQ ID NO: 57153 - DNA, 626 bp, Triticum aestivum
  unsure (1)..(626): unsure at all n locations
  Clone ID: PAT_TA_57153
cctcgccccgctgtgcgcgctcgagaagattgactcgctgagcctgtcgtctgccgcgtcggtcgggctcgccgttgtttttgtggccgtctcgtgcatgatcgcggcggtgaagctagttgagggcaagctcgccgcgccgaggatggggcctgatttcagctcgaaggcggcaattctggacctgctggtggtgatacccatcatgaccaacgcctacatctgccatttcaatgtgcagcccatctacaacgagctcaaggagaagacgcctcagaacatgtacaatatcagccgcatctccaccgtgctctgcgtagtcgtgtacgccctgaccgccatctccgggtacctcctgttcggcgacgacaccgagtccgatgtcctcaccaacttcgacaaggaccttgggatcaagttcagcacggtgctcaactacattgtgaggatcgggtacatcgtccacctggtcctcgtcttcccggtggtccacttctcgctgaggcagacggtggactcgctggtcttcggtgagctcgcgccccacagcaggaagaggatgctctccctgacggnggtgctgctggccctcatgtacctggagtcgaccatgatacccaacatgt

SEQ ID NO: 57154 - DNA, 394 bp, Triticum aestivum
  unsure (1)..(394): unsure at all n locations
  Clone ID: PAT_TA_57154
ctcagatgctgacatgtattatgacgctggtgagacgatgttaggggaggtggatgattacctggctttaagaagaagagacatgtttggcatctacaatgtgattgattacctgattatagattcttaaatgttcngtaggtatttttttattgaatgttgatgctttaatgttggtggctgaggtgaggtaactggactactatctttgtgaaactgccttggcttgatatgtgttatagaacttttacaattgattcgcgatcggcgcactcaatagaatgctgtttatgaattgttgggatgagttatcccccgtcaatttttcttgttctccgttgtatgttgtgtgactgaactcattgatccaatctataagatgaactatgtaaaa

SEQ ID NO: 57155 - DNA, 637 bp, Triticum aestivum
  Clone ID: PAT_TA_57155
ggagcaagccaccccgcccgccgccgccggcatcgacctttccccggcggcaaccgacctcggccgggtgcacctcctgccctgcggcatcaggcacaacagcgccgccgccgtctccgactacttcaagccgagggacactggtgtggaggtggacggggtgaaggtggaggaggccttcttccgggggaggaacctgcagggcgccaccgtcgcgctccccgatggctaccgaggttctgtattggagaagaagaagaacgaagaaaaggatgctcagggcatggatgaggaggctagcaattttgtatcccgtgcagaattccagaacataacttactggaatcatgataccatgccatcagcggaggatcctctcccacggtgctttcattggttagccattgcgaatgcaatgcacaagccagttactgctgaagacatggctaacatgtcagccaggcagaatcagaacagttgaccaagatctattgcatggtgaatctgttatctagttccagctggtgcatcatccaaccaatctaataagcaatctaccaatacaatgaacttggaatgtcattagctgcgagcctgtgtgggccaggcactctgtgagggctgcgaacttggaatg

SEQ ID NO: 57156 - DNA, 639 bp, Triticum aestivum
  Clone ID: PAT_TA_57156
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaggggccccatttttccccccccggcctgccggggttatattttttttttggggcccccaaattaaattcccgggcccgggttttacccccgtgggacggggaaaaccccgggggtcccccattttatccccttggaaccactcccccttttccccggtggggtaaaaaggaaaaggccccccccggtccccctttccaaaattttcccccccttaatgggaaaggggccccccccttttccggcccttttaaccccgggggggggggggtttccccccaggggcccctttcctttgcccggccccttagccccctttttttgggttttttccctttttttttccccccttttcccggttttcccccgaaagtttttaaaggggggccccctttaggggccccatttaagggtttacgggcccctccccccaaaaaacttttttaggggggggggtccccgagggggccctcccc

SEQ ID NO: 57157 - DNA, 717 bp, Triticum aestivum
  unsure (1)..(717): unsure at all n locations
  Clone ID: PAT_TA_57157
ctgtgaaccattgttgtgcgattatatgatttgtggtatttgcttgagtgaacctgtaaggtttgtaccttctggaaagtgctagcacctacatattatccaaaaaaattctaaatgtcatgaggcatgagccacgatttttctcaacaacgacccttggtatatataaggcatgcatacaattttaataacactctttttgctctcatttatctgttggcatagagcatcgtataatatagaagattcattcaaacacagctctttgaatatcggaaaaaatattggttgcctgatttatttataagaagattcttctatgtatttagttacatgattttaatttgatcgtcttctttcaacttttttttgctgagtatgatatttccttaggttcaccttgaccttcactgctcgtgtaagagcttaagtaaattgatgttgtatcatcagaatctgtagccttgcacagtttttttgtctgtacatacacttcaatttctttctcgcactgaaatccctctttgtcacaggatgaatcagaaactgaagatgatgatcccatggacacagaagaagcttcctctatcctcatcgctgcactgcagtctttcagcaaagctctggtcaatcaacttcaactacgatgtgggaagtggaactattgttgtctgtcaattaagacagtcgggaacttggggttgncattcctggcta

SEQ ID NO: 57158 - DNA, 722 bp, Triticum aestivum
  Clone ID: PAT_TA_57158
ccccaaccccctccgagctgctcacccctactttctttccccaatcactccaccacatcgtctgaagatggaggaagcacagaccaaggcagcaacagctcagcgacgatccagacctccccctatccatctggtggtgccgtgcagagccaccgagcgggccgcatcaaggcgtctggtggagtcgcgccgcggtggctgaggagctgtgcccagtcgctgtcggtcccaagccgccaggggatgcgccgtgccccttcttcaccgaggggcccgtttccgccgcatacgccgtcctcgacgttgtcttctccatcgacctcgacgggctgtgagccgcatgccccaccaggtccctccctaccttctactacttttgattttttccggcttccctaaggattgtcgacgcgcaggcaacgtcgagcatgtgttgaggcaagatactggctgatatggttctcgctccgatgagcatggatccgcttactcagtagcatggatctgggcgatatggtggaggatatggcatctcccttcgatgccgtcggagaagatggctagatctacgtccagaagggcatgtgaatgtgcagcataaaatctttctgtacaaaaattgttagtagcacaaatttgttgtctggaatggtgttggagcgttctcgtcggtcaagatcggctactcaaaatattatttgttgtccgtcgagtgctgaaca

SEQ ID NO: 57159 - DNA, 510 bp, Triticum aestivum
  Clone ID: PAT_TA_57159
ataaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaggaagttttaaaggatcaaaagtttaagggggggggcttgcgagggattaatttttttttggggcgccttaatttaaattcgtgggcttgttgttttacaccgtaatttattggaatagcccggggtttaccaaatttttttgtgttgaacccttgccttttttaacttgttggggtttaaaaaaataggccttttgggatgggcttttcaaacattatagggccccctgattggggattggccccccctttggaggggggttttaaaaaggggggccgccctgtttccccccatttaacccggtccctttgggggggccttagggccggcccttttagtttttttcctttcttttggggcgtttttttcgtttttcccgttcttttttaattggggggctccttt

SEQ ID NO: 57160 - DNA, 687 bp, Triticum aestivum
  Clone ID: PAT_TA_57160
ggcgagcagccacagtccttcttcagcgtcttcagcgacgaggttatccaggcggcattcaacactcgtcaacatcacccggggctcgatgacggcgctgagatacgccacccggtcgaccaggatctacatcgtcgtggaggggcgcgacggctacttcgagatggcgtgcccgcacgtctccagcttcggccgttctgagcgccgggagcacgagcaggagcgcgagcgcgagcacggacacggcaggaggagcgaggagcgcgagcgtgagcatgggcagggcaggaggagcgaggagcgcaaggacgagcagggaagacaggaggaggagcagggccgcggccaggagcaggagaaatcgaggggctacaggcaggtgagggcccagatcaaggtggggtcggtgatcgtgctccccgcgggccacccggcgacgttcgtggccgggaacgaggggaacctcgccctgctgtccttcggcgtgggcgccaacaacgacgaggaggtgttcgtgaccggcgggaacagcgtgctgaagcagctggacgacgcggccaaggcgctggcgttcccccagcaggcgagggagctggcggacagggtcatccgcgcgcagccggagtccgtgttcgtcgccggcccgcagcagcagcgccgggtcgccgacatgtgagcgacgatctc

SEQ ID NO: 57161 - DNA, 612 bp, Triticum aestivum
  Clone ID: PAT_TA_57161
aaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggcccttttaaagaacccaattttactgccccatccttgcaattactaaatttttttttggggcacccaaatttaatttcacgggccggcgttttaaaacggagggccgggaaaacccctgttttacccaaatttaatccctttaaagaaaatccccttttccctgtttgggttaataaaaaaaggccccgcccgtttcccctttccaaaaattcgccccccttgattgggaattggacccccccctttacggtttcttaaatcccgggggggggggggtttccccccagcgtgcccttttcttttgccagggccttatccccggttcttttggtttttttcccttcttttttgccccctttagcgggttttccccgaaaagttttaaatgggggcctccttttagggtcccgttttagggttttagggcccttgaccccaaaaaattttttttggggtgtgggtccactttggggccc

SEQ ID NO: 57162 - DNA, 476 bp, Triticum aestivum
  unsure (1)..(476): unsure at all n locations
  Clone ID: PAT_TA_57162
gacccacgcgnaccgggaaccccctttgcaaaanncacangcgcgggggcgcgcggagaaagcaccaaccaccccaaagaaaaggaaaaccgccgccaggccaacgncagcgaagggaacgaccccggaaaccccaggagacgngagaacgcgcacaccacccngcgncaaaanagcggcacgagaaaccccggaacaccggcggggggggggggcncaccgaggacagagcaccgcagggcaaaagnggaccngccccgaacaaacaaagcnacaagcgcccgcgacccaggagcagggcangagccaccaacaaccaaaggcggggagacaagcagagcagacggncgacgcgccccacagaaggcagggcgggcagcnnnccgngcacccccgcaggcccggccacngcangaagcccaaggaaccgaaccccgcagaaaagggaagcnagagaaaggcaccacgcccgcaga

SEQ ID NO: 57163 - DNA, 628 bp, Triticum aestivum
  Clone ID: PAT_TA_57163
aaaaaaaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaagaaacaaaaaataaaaaaaaaaaaaaaaagggggggcccttttttaaggttccttattttccttgcggggggtgcccctttttttttttttttttgtggcccctaaatttaattcgatggccctttttttcacacgcgcggcctggaaaaaccctggggctcccccttttttttccctttaaacacctcccctttttcgcctttgggcaaaaagacaaatagccccgccagagccctttttccaaatttttgccctctttttggtgaatttgtaccccccttttacgggtttttttaaaccgggggggggggggggttccctccagggggcccctttaattttccagggcccttaggccccctttttttggttttttcccttttttttcgcccccggtccgcggttttccccgaaaggttttaaagcgggggcttttttttggggtccctttttagggttttagggcccctcaccccaaaaaaattttttgggggggg

SEQ ID NO: 57164 - DNA, 300 bp, Triticum aestivum
  Clone ID: PAT_TA_57164
tacgcaccgtgaagcggcctattaagcgccattaatgtcgtggttactcgcagcgacaccgatacagtcggcagcgctctacagcgcgctactttcggtttctttcgtttctttctcttcactgtttggcgactttccccggctagctctaaatagctggctacctttagggctctgaatgagtgctatacagcgccttaacccaaaaaaacttgattaaagtgaaggatgacgaagggtgacatagcgctgattgacggtgattgacgctttgacgttgtaggacacgggattaatagt

SEQ ID NO: 57165 - DNA, 555 bp, Triticum aestivum
  unsure (1)..(555): unsure at all n locations
  Clone ID: PAT_TA_57165
cgccccggcatgcgggccgcagtggaaagcggcatccggcgtggtagtcactgttcgccaggttccggcacaccccccgtcgtcggtacgctcgaccacgcaagagggcttcaaccctgtgcaccacgcgggagcagcatccacgctcggacccgtcctcgccgggctcctgttcgtggcgcgcaatgacgtagcggccagccacagcggacgccctcgtctttcccaggagtgccacaacgtcgccgacgcggcaaggcacgacctggacgctcgggttcgggctatccccgctcctcgacagctccacctctgtcatcacgggagggcgactcgacctgngtgatgaaggtggcgagggccacggcgaggaggacatcaatgccgtgggcctcacgggagcaagatccgcgctcggccttgtccccgtcgagttcccatcgtccgtggcacaagctctactcgcggccaaccataacggacaccgctgtctcttcacggattgccacacccgttgtccgcgccggtggggcacggtttgcccggccggggcgc

SEQ ID NO: 57166 - DNA, 622 bp, Triticum aestivum
  Clone ID: PAT_TA_57166
ctccgtcgccgcctcccatcagccgccggtcatcacaccgcacctcttcctccccccagccgccacggcgcgccgccccggccgggcggttcctgccccgattggacgccgtgagcagggggagacatgatttacacggcgatcgacacgttctacctcacggacgagcagctgcgcgagtcgccgtcgcggaaggatgggatcgacgaggccgccgagacgaccctccgcgtctacggctgcgacctcatccaggagagcggcatcctcctcaggctgtatccttttgtcccccgcctccctttgttcccggattttgcaagttcatgagttttctagggtttggtgataaacttccatgggaaatcgagcacattcaaacgcaagttttgcgtgcattaggcttaggattcgcttagggttacatagatgaaacacagctcatttgacatcttcaaataggttggttcgaaaacaaagtttttctttttacttcagtgtattagcaattaattatagcatgctgaatagcatagagagttgatgtcatctgcaatgtaatttggctaccaaatcaatgaagacgtggcttcataatagttgataatacactaaagtaaaa

SEQ ID NO: 57167 - DNA, 543 bp, Triticum aestivum
  Clone ID: PAT_TA_57167
aaaaaaaaaaaaaaaaaaaaaaaaaaaaaaaaaaaaaaaaaggaaaaaaaaaaaaaaaaaaaaaaggagtaacgaacaagaggaatgcaaaataaaaagcgcgggcatagtgaaaaggtaccttcttttacctggcgcgtctattgtacagcgctcgggtctggtttagggcctggcgaataccaagtctaaatggcgggggttaccaatccccctttgctgggaagaaccttgtcgcttcccaggccttgtcggattggcgattaccacccttttcgcaggctgtttggaaaatgggacgccccctagtggggacctttacgcgccgtggacgtgctgtttacgcgcagggtgtgccccttttttgcgcgcgttaatcgccccgttggtttgggttttttcccttgcttttttgccattttccccggctttacccgccaagctttaagttttgggccctctttttgtaaccaagggtggtgcttttcggcccccaagccataaataagtggctccttgtgggggtccaattagtgggttatc

SEQ ID NO: 57168 - DNA, 448 bp, Triticum aestivum
  Clone ID: PAT_TA_57168
gctcctttccccgccgacgacgacgaacgacaggcggcgcctatgtttaggacacacgatctcctgcgcgcaccatgcaggagctaattcatctgtattcagggacttactgctagacggactggccgaaggactacaccgcggtgagtgtcaaaacgatcaaggaccccaacttattcaaggtgcgctgcatcaggttcttgtacacttctgagtacacgacaaggacaaggccaacaggctttaccaacacctgcccacactgtatgatgaacagggacgcttcccaggcatgaagccttatcatgcctttacgaggagcgtacatgcaggatgaacgatccactgggcagagccctagagcccgctatttgtattttctacactgacttgttatgcacgggacctgtgttgaccctatgatatttaacttgctggataatttaaa

SEQ ID NO: 57169 - DNA, 588 bp, Triticum aestivum
  Clone ID: PAT_TA_57169
gcggtaactaaactgctactaaaaaagaaacacaagatgctggagttttacccaatttacagtattgcatgtttgtctatgtccaacatttcactgtatagtgaaattcaatttgtgtattccaggatttcattttgaataaactaactcatgttgttgtgttgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaaaaaacaaaatttaaaaccccggggttggaaagtaaaatttttttttttggggccccaaaattaaattactggggcgggttttaaaaaagggggggggggaaaaacccgggggtaccccaaattaaaggctttggaaaaaaacccctttttcccagggggggaaaaaaaaaaaaagccccccccattccccttttcaaaaatttgccccccctaaaggggaaaggggcccccccctttaagggcctattaaagggggggggggggggggtttccc

SEQ ID NO: 57170 - DNA, 537 bp, Triticum aestivum
  unsure (1)..(537): unsure at all n locations
  Clone ID: PAT_TA_57170
gccgccgcccgtcgaggtgcgcgcaggtaagcaggggcggcgcaaattggcagccgcggctcaggtgggccttcgtcgccggctgaacaccacggtggctggggcgtgcggtgcagcggcgagggaggtggaagaagcagacggttgcttcgagttggattaggagccgggaaaggaaagagttgcagtgttgcccggcgagggtctcaaactctcaattcatgcttaattaagctttggcgcgaagcttcaaatgcacgcaagcaaatccgattttctcacggatcacatcacatacgcatccacggtttggaatcggcctgagctcatcaataaaagggaaggcagccaacctgctgcctttgccctcgcctcgctctgacttctcttctcgcacttccgatcttccccatcgtctccttcaccaatcaccagcccttacccagcgaagcgaccggcgtcccctgttcccttcccatggagattgcctacccctacggcgggngagctcaccaggaagcacggctccgtgacagg

SEQ ID NO: 57171 - DNA, 538 bp, Triticum aestivum
  Clone ID: PAT_TA_57171
cacagtttttgcgaattattactttctattccactcagcttcctggcccaaattatcactgtcgtgagggctcgaaactggccactcttccaccacccaaaaatgttcttgaagtgctcctgatcaactttcctcgtggagtgctttttggctgtggtgatctgatattttcatctcacatgatctttactcttgtgtttgtccgtacataccataaatatggatcaaaaaggtattaaaatatctgtgtaggtgtttgtgcctgtaacatgtgcatttgatttcgcataggtggcatgctagcccataccctgatcacatgctctagtataattggtggatcttgtttctctaggttgattaagctatttgcctggttgatggccatcatccaaagtctccttatcattgcttctcgcaagcactacaccgtggatgttgttgttgcttggtaggatcaaattccatttcaataatataattatattgcatcggcatgtgccttccgtttgacagatcctctctccgcaggtatact

SEQ ID NO: 57172 - DNA, 578 bp, Triticum aestivum
  Clone ID: PAT_TA_57172
tgacacttcattctctgaattaacaaaaacagcaagtggttccacaatcttccagaaatcttccctcaaagccattagaaaacctttcatgccaatgcagagaaaacggcttaaggcctgcaactgcccagcagaaatgatcaaatcatcgtacagggatgcttgctttcggcgcccgaaaaaacatgctggcgagactgattcctcaggagaggaagagaaagagaacacgagggattcttgcggctctgtgctaagtgaagtaacttccgctcccaccgcaagggatcagctaaaatataacctcatagtatgcaaacaaatggttggaatttttgtcactgtgtgggtaaagaaagaactagtgcaacacatcggccatctaagaacgtcttgcatagggcgaggaattctgggctgtcttggaaacaaggtcaggactaaatcagattgaagtattgctgtaactaattgtctgtatcctgaatacacttctactgcagggatgtatatcagtaagcatgacagtgcaccagacaagcttttgtttcatctgcagccatttggcttcaggtcag

SEQ ID NO: 57173 - DNA, 567 bp, Triticum aestivum
  unsure (1)..(567): unsure at all n locations
  Clone ID: PAT_TA_57173
actcctcacagtcgcagcatactctcagtcctcaccttcctcccctacgccaccatcccaccaaggaaaggaggatgtcttgctgcggcggcaactgcggatgcggcgccggctgcaagtgcggcatcggctgcggcgggtgcaagatgttccccgacgatgaggccaccgccggcgccgacgccatggtcatgcccaccgcctaccacaaggggagctccggcgggttcgagacggccggcggagagaccggcggctgcgactgcaccacctgcaagtgcggcacggcctgcggctgctcctgctgcatctgcaactgagccggcgcccagaacgccggccgacgaggccagcacgaggatgaagaggacaactggacaagcaaccaccaccaccaccaccaccatcactagccgctgtatgcgcccgcccgcgcgcgcgctgaataaaataaaaccgtagtgtgttccttaactctgtacctgaacgcccgtgctgtccaccagcagtgtccttgctcatgcctccaactctaatacatggcgcctcctcttggagacctactnt

SEQ ID NO: 57174 - DNA, 643 bp, Triticum aestivum
  Clone ID: PAT_TA_57174
ggccgccgccctgctgcacgtcggcgccgtgtgaccggcgacttcagcgttggctcgtcccgttgtcgaggcggagccctccaaaggcggttgatgagcccgaggaacaccggggaccacgtcccggcatggatttcggcggtgcgggccgccatggttgacgcgaagcggcggagcagcactcgtgtttccggcgagggcgtcggaagtccgagggacggcgccacgtatgcattctccggcgttgggagattgaggtcggggagagcccgaggggcgcgtgcggcgggcgcgacttcgacctcgtccgtcttcaccactggcgggtgcgcgtccacgagagccgcagccgacggcgagacgaactccgacacgggccatagctcagcggagcgaagtgctcgggatcctcgttggagggtgtcggggacgggagacactgtccgaagccgtggcgcaggtatgtagtagctgctgaattcgtgcttggggtcgtcggtgagccaatcggcgcttggtccgcccagcagccacgccatgcgcggaacggcgaacgccgacggtggaggcagcagttcgtcagggtccgcggtgacgttggaggcagaggccttttagtattcgtcctcgacgacgaacatcc

SEQ ID NO: 57175 - DNA, 636 bp, Triticum aestivum
  Clone ID: PAT_TA_57175
aaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccctttttaaagaacccaggtttccttccccgggcttccaacgttttactttttttttgggggcccctaatttcattttttgggccgcctttttacaacgcggggccgggaaaaccccgggggttccccaattaaatcccttgggaacccatccccttttccccggggggcttattaccaaaaagccccgccccgttcccctttccaaccatttgcccaccctttttggcaatgggacccccccttttaggggccctttaaccccgcggggtggggggtttccccccagggggcccgttacttttgccaggcccttagcccccgttcttttggtttttttcctttcttttttggccattttccccgtttttccccgaaaagttttaaatgggggcccccttttggggtcccaattaagggttttagggcccctggcccccaaaaaattggtttggggggacggttaactttggggcccttccccctgttaaagggttttccc

SEQ ID NO: 57176 - DNA, 114 bp, Triticum aestivum
  Clone ID: PAT_TA_57176
gccacgcgtttgcctaatcgtacaacgagaactcccgcacgtcagggtcttcagggtctgcctattgcttgcgacacgcatcgtgacgcaagacctgcagagagaagcgtatgc

SEQ ID NO: 57177 - DNA, 702 bp, Triticum aestivum
  Clone ID: PAT_TA_57177
cgcggctgtttcggcctcccatgacgaggaggacgacaggcgcggtgggcactcgctgcagcagtgcgtgcagcggtgccagcaggaccggccgcggtactcgcatgcccggtgcgtgcaggagtgccgggacgaccagcagcagcacggaaggcacgagcaggaggagcagggccgcggccatggccggcacggcgagggagagcgtgatgaggagcacggggatagccgccggccgtacgtgttcggcccgcgcagcttccgtagcatcatccggagcgaccacgggttcgtcaaggcacttcgcccgttcgacgaagtgtccaggctcctccggggcatcaggaactaccgcgtcgccatcatggaggtgaacccgcgcgcgttcgtcgtgccaggactcacggacgcggacggcgtcggctacgtcgctcaaggcgagggggtactgacggtgattgagaacggcgagaagcggtcctacaccgtcagggaaggcgatgtcatcgtggcgccggcggggtctatcatgcacctggccaacaccgacggccggaggaagctgatcatcgccaagattctccacaccatctccgtgcccggcatgttccagtatttctcggccaagcctctcttggcgagtttgagcaaacgcgtgctgagagcggctctcaagacctccgatgagcgcctggagaggct

SEQ ID NO: 57178 - DNA, 591 bp, Triticum aestivum
  unsure (1)..(591): unsure at all n locations
  Clone ID: PAT_TA_57178
ccgatcggtccggtggccatggctaccagcagcagcaacagcaatccattcagcttcgccttgagggggctccgagaccgcgacggtggcaattgtggcagctactacagcatccctgacctaggcgatcagcgaatagataaactgccatacaccattcgtgttcttcttgaatctgcggtgcgtaattgtgacgagttccaaataaccaaggaggatgtagaaaagatcatgggctgggagaagacctccctggagcaagttgaaatcccattcaaaccctcacgtgtgatacttcaggattttactggtgtgcctgtccttgttgaccttgcaagcatgcgcgacgcaatgtcggaattaggtggcaatcctgataagattaacccgatggttccagcagatcttgtaattgatcactcagtaactgctaatgtggtgaggtcacaaaatgcgatacaggccaatatggaactggaattcgagagaaacaaggaacggttcgccttccttaaatgggggtcttctgcatttcacaatatgcttatcatacctcctggntctggtattgntcatcagggaaatcttgag

SEQ ID NO: 57179 - DNA, 481 bp, Triticum aestivum
  Clone ID: PAT_TA_57179
gcaaaaattttaaaaaaaaaaaaaaaaaaaaaaaaaaaaaaaaaaaaaaaaaaaaaaaaaaaaaaaaaaagaaaaaaaaaaatagggggaccggcttggggggcccagctttccaaggccttgctgttttgttccggactctttttttgttttactgggcgccttttttttgctaattgtttgggaaatccctgggggttccccttttttttttccttgcatttccatccccttttggcctggcgtgcgttctccctttttgggcccccccccgattggccttcccggccggtcgtttcccaaattggcgaatgggacccccctttttgcgcccccttttttccccttgttgcggtggctcctttcagggtggggggtagatttggcagggctttaccggccggttctttcgtttttttcccttccttttttgccttttgttccgttttttcctggggggtttttcccggggggccctttt

SEQ ID NO: 57180 - DNA, 643 bp, Triticum aestivum
  Clone ID: PAT_TA_57180
ggcccgagcacgaagccatttttgcatctccgcgagcgacttgagagggtgagatcggccttgcggcgtaggggatgaagcggctgctcgttcatggcgggagggcaatcggctgcccctccaggagcgccgtggaagatcccaccgccctggccgcgcttggcaacggcgttctactgcccaggtaccactcgacagagaagcacgacgacagtgacacgctgggcgaaatcggggagaaggcaagaacgacggcggaggagttcctgaagatggccaaggagaagaccgacgacgtcgcggagggcgcaaaggagacggtgcaggagaccaaggaagcggtgctcggcgagtcggacgacgagaaggacaagttcaagcagcgggtcgagcaggggaggtaccatcagaaataagcgggaggtgttccctttgctgtatgctcgcgtgcgtgcagtcatggcctgcccaaagccattagctctgcagtttgtatgtcaaccactaggcttggagtaaggtgctactgtatgcgtaatgtttcttcccccttcagttcagtggccttcagcactgcaatgggatcttggtgctatacaacttgccacttcccgcagaataaataatattgaacttctgaatt

SEQ ID NO: 57181 - DNA, 601 bp, Triticum aestivum
  unsure (1)..(601): unsure at all n locations
  Clone ID: PAT_TA_57181
cggacgcgtggggtcaatctactcttcctcccaccgccgccgccgccgctcgtcgtttaagaggccgcctccaaccgcagcgcaggatgagtgaagaggactcgacgagccggccagctccgaagctcaacgagaggatcctttcgtcgctgtcgaggagggcagtggccgcgcatccgtggcatgatctcgagatcggccctggggctccagcggtgttcaatgttgttgttgagatcacaaagggaagcaaagtgaaatatgagcttgacaagaaaactggactgattaaggttgatagagttctgtactcatcagttgtatatcctcacaactatggtttcattccgagaacactttgtgaagacaacgatccaatggatgtgttggtcctgatgcaggagcctgttattcctggttctttcctccgagctagagcaattggccttatgcccatgattgatcagggcgaaaaggatgacaagatcatagcagtctgcgccgatgatcctgaataccgtcactacaatgacatcagtgagctgtctcctcaccgnctccaagagatcaagcgcttctttgaagactaccagaagaatga

SEQ ID NO: 57182 - DNA, 585 bp, Triticum aestivum
  unsure (1)..(585): unsure at all n locations
  Clone ID: PAT_TA_57182
ggagtggaccaaggacatcgaggcctacaagcctgggagcaaggtgacgtacccgatcatggcggacccggaccggtcggccatcaagcagctcaacatggtggacccggacgagaaggacggcgaggggcagctgccgtcccgcaccctgcacatcgtggggccggacaaggtggtgaagctgagcttcctgtacccgtcgtgcacggggcggaacatggacgaggtggtgcgcgccgtggactcgctgctgacggcggccaagcacaaggtggccaccccggccaactggaagcccggggagtgcgtggtgatcgcgcccggcgtctccgacgacgaggccaagaagatgtttccccaggggtttgagaccgccgacctgccctccaagaagggctacctccgcttcaccaaggtctaggcgtgcgtccgtgctagctcggttacttgtggcggtctgtgtcgtcgtggtgcgtgcgtgcttttgtggtggtatgtgtcgtgtttcttctgtaaatctaccagcgtcgctgggctatgtatgtgtactgtgactntgccactttcatgtngtcgatcgccggt

SEQ ID NO: 57183 - DNA, 451 bp, Triticum aestivum
  unsure (1)..(451): unsure at all n locations
  Clone ID: PAT_TA_57183
gggatgaccgggacccatggcacaggccacaccggcacagggatgaccgggacccatggtacaggccacaccgccgggctcggcggcaccggcacagggatcaccgggacccatggcgcaggccacaccggcatagggatgaccgggacccatggcacaggccacaccgccgggctcggcggcaccggcacagggatcaccgggacccatggcacagggcacacggccgggtacgacgccaccggcaccgggatcaccgggacccatggcacagggcacacgcccgggtacggcgcgaccggcaccgggatcaccgggacccacggcgccgctggcacacaccctcatggtgggctacccgagcacaagactcgtggcatcctccaccgctctggcggctcctgctccagctcggtccctaggcngattccttgctttcttttggggtgat

SEQ ID NO: 57184 - DNA, 762 bp, Triticum aestivum
  unsure (1)..(762): unsure at all n locations
  Clone ID: PAT_TA_57184
ctggaacgttaaatgcatgcatagctggatttacgattctttgttttgtgcttggtttattaatcagccaaccagagattcctctccatgtgaatgtgatgttccctaagttgagtggagaaagtgcttactcactgatggcacttatgggcgcaaacataatgtcacacaatttttatgtccattcgtccattgttcaggtatttcacggtgtttcttgctcatacattgttaattgtccatgaatattgatttacatctgaaggtgcactagtgtcaaagttttccattaagaaaggtcatgttatttctgcaaatggtgatgcatgtactcatggtgagtcatatggagttgttcataatgaatgatggtagcaaaactagcattgtttattttctgctttttatgacgttgttaatacacctatttcaagattgaaaaaaccattaaaattttggttatggtggttcagagatattttgaaacatatcaggtgatgcatacttctttttccggaagatgggacaagagcactgtctttgcactttgcacacctgatgggatgtggatcccactttactatttattccttcttatttgaggtatcctttcatgttaatttgaatgtcatatatgcaggttcagagggctcatgttcatacactgngtgccctgtttcatgaccaccttttttcaatattatttacttttactggggttttttcttgtgaactatgttctgttgagctcagcagcagcgg

SEQ ID NO: 57185 - DNA, 594 bp, Triticum aestivum
  Clone ID: PAT_TA_57185
gccacttgtagtgttctccttccatgtgaaatacaaaatggcaattctatgcccctgttcatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaaaaaacaaatttaactaacccgggaatgaaaaaaaaaattttttttatagggcaaccaaaataaaataaatggcccgggttttaaaaacgtggaaatggaaaaaaccctggggtaaccaaattaaatccctttgaaaaaaatccccttttcccaagttggggaaaaaaaaaaaaggcccaaacaaatcccctttcaaaaaatttgccaaccctaaatggaaaaggaaacccccctttaaggggcaaataaaccccggggggggtggggttaaccccaagggaaaccgttaaatttgaaagcccctaaagccccgcccttttggtttttttcctttcttttctcccaagtttggcggtttttccccgaaaagtttaaaaagggg

SEQ ID NO: 57186 - DNA, 621 bp, Triticum aestivum
  unsure (1)..(621): unsure at all n locations
  Clone ID: PAT_TA_57186
cactcgccttcttgctctgctcaccgcgagcgcgcgcgtgcgcccggagcgccgatggccgccgcaatgccaccgtcgctgcccgccctcctcgcggcgctgctgctgctggtgacgctttcgccggccgcggcgcgcgtccccggcgtgtacaccggcggcgactggcagagcgcgcacgccaccttctacggcggcagcgacgcctccggcaccatgggcggcgcgtgcgggtacgggaacctgtacagccaggggtacggggtgaacaacgcggcgctgagcacggcgctgtcaacgaggggcagcgctgcgggggcgtgcttcgagatccggtgcgtgaaccagccggggtgggcgtggtgcctcccggggcggccgtccatcgtggtcaccgccaccaacttctgcccgcccaactacgcgctgccctcggacgacggcggctggtgcaacccgccccgcccccacttcgacctcgccatgcccatgttcctccacatggcgcagtaccgcgccggcatcgtccccgtctcctaccgccgggtggcgtgccggaagtccgccggggtgcggntcacgatcaacgggttcaggtacttcaacctggtgctcatcacg

SEQ ID NO: 57187 - DNA, 310 bp, Triticum aestivum
  unsure (1)..(310): unsure at all n locations
  Clone ID: PAT_TA_57187
taccgatccatttttgcctcctcccagtctccgtctccgcgtcactagcgcgctcgggagagagaggagtggttgcgcttccgtcggccccgtaccgcttgttggcttgcgcccttgtgcggagtggagtggttgctgcttttgcctatcgccactgccattgccggcattggggggcgggcggacgcacccacgcgcggttgacgggagtgacgtgacggcactctgcgcgtncgccttgttatatccaccccgcaccggtccgatcctcctcggcgacaacgagcgcggtcgggaggggttcgagggt

SEQ ID NO: 57188 - DNA, 667 bp, Triticum aestivum
  unsure (1)..(667): unsure at all n locations
  Clone ID: PAT_TA_57188
taaatctggtcatatgtgtttacttagtaataattttatataccctatgcagttttcagcacaagtatgatgttcctctttttaggtctgttattttcgttcctcaaaaaaacagatgcaatgctaaataagatgaatctatgacatttcttggccatgcacttgatgttctcatattaacaagttaacttgtttgatatatgttggtgaattcaactttgtgtacttattaccccctctgatccaaaataagtgtcgcagctttgaactaaggttagtatcttgaattgtttccttagactcaaggaagatgcttggcagatctttgtgaagcacttcactgtgatctgacaatggagttcaagaaaccaaagagtaaatgcaatgctgctgcagctgcaaggaaccgtcatctttgtgaggttcttattattttgtttgaactgccctaaaagattgccactcttgtaggcttgttgcatttttttttaccaatggaaaagctagtcaaatttggttgttgtacctgcctgaacgtaaacactagaagatgatcatgacacattatgagaactataaaagattgccacatatttccttggctttgntaattttgttgatatttggttgaaaaatataggcgcgatatatgcctatgtagatagca

SEQ ID NO: 57189 - DNA, 683 bp, Triticum aestivum
  Clone ID: PAT_TA_57189
cgaagttagtctctgttgcttctggtatgtcctatgttgatttaggcattacagaaatctattgggaaacacctcggattattagtatggtgtgcttttagtgtatgattctcaatgctaatggtgtgtatccttcaaacaattgctaggtatcaatttactatattactgcaaagaatgacgatgaggttgagttcatcctcttagagaagatgtatgctttagcaactcttttccagatcgcaattctacaaaaacataaagtcttgtggatgtgcaggccgaccgcggacgctttgtgctctccaccggccatggatgcatgctccagtacgctccactccaactcgccggataccaaggcattacgggatgggttagggtttgctgctggatccagcgtttttctgttgatggttgtcgtctgctcgtgctctctattgtcggactgctgggatctcccgttgttgtggttggctcgacagttatgatttttgtcgatggtcccattgcagttcatttgaagcaaaagaaaggcatgcagacttggatatccgattaaaaggtatacattcattgagttcaggagcggaatgatgtgccacctacaggaagaaactgtagtcaagaagaacgtgatcatttgagaagtacgataaggtacataacgttcagcctgaaat

SEQ ID NO: 57190 - DNA, 493 bp, Triticum aestivum
  Clone ID: PAT_TA_57190
cgcgctgcatgtagcacgccaagatgtactacatcggcgtgtgtccgtcctctgtggatctggcacgggcgcagcatgcacccacctgtgacgctttccgtagttcttgtgtgaatgaacaagatgccacaaatacatgtgaaaaaacataactacgaattatgatatgccatgtactcttgcatgctaatagaatgatacaattaacccaaaaagtaaaggggcgtatctgtctacaggatccacaactgacgtagcgtcgagcatgactactataatagcatgttgctataagagaaaacctaaactcaatcatcctgggcgacgttatcaaacgaggctactgtaaaaacaatgatgttacccacattaattggcttgctgaacattcaagtttccttcgatggaacagaacagacactacttagagagctgacttctttcaatagttatctaaactacaatggccaatgtatcaatggctgaacaattt

SEQ ID NO: 57191 - DNA, 592 bp, Triticum aestivum
  Clone ID: PAT_TA_57191
gaaagaggaagccttgccgagtttttctacatcatacaacctgccatggactctgatatactcctttcgcagaacgggtatgatggatgttgctctggactgatgattggacgcagatccctttggttgcctgatccatcattattgcattctaatttgaatctgccttgctctaactgaatattctattatccacaaaaaaagtgaatttgtgtatatcatcatgcaacctgccaatagactctgatactccttttgcatattgtgtaggttggatgttgctgttcatgaattccactggatggattctttcaagaaaaaaatccactggatggttcatattatattacaccccaacgcactagttgcctgatttatggttggtggactcatgctgactctagttctaaacaagttaaaatctagacctaatgaacactcgacttgattctacagttctaatatgcatccatggtacccaagtaccaagatctggacagtgcaaaggtgatgaagaggggaggagtctattgaattgaaagtagtactgtaactgtttccagcgatgcaagttttccctgaagtttaaggt

SEQ ID NO: 57192 - DNA, 373 bp, Triticum aestivum
  Clone ID: PAT_TA_57192
attctaggaaatagccaagaaacccagctatgtgtgctcagcatccagcaaatcctagctatcttcatctaaatagagagccagcgatcaaacttcagttcttacaagaacaaatgctccattgtgttcatgtcatttaagtacagattgacaggaatagaaactgacaagtgtttggtgatgatcggatgaagaaaatgtctcagtttgtttttgttttgtagcaacatagaaacaaaggattggatagttgtggcaaactgtagctagctagatgatgttttggcatttgatgtatatatgtgatgattgatatccaaagacacgtatattatttcttgaattggaatgatctaaattgttgtatttatga

SEQ ID NO: 57193 - DNA, 303 bp, Triticum aestivum
  Clone ID: PAT_TA_57193
caaaatgcggatgaggatggcgagcacaagggcaagggaagaatggcaaacccatgcagccacaccctaaggactaaatccatgtccggaagaggagaaggaaggttatagaaactaagagccacacccggagatcgcgcaattatgttcatgatgctattatttatcccaagtttgtcaattttgttcgtggcctgatgtttgatttactgctacttaattgctacatgagttaacatgacataagtatccatattgagcaataatttgaggtgagcatcaaaactgttcttgatgtttatt

SEQ ID NO: 57194 - DNA, 745 bp, Triticum aestivum
  unsure (1)..(745): unsure at all n locations
  Clone ID: PAT_TA_57194
agcatctgcagcaaatgagcaacgaggccaagagattgaagatgatactggcagatactgttcgcccatggaaaatgaaagagtgtcccaagcacataagcatgaagagaaacatagagacggccatggcgatgtagcacgtggatacaatggtaaaatcaagtccaggaagcacagatctgaacggcacgaaagtctggagtctggatgttctgattggccttcagaatttgctgatgcaggcacaagcagaagtccttcaggcagcaagtccaccaacaggtacaatgatcacaaaaggaaccggaggcaatcctcggatgatcccaatcttgaaaggggctactccgctgcggacaaatcatcggggaaagcacacattgccaaaagtagctcgagacattacgttgaagatgactcttgtggtgagaaaggtagtggaagaggcaaatctggaaagcacagtgatcattgtgatgaccccgatgatagatggctagcaacaaatagtgacgttgattcagacgcagaaactcaattcccgaggtcaagcagtggagttggtaaaggtggaaggaacgataacgctcctcctgatgaggatgattgttatcgaaggtccagcagtaggtctggtaggtcaagagcgaaggatgacaagagcagcaggaagaagaagaagcgtcacagtgaaatcaggaagaacagngatagcgacgaccatccctcaaatctaacgacgttc

SEQ ID NO: 57195 - DNA, 532 bp, Triticum aestivum
  Clone ID: PAT_TA_57195
gaggaaaataaaaaaaaaaaaaaaaaaaagggggcggcacgaatctaggggagtccaggtcttacaggacgccaagcctgacgacacgcatagcatgtcgtatagagacacctaaaataaagtcactgaacgtcattttacagcgcggcgactgacaaaaaccctgacgggaaaaaccttaatggcaccgaactaaatccccttgtagcaaattggcgttttaccaaataggccagtaccgaacaggcttgcaaacagcggcctacccaaaatgggcaaaggcacacggcctaaagggacgcaccatgcacgggggcagtaagggctacgcgcagggtgaccactacaattgcgaccgctctactggccagtgctttagctcccgttcctttctttttcttcactttcttcggcttcacccgtgaagctttaaaccgggggcttcttttaggggggctacctataggtttacgatacattgatctaaaaaaacttgaccagagagaaggtgaacagggtgaggcatcaccct

SEQ ID NO: 57196 - DNA, 719 bp, Triticum aestivum
  unsure (1)..(719): unsure at all n locations
  Clone ID: PAT_TA_57196
acatatgcaggtctttggaatctgaaacttctatgtggtgatgagcttctgctcatcttgattgattcatctccagtgaaggaacacagagttgtgcagccggtggtgtcttgaccaagggttgttgtgatgaacatccatcgatggtactgcctcctccgtatcatgcccaggttctctgctcgtcgaacatataaaggcgcaaccattgtgatgtttgcttcctgccattagagcaaagttgcctgaataaaaacatcagtagtttcccccttttagctttgacgcggtgttatggttgtacaagtgtatagcaatagtaagatgtagattttttgggaaacgtgagtgtgcgattaatccgagcagagccttgcgccactacaaaatggtgaggtatttccatgcccactgaaatagcaaactttaggatcgaccgggcgcatcagtgacttgaaggggatagcgccaagagaagaaaacaatggggncgtggtcttctggaggtgcatctggtccacgccaagggcctctccggcagcgatttccttgacctgtgtggtcgttaggtgccggagccaggagcacaagggcaacaccgcactgagttccatagggaatttcttgccattggcacgaccagtatttactatgcaagcagacaatagttggtacattcctgccaactatatgaatctcacagcttctcacatgtacca

SEQ ID NO: 57197 - DNA, 517 bp, Triticum aestivum
  Clone ID: PAT_TA_57197
gcatcagctcactgagacagtacaagaaaataaactagctctgttcaacttcgcaagtccactaggatcacaagtcagttttcactcccagcagcgcggcaagaacaagaagtataggagaagccatggctggtccggcgaaggcatcgtggatggtggccatgagcgtgggcgcggtggaagcgctcaaggaccaggccgggctttgccgctggaactatgccctcaggtccaccgggcagccaaggccaacgtccgcggcggcgtctcgcagggcagcaagcagcttccggcctccgcgtcggcggtggcggagaggcggcgagcggagaaggccgaggaggggctaagaacggtgatgtacctcagctgctggggcccaaattaggagtactagttggttaggggtgttgtgttcgttgcagcttgtgcttatacttatgcgacaaccccatgaccgtttgtaaatacagcacgatgatgatgatgatgaaaatttcggctatgaatttatatt

SEQ ID NO: 57198 - DNA, 472 bp, Triticum aestivum
  unsure (1)..(472): unsure at all n locations
  Clone ID: PAT_TA_57198
acgaaagctaggtgactgtttgggtgtcgcagggaaatcagttgaagacttgaaaacggctcaggagtttcttcattgcgcaaagactggtttcctttattagaaagtaaagcgaagtgtctgatgggagtattaccgttgcaagtttgtatgagcttggctgttgatcaatgcagtaatgttggtggaagctcgtcagttgccatctatctatcctatgtcaggtttgcgggtcttgtatgaagctcactcgcccgccgcacgccgtgtgccgcgtccaccaaaagatcgcagcctttgcatttgtcttgttagtacaatgtatgtagtgacgacggaggagagggatatgttttgttggttttcttcgtcctgtggctgcacaagaagaggagagcatagtatatatatatacaaaaccttttatggtatcagtaaactgttagccgagtttaatagtttctgcntanna

SEQ ID NO: 57199 - DNA, 478 bp, Triticum aestivum
  unsure (1)..(478): unsure at all n locations
  Clone ID: PAT_TA_57199
aaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgcccttttgaagccacccttctttccgcgcccttgcagggaattttttttttttttttggggcccacttaaattcatttggcgggcgttttttaaccccgggcgggggaaaaccccccgggcccccccctaattaacttgggtggaaaccccccttttttcggcggggggaataaaaaaaagggcggccccaaccgcctttcctaccaattggtcgccctgtttgggggggggagggccccctctttggggcgtttatttagggggggggggggggttgctcccgggggggcggttcttttttttggccccttccttcccgcccgtttntttnttttccttcc

SEQ ID NO: 57200 - DNA, 564 bp, Triticum aestivum
  Clone ID: PAT_TA_57200
atttggggtggtggatgttgaggttaaatgatgattcatgcctggatggtggcacttacttatgtccctagttaaaacaacattctggtaaatacgtactcctactctatgatggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccattcaaaagaatcaaatcttatatacggatacttaaaatcaatacactgtttttaaattgtacaccaaagttaaataaaaaaaccgtggtttaacaaaattgaatcgggaaaaaccctgttcttccccaactaaatggttttaaagaaaaaacccctttaccaattggccttaaaaaaaaaacggccccccaaatgggcaatgccaaacgccttggaaccctaaattaaaaaggggagttgccctggatacgcccataaagaccgctccttttgccggttacccacacccggacccttaaacttcctaccctcctatccccccctcttttg

SEQ ID NO: 57201 - DNA, 659 bp, Triticum aestivum
  Clone ID: PAT_TA_57201
tgatcggaaagaggatgcactgtaccagcagtacgtaatgagcaggtacaagataccgaaagcaaagaaagaccaaacaattcctgatttcattgaaatagagggttttcacacgtcacttcagaacttccatgcttctttaaagccacgtgctgatctggacagcgaggtaatgacactctatctaaagactttcaacttggagcagatgtacaacaagaagaagccgaagaagtttgcattctcggtgtttatggggagtcaattgggtgtggaccctgacttgtttgatcacaagagttgtgaaagagagttcagaagggcttgtgagaataaccagatttcaagatgcgacttacttttcattactatcgttcagaacaagcattgggctgtagttgttgttaacttgtcacacaatcagttcaatgttttcgattccgtcaagacaatcatggatgtttcattgttgcataaggcaacaaacaatgtgatcacaaacataaagcaagttgtcactactgaatctgcgttcaagattgatctcaacggctttgagaaggtcacccaagcttacccaaagcaatcaacacactataattgtggcttccatgcaattctttacttggaaaacttggatggtgttgtcatgaaacatt

SEQ ID NO: 57202 - DNA, 694 bp, Triticum aestivum
  Clone ID: PAT_TA_57202
gtataaggaagcaattagtttggtgatctacagaatgaggactgaattacatgcatatattatacatgtcgtattcgcagcctgaggaaatcacagctatttatatattttaatttatgcatgtcgtaccagttttattgacactgtaggattacttcgaacggcatccaactttcacaaaagttaacatggaaactagctcgcaatcacttggggggtgggtgcagggatacagaaaattgaggtaactggacttactagattgaaccagtagatttttaacctgccacagagatgtgctttcacactaatatcagttgtaatgataccttattcacaacaaataaatacaatactttgagttgaaaactacagaggcattgtcgcaatgaacctcggtataggctgcatcagatggaatcccattctatatctctggcctaaacttctatgtacatgtttggtgacagcatacgtcgttagtcaacgttttactggatttcaggtgctgctccacactctacttttaatatccttgcgagtcacagtctcttggatccatgttcaagtggggctggtacggtgctatcagtgccaaaggacgagcctgaatgttcgagtaatatctcatcgatggtaaaggaaggacatggatttggaaatgaggatcacaagtcatttaaccagtttgatg

SEQ ID NO: 57203 - DNA, 610 bp, Triticum aestivum
  unsure (1)..(610): unsure at all n locations
  Clone ID: PAT_TA_57203
gcctcctccttcctccccatccagcggcgcctcctccctctttcccggcctcccgcatcgcgctgagcctcgtcggccgcttcccccagccggtgtccctctccagatgcatcctccctgagatccggtacggagagagtcatggtggcaggggcagatgcatgaggaggaggaggccatggtcatggtggcgcgacggaggtcgtggctcgccccccgccgcctctctcgtgccccccttttccctacccccctccccggtgtccttgcctctgccatggcctccgcccgattccagatcggccgcaggtcgaggagcggttgctgcagtgagggcagcagcgtgcagagggggagaggtcaaggacggttgccagttcatggaggagagatgcaacacaacggttcagcagcggcaatcctcgagatagagttaggccgatctgaataaacagagatgagcagcagcagggttgggtgctccatttgtatgcgttgcattggttaattntgttgtgctcatgtttctgtttcatgctattgtccacgagttctacttactgcttatttcccattaagtatttagnttcataatgctctggccaaccta

SEQ ID NO: 57204 - DNA, 467 bp, Triticum aestivum
  Clone ID: PAT_TA_57204
cgtcccggaaaaaaaattatataaaaaaaaaaaaaaaaaaaaaaaaaaaaaaaaaaaaaaaaaaaaaaaaaaaaaaaaaaaaaaaaaaaaaaggaaaaaaaattataaaaaaaaaaaagctaaagaactagagacatccaaaatgaaagctgctgttctggggactcggtcattttttttctttggcgcgccttgtttcaacgcctggggtttgtttttttcctgtggtttccaaacaattcccctttgggccccttccctctttggccgggggcccgttcccctttccccctcccgccttttcgcccttcctgcccgctcacttggccggtttgtgaaagggggccccccccgcggcggttcttctttctccggggggggggccctttccccttgccggcccccttcccctccccctttgctccttcccctttttcttttttccttcccttccttcctttcctttt

SEQ ID NO: 57205 - DNA, 605 bp, Triticum aestivum
  Clone ID: PAT_TA_57205
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggttcaagttttagttccgggggttggcaaggtaatagtttttttttggggcccctaaatttaatttaaggggcggggttttaaaaagggggggatgggaaaaccctgggggttcccaattttattggttttgaagaaattccctttttggcaggtgggggtaaaaggaaaagggcccgaccggttggcctttccaaaaattggcccaccttgatgggaaaagggaaccccccttttaggggccttttaagcgggggggggggggggtttcccccaagggggaccgttattttggcaggggccttaggcccggtttttttggtttttttcctttttttttcggcaacgttggcggtttttcccgggaaggttttaaatggggggttccttttggggtcccgtttaagggttttagggccccttgccccaaaaaattttgtttagggg

SEQ ID NO: 57206 - DNA, 472 bp, Triticum aestivum
  unsure (1)..(472): unsure at all n locations
  Clone ID: PAT_TA_57206
cgagtatctgcccgcggcgggcgagtggggcgactagaggccatcccggtgcccccccccccccccccccccacccccagtaggccgccgccncantcncgnaaaccgatgatgcattgcagcgcgctcgccgagtcgaggagctgcccacggcggtcgacgaggtttagatggagcagagctcaaaggggggcgtggtgtatattatttttttcggagtacaagggaaaggctgggagtattgcattaccagcggttgtagactccccatggacttgattcatggtgaccaggatgagcagtatcgccaggatccatgtaaactccatgctcgccgaggaactgaagctggtcaccatggttctctctcgcaattttttggaatcaataatcaaccgtccggtacaaaggacttgtgcttctctatcgcacggaaaacacctaacccggcgtactgcttttatcttaatct

SEQ ID NO: 57207 - DNA, 631 bp, Triticum aestivum
  unsure (1)..(631): unsure at all n locations
  Clone ID: PAT_TA_57207
cgccactacattccgatgctccacccccctcgtgtcccggctccgagcaatactactactcctacatagccaccgaccagaccaggagccgcaccacagggggtcaagaaagcagcggcgccatccccggcgatggaggcggacgagctcctgaagaagatacgggcgctggaggaagggcaggcggagctcaagcgggaggtgggcaggctcatgccggaccgccgcgccgcggcccggcgacgcgccctccgcgcgctgccgccgccgccgcggccctcctcgtcgtcgcggcgcgtcgcagcccgtggcaggctgcccgacaggcactgccactggatactgcagtcgctggggcaagccgtgcacatcatcgcccccgacgggaagcttctgtactggaaccggtatgctgagcatatgtatggctattctgcagcagaggcagttggccggaatgccgttgaattaattgttcatcctactgacttcgatgctgcaaaactcgncatccagaacatatttatgggcaagtgttggagagggaggtttcctgttaagaacaaagcaggagagaggtttttcatttctggccaccacaccccttttgttcgatgacgatggtagcttg

SEQ ID NO: 57208 - DNA, 220 bp, Triticum aestivum
  Clone ID: PAT_TA_57208
aactctttatatatgtgctatctagatacactaaatctgatcgactgtccacaacgttacagactgggaaaatgctaaaaccatgcagctaactaacttagtagcatagccccatatccccatttggccaactagcgaaaaagccaacacggctcgacctttcgaacttccgaacagtcggacaggctaaagggacactgccacgcgcgctgcatcaagc

SEQ ID NO: 57209 - DNA, 547 bp, Triticum aestivum
  Clone ID: PAT_TA_57209
gaaaaaaaaggccccccccccctgggtttttttttggggggccccccccccctggggggaggggggggggcaacctaccttattggcccgggggcccccccccccaaattttttttgcccccccccgggccctaccaacccccacccccccccaaggcccctttttaaaaggggggggcccccactcaaatttccttgaaagggcccctgccccccaaaaagggggggggggcccttttaaagaaggcccccccgggttttccccccgggcccctttaaaggaaccaaatttaccgacccgggcctgggaaagaaaaattttttttttggggcccccaaattcaattcacggggccgggttttacaacggggggggggggaaaaccccgggggtcccccaattaaaggccttggaaaaaaacccccttttcccaggggggggaaaaacaaaaaggcccccccccaacccccttcccaaaaattgcccccccctaatggggaatgggccccccccctgagcggcccataaaacccggggggggggggg

SEQ ID NO: 57210 - DNA, 600 bp, Triticum aestivum
  unsure (1)..(600): unsure at all n locations
  Clone ID: PAT_TA_57210
cttgtttggagatctattttaccaggacattccttactcagtttactgttcattatcttgcctttgtatattcttttgcttgaggacaagcaaagatttaagtgtgggggaaattgatctacacatttcatatacatcttttggctctgaaatatgcggtttattgagttatattcattcatttcttgccatgaattgttgaattttgtgaatgataatcatataaaggggtcatttactactcagtggtttgttttgcagaaaagtgcgagaaggcactataaacttcaagatacggactaagtggctaagagaacgaagaagaggaggaagaatggacttgtgcgagaagaaacaaagtaaccagggggccaacttgagaagagagggatgttcttgcgaaggaagaaggaagcaggagggccattgtgcaaatggaagatcagattgaggggtcaaaatccctagtccatctccaattcccctcgggcctggcacatctctctctccctcacccctccttctccaactccggccgncgccacggccaggccggcgtggtggtgcgccttcgnctcccatccatccactagctccacc

SEQ ID NO: 57211 - DNA, 620 bp, Triticum aestivum
  Clone ID: PAT_TA_57211
gctgcaccaaagctaatcataaccgatgaggaccaaagcatgagaagaggaatagaagctatatttccgaacacaaagcatcgactttgtatgtggcatattctgatgaaactccctgaaaaagttggacccatcttgagaaataatgaagattttaaaccaaaattcatggtgtgtgtgtgtggatcagagactccagatgagttcgaatcacggtggtcttcaataatttctgagtttggcttagaggataatgaatggttgaaagaaaagtatgatttacgccaatcatggattccagcatactttatggagttctcccttggcggaatattgcgcacaacatcaagatctgagagtgagaatgcatttttccgtcacttcactaaccggaaacttgccttgattgagttttgggtaagatttgaaaccgctttagaagagcaacgacaaaaggagttgcaggaggataattctacccttcataccttgccaatacttcatacttgttggggaattgaggctcatgccagagaagtgtatacccacaacatttttgttgctttccaacttgaggtggtggctgctagggaccgtcgccatgtaaaaactattgagca

SEQ ID NO: 57212 - DNA, 602 bp, Triticum aestivum
  Clone ID: PAT_TA_57212
ctctgtcctctacagcgccctccaccgccgaccccctccgccgacctggtgacccccactgagatcgatgccgccggtgcgtcgagatcggcctcgcctccgtcccacggatctggtgtacgtggtcaacgtcgtctcgctccctgcggcaccaccctaggacaggtcgacggcgcctgtgcgttgaggtcgacgtcgccttgatccccagcacgagatccggcgacgaactccgggcctcttgtctcaagttagccgtgccaccccacgccatcgcgctgctcttctccgcgaccctccacgcggacgagcgctatcgggctccccaccatgtctcttaccacaccgacggcgaccgcggtgcctgctccccactacgctagtacaacatgttgctcagatctgtcatggtgaaacgcgatgcaggtatgcttttccttacaaaggttgtgaaactcttcttttctgatggatgagaactcacgagatattgccgatttatcttctcattgctgtagattttcccttccttccaccgaattactactgggctccaagtctttctcattgctggctctgtattttgcttccaaattgttgca

SEQ ID NO: 57213 - DNA, 612 bp, Triticum aestivum
  unsure (1)..(612): unsure at all n locations
  Clone ID: PAT_TA_57213
gtcacctgccagcttatcagctccaccctcatcgaccacgacaacggcgggcgtgggaaggtgggcgcggaggcggagctggagcagtgggtgacgagcctgccgtcgctgaccacgggggagtccaagttcggcctcaccttcgactgggaggtggagaagctgggcgtgccgggcgccatcatcgtcaacaaccaccacagctccgagttcctgctcaagaccgtcaccctccacgacgtccccggccgcggcaacctctccttcgtcgccaactcatggatctaccccacctccagctacacctacagccgtgtcttcttcgccaacgatacgtacctgccgagccagatgccggcggtgctgaagccgtaccgcgacgacgagctccgtaacctgcggggcgacgaccagcagggcccctaccaggagcacgaccgcgtctaccgctacgacgtctacaacgacctcggcgagggccgccccgtcctcggcggcagcgccgaccacccctacccgcgccgnggacgcaccgggcgcaagcccaacgccaacgatcccaacctggagaagccgctgtcgctgctagagcagatctacgtgccgcgggac

SEQ ID NO: 57214 - DNA, 656 bp, Triticum aestivum
  Clone ID: PAT_TA_57214
agaatggtcaccttgcacgcggttgccgcaatcaatggcgtcctctaagctctttggcatgccttgctatgccgcaggtcctcggtatcgtacatcgtcctgctccagcttcatgtgagggtccaatgaaatccacgctcccttccaaggcgcttcgccatgggtcttgggcgtctgtcgtgtctacttcggttggcttggctacaccgcccgatgtgatgttacagtccgctttggcggatcagacagcgctgttgcagatttgcctggcgcgtgttgggagtcttctcgagcgagcggaggctgctttgagcagtctctcccttgcgccggctttgtcgcagaccactccgatgtcacgccctcctggtgtggccgatgttggctccattgagaaaggggaccaagagctatatggatgtttctcccctcatgttggggacagttcatcgtctctgtcggcctcgtcccctatgttgtctaccactgagggtgagtccgtcgtcgtgcttcaggctccggtgctgtaggccatgcccgagccgcgggagctatgtctgagccctacttcgccattgttcgtggagcatttggaggttgactcctcgatgacctcgtgtgcgggacatgtttcgcctctgtcatctaagcaactg

SEQ ID NO: 57215 - DNA, 554 bp, Triticum aestivum
  unsure (1)..(554): unsure at all n locations
  Clone ID: PAT_TA_57215
cacagaccccccccccccccccccccccgagcgctcctcgccgccgccaggtcggggcggatccaccgccgccgctgctccggtttttgccgacggcggtagatgattttctgcgtaccagggtaccggcggagtactctggtacagctgggggcgcaacgccgataaatttttgacggtgtcgggccggcttcaagatgtttatttatccgccatgccgcctactcgatgactagcagggtgtcctttctcccttaatcagtgaggtcatctgttcaaggttgtatctcactttaagactgatttttcatcggaggacgcttccaccaaggaccagatccgccgctgatggtacgaagcagatgcaatcttccgggctcggagaggatctgtcacaaaagggcagagcggctccacatggatcgagttcccgggccttgtccttgcgcccgaatccgtaaagtttgggtggtcagttccatacggatcgagttattggttttttggngctcgttcttgcgcccggntccggcttggcggaactgccccgggtt

SEQ ID NO: 57216 - DNA, 760 bp, Triticum aestivum
  unsure (1)..(760): unsure at all n locations
  Clone ID: PAT_TA_57216
attcagcagctcagccccacagtttagcgggctgtctggggcagtgtctcgaccttcctactctggtgggtcgatccccccgtttggggctgcacgggcaccctcgcagcagggtccttatggtgggcctccccagtttggcggggagagaccaggattgcagactccgctatttggggctcagaccgcacctgcatctcagccaccaccgttcatgggggttcgtggggcaaatgcaccagcatttgggcctccagggtggcaagggcagacacgaccaggaaccgtgagaatgcctggcatgcctggtgccatgccgcctaatgcactaggccaagggatgccatccacacccaccatgccatactctccccatgctgaagcccaggtctctaccccatccaaaattgaccctaatcagattccacgtcctattaccgagacgtcagttgtcatttttgagactcggcaagctggccaagcagctgttccgccggctgcatcaagtgaatttattgtgaaggacaccggcaattgcagtccccgtttgatgcggtgcaccatgaatcagataccatgtacgggtgatctcttgacaacatcaggaatgccattggctataatggtgcaaccttttgctcttccccatccttctgaggaggctatccagctcgtggattttggggagatgggccctatcaggtgttctcgctgcanagcgtacataaatccattcatgagaattcgttgatcaagggaa

SEQ ID NO: 57217 - DNA, 696 bp, Triticum aestivum
  Clone ID: PAT_TA_57217
agagaagcctgctgaaaatgttcttggtactcatttgactccttgggcgaggcttatgacttctacaatctgtattcatgggaaaaatgttttgtcattcgctacgggaagagtcggccaaatgtggagtgggtaaaatgcatacaggaaatagtctgtggctgctcgggtaaagctggtgtagacttctacgggcagaagataatgggcggtatattgcagagcatagagaaaatcataagcactcactttcgcctaattttgctgacaaaatccattgtccatcacataagcatattgacgtgtacctgagagatctcataaagcaactcaggcaaaacaatgtgaatctgggcaaggtttatagtatcataggtggcattttcggttcaatggagaatgttcccttcaccaaaaggtcattgcgaaatctgtgtgggcagataaacagggaccaagcggatgatgatgtgaggaagacagtggaagtttttgcagacattggagccacggatctgcatttcacatactgggttcaggctgacactgagggcaggatcaagaaccttatttgggcaactggtaccagaaggttgcagtacatatttttttggagacgtgataacatttgacaccacatacaggaccaacctgtatgatatgccttttcagttgtttgctggagtcaacatcatt

SEQ ID NO: 57218 - DNA, 613 bp, Triticum aestivum
  unsure (1)..(613): unsure at all n locations
  Clone ID: PAT_TA_57218
gagaaggtgcaacaaattcacttggtttgtgaatatccttaatataagctagcaacttttatatatatgccaggttgtcttcaagccatagaagcactatcgagccctggagctgtggcgacagtgccgtcccagccaccggcgtcctcttccatgccatggccatccaggaggagtgccacggctatcgcagttctccccatgccatcctcctggatgttgatcgtgtccttgcaccggcggcagctggagcctggtacgtccagagaggcatggccttggattggagcattgcagtcatcgatccacttcgtggtagtcatggggtagggtggcgtagaactcagccccgtgagctgcagttcaccagttcattcctcagctgtaagcccagcaagaaggaaaatggtttgtgctatatatacgactgaactggacaatcacatagaaggtagatatttgcacatctgatttcttttgtgtagtctgggtactctttcccatggtgttaaaaaatatatatgtttgtgaagttgtatgacttagtgattttgtagcacactaagttgacccanactggcttgaatttgttggttatttggcctttgccctg

SEQ ID NO: 57219 - DNA, 640 bp, Triticum aestivum
  unsure (1)..(640): unsure at all n locations
  Clone ID: PAT_TA_57219
atcggcatcaacaaacaaggaaatggagtcgcagatccccaactatccgaatctgcctccacagcttatatgccaactgcataatgtgaccatgcacgctgatgcagagacagacgaggtctatgcacaaatgacgttacagccactcagcccacaagaactcaaggacccatttctacctgctgagttgggcaatgctagcaaacaaccaacgaattatttctgcaaaacattaactgcaagtgataccagtacccatggtggattctctgttccccgccgagcagcggagaaggtgtttcctccgctggatttcactcagcagcctccagcacaggagttggtggcaaaagaccttcatggcaatgagtggaaattccgccatatctttcgaggtcaaccaaagcggcatcttctgacgacaggttggagcgtctttataagtgcgaagagactggtcgctggagactctgtcctatttatctggaatgacaacaatcagctgcttctgggaatacgtcgagcaaatagatcgcagacggttatgccatcatcagtattgtctagtgacagcatgcatataggtcttcttgctgcagctgctcatgctgcatcaacaaatagccggntcactattttc

SEQ ID NO: 57220 - DNA, 599 bp, Triticum aestivum
  unsure (1)..(599): unsure at all n locations
  Clone ID: PAT_TA_57220
ttctcttctcatctcatctcatcaagaacacaacagaacagtgagggaggggcccacccccgccggagaagaccgccgcgacggaactcgcatcgccggatggacccgcatgatggagagcctgctgctgacgagttgccaccaccaccccctctgcctcccaacgtggtgcccatcatcgcagaagatgctgctgctgctagtgagagcgaaccgcccccaccgccacctccaagcaagccagcaaagcctaggaggcacataatggccaggcctcccaatggcttgggaaagaaggccagcccatccagctgcttgccaaccactacaaagtctctgtcaagccttcagaggagttcttcaaccactactatgttaatctcaagtatgaggatgatacgccagtcgacagcaagggcattggcagaaaggtccttgataagctgcagcacacctaccattctgagctcgcagacaaggactntgcatatgatggcgaaaagagcctctttaccatcggggctcttccacagatcaacaatgaattcattgtggtattggaagacatcggtagtggaaagactgctgctgggagccct

SEQ ID NO: 57221 - DNA, 703 bp, Triticum aestivum
  unsure (1)..(703): unsure at all n locations
  Clone ID: PAT_TA_57221
ttgcatgcatgttcaacctgaaaccaaattaactctttgtcgattcatgtatgaatatgtctctctcttaacttcgcattcctctgcaggacaacctgattagcatgcaacgcaggacagcagcccctgcggccagcagcaaccccccagcgcgctctcatcaaagccatcccgatgccgctgcttcgttgacaaattctgccggggagctcaggctacccaacggcgacctctactccggcacgctgtcggggggagtaccggagggcacggggcggtgcgtctggtcaggcagcggctgcgtgtacgagggcgggtggaggcgggggatgagacacggcattggaaggacggagtggccgtcgggggccgtctacgaaggcgaatactccggcggcttcatggacggcgaaggaacacacgtggccgccggctcctcctcctcgtcctcttacaagggtcagtggaagctggaccgcaagcacggcctcgggctccaggcgcacgccaatggcgacgtgtaccagggcgcctgggtccagggccagatggaaggccagggcaggtacacgtgggccaacggcaacaactacgtcggcaccatgaggaacggcctcatgtccggcaaaggtgtcctcacgtggagcaccggngactcgttccaggggaactgggtcggcggcgtggcgcacggctacgggct

SEQ ID NO: 57222 - DNA, 636 bp, Triticum aestivum
  Clone ID: PAT_TA_57222
attttattgtctatttgcatacttctgctgaaacatagtggagataatatgagcttacaataagcatgctacacaggagttgggcacagcgggacccaaaaaagcattgcccaagggattcttgatgatcttgacaagtcaacagtttgagacacattgatcaacctattagagaagacaaagaagggagagatggactattattttattgtggttatggaaaaaggaaaggggacacatggcttatgcatgcacacatgggagagagtacagaatatagggcaagacgggctagattgacagtggctgtccgctatttggataccaataaagaccgcacagatacatgcgactcttgaggccacaaatattactggccaaatttgatatgtgcggcaacacaagctgaagcacactattctgcgagatgatgcatcaactggttcttttgaatctggcgtggatggggaaggagggaaaagtgttgggcagacaaaggagcatgctcatcttattagaatctacggtggtgagcaacttattgttgcagtcaacaagatggatgctattgggtactcaaaagataggctggagttcatcaaggtacgacttggtagttttctgcggtcatgcaac

SEQ ID NO: 57223 - DNA, 663 bp, Triticum aestivum
  Clone ID: PAT_TA_57223
agctggatagatacaaggatgatgttcgtgcctttatggttgctgatgatcttcagacggtcagtggagaatctaaaatgttcagcaatcaagagagtgctgctggggttacagaagtacaccagaaagagacatgtgctggttgatttgggctttttgttatcagacgcactggtgaatctgtttcagtgatagctgaattcagtagccacttttgtgcaatttgcttgagagcctcaagctttactgttgtatgtagcttcatgtgtctggaagatgggaaacacagcctgaaggttcagtagaaagaatatgcaagacaggaatgggttgcgttgcagattaggtgctaatgaaattatatgctcggttcatgtcactacgtggtgcagagcttcatcgatgagcatgtactacgatgagttgtgcatgtgagagcgcaaaagcaattgttgcccggttatacgagggtaagttaaatctttggataaacacaataaccttccatttagttttcagtcagtatccgtaagtgtattgaatagatcaactgtgacatgactttgattaccactccacatgcactggagtctggagggcagagtggtgcccttttctgtacctggttgtaattttagtagcaattgctcaattttaagcagt

SEQ ID NO: 57224 - DNA, 207 bp, Triticum aestivum
  Clone ID: PAT_TA_57224
ggaggtgacgaggagggaggactacgagcggatgcagcagcggttcgactggggcgaagactccatctacaaccaggacgccatcgaactgtccgccggcagataaccggcgtcagactgctcgctgttggtaataatgccattcttcgtagcagggtcggagtcttgtatattgtgatgttgtcgtaagtcaatgttgctgactgt

SEQ ID NO: 57225 - DNA, 620 bp, Triticum aestivum
  Clone ID: PAT_TA_57225
caccgatcggtccagctccctccaccacgccgccccctcccacctagggtttccactagagagcaaaggggatcgggggtcagttatgcgccgccgcctcctgccgtgcgccgatctcccccctctcgcagccgcaattgccgtcggggccgcgtaaatatctggccgggcggacgccgcgctacttctcgcagccaatcttcggaggagaccaagtcggggcaactcgcgagccttcatcagctgccaaattcacggcgaccgaatcttctcgggcgtcgccggatcttcgtggcagccatggggaagggcaagaaagttgataggctcagcgcattgcctgatgacgttctggtcaacattcttgaccggctcaatgtccatgaggctgcaagaaccagtatcctctccaggcgttggactcagctctgtgccaagctgtctcggcttataataagcgccctggacttcctgccaaagggtgtgtcgtgcaccaacatctctgacgatgaattggtccgcatcaatgcagctgtgtttcaagcgacagatagcatattggcacgcagaaatcatggagagcacaccatccgccttctgtccacaaggttctacttgag

SEQ ID NO: 57226 - DNA, 712 bp, Triticum aestivum
  Clone ID: PAT_TA_57226
gttcgtgcgtgagcagaggagacggaggtttgctaggttttagcgcgggtgcggcggcgcggtcctgccgttgtgtgttaggttggccggagcaagcgagcgggatgccaaagggcgacgacgcgctcgcgcggaagcgcgggaaggtgcgtcgcaagcggatgcgcagcagcgagaacgccgtctccacgcgcgtcgccgccttttttttctccaagcgccgccgcaagaccggcaagcgccgcggctgcgagggcatgtgcttctccctcccttgccccgaggaccccttcaacgagcgccacggcaagaagcgcaagaccgaagacgccgccgacaccaacgacgaccacaagaagaaaagcaagggttccaagaagcaggagcgggccaccggtcctaatgccatacacgtgcggaagaaggagacgggggaggaccggctggagtatgaccggccgtccaagttcctggtggtctgcctcaacgccatccgggacggggcgggggcatccgaggaggacggcggcggcatccacgacaccgcctcctggggcatggagctctggaagtcctgcgcggcgtcccctccttcggacgtgctcgacaccagctaccagtacgccacccgggagcagacggcgtggctcgtctccacggcctgcgacatcgtcgccaggaaggagaagctcggagtggttgtctcatgccc

SEQ ID NO: 57227 - DNA, 593 bp, Triticum aestivum
  Clone ID: PAT_TA_57227
ggaaagccgtccatggcgatcctggtggcgttgctaatggcgttagtggcactgccgctcctcatggtgcccgacacgctctctatgccaggctccaacggcgtggatcgcggcgccgccctgtcgctcccacgcccgtgcttcagcagatccgtgtttgagttgtgcatacctttagccgcctcccctccaatgtccacgattctgatataccgtgtttgttagtcttgactggtgtttgttctccgtattgttgtgcaggaggctggagaacatcagggagaaaagggagtcgtggatggagacttgtcctacatggccgagcgagatcgaggctagccgccggtaatgttcttctcccgtgcaagttccgcactgcattgaagcatccaacacatgatgtagctacgttacaggtgggatatcagccaagtatgtttcgaggtgagacatccatcaagtttgtttggagaaattgtgcagtccagctcctgcgtgctggtcaccgagctccactgtgtccagctcatccgaccatgtgctccactgcatctaggtcaaccgatcttgtggcagagctacactgacgcaag

SEQ ID NO: 57228 - DNA, 680 bp, Triticum aestivum
  Clone ID: PAT_TA_57228
gagcccggaggcattggatcctgaccatcaccaacaatctaaaggtcgatgaggccgacgagccccatggcgacaggagatgcaacaaggtaaacgtcgatgagcctaacgacgacagcaacctaaagcttgtggatttgcgagtgttgaagacggcgacgacaactccactaggaatacgaccgcggcggcttcttcttcgttgtttctctggtggaagacccgcgcctgcgacaccgcggcagcagcggcggctgtcaagtgggtcgtccctgctcacttggcagcagcggcggcggctacaaatcttctccagcctgggtcatctccgtcaccaacgcctacagcctggggtgcagagtagagcaacagcagcacgggcagggtcaaggagcagcagcacaggcagctcagtggagcagcagcagcacgggcagggtcagtggagcagcagcagtacgggcagggtcaggggagcagcagcagcacgggcagaaaccaccggcgacaggggagaagcagccgcacgggtgcgtgggcaggggagaaggagcagcacgggtgcgcgggcgtgggagatcgacgaggtcgcgctggagattgagtatcacgtgcgcgtgctcctggtccaccggatcgtggaggcagcctccggcgacgccggtaggagatcacggcag

SEQ ID NO: 57229 - DNA, 622 bp, Triticum aestivum
  Clone ID: PAT_TA_57229
ccaagcccctaagtcttgagccgccagcatgcgtgaaggatgccggcgacaaggacgaacccgaggcgctgaacgcgttccatctgatatccctctccgagggattcgacctctcgccactgttcgagggccacccggcaagccggcggctggagggcggcatgcggttcgcgacgcgggagccagcacggggcgtggtctcccgtctcgaggaggtcgctgcgcgtggaggcgggcggatgcgggtgaccaagagcagcccggggggcgtgcgcctggagggcgcggaacgcggcgggcgcaagggccggctcgccgtggccgccgagatattcagcgtggctccttcggtgctcgtggtcgacgtcaagaaggacggcggcgacaccctcgagtacctctcgttctgctgtgacgagctccggccagccctccaggacattgtctgggctgccgaccctccggcgtctgtcgccatcgccgtctgacgctgcagtaccatgtttcttttctgttggtcttgattcggtagtgacgggagtgaagtaagcagcatgtttatgttagtctggtcagtgcgaagaagagaatcagctctgccttcccttgaagatttcatttt

SEQ ID NO: 57230 - DNA, 222 bp, Triticum aestivum
  Clone ID: PAT_TA_57230
ggacgacatcgcttgcgtcgtcgtgcgcatccactgacctgcaacgatgctactcctataccatcatgtatttgttgtaggatgtcaagcgcgtagggccagtttgtggaagggatatgagctgaactgtttgctgtactagcaaacttcttacagaaaggaagtgcactggactgtttgatgtaaaattctcgctgaagttcaaattctagtagcctacac

SEQ ID NO: 57231 - DNA, 480 bp, Triticum aestivum
  Clone ID: PAT_TA_57231
gtaaccttgagttcagttcagtcgggttcagtctagtctctccctgcatctgtgtatacagctgaaaaatgaaggggaaaacaaactgcaggcccctgcttgctagctagtgatctcccttccctcctcccgtgtccagaaatgggtcaagaacaaaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaagaaccaaagttaactacccggggaaggaaaagaaaaagtttttttatggggcccccaaaataaaattaaggggccggggtttaaaaacgggggaaggggaaaaacccgggggtacccaaataaaatggcttggaaaaaaatccccttttcgcaagtgggg

SEQ ID NO: 57232 - DNA, 405 bp, Triticum aestivum
  unsure (1)..(405): unsure at all n locations
  Clone ID: PAT_TA_57232
gacccagcgaccgaacaattttgggggcnccgcaggggggggggggcgggggccgcgcaggggcnggcggcggcgcggagncgcagcaaccacgagggggggcaggaaggaccacgangaccgcnggagaagccgccaacccggcagcacaggcggnggcgcccgcgacacgcggcaccccaccnggcccnccgaggggggggaagaacgaccgttcttgtctgacggcangccgcaggagaagccacacatacccggcatgcttggacgcgcccccccgggcgtggcctcaacaactatcgggcttctgccccccagagcggccattgagtcgggcccagaagggggggatcctgctccacaaccagcattcctatgtgctgcggcagccgggcgggctgcgac

SEQ ID NO: 57233 - DNA, 680 bp, Triticum aestivum
  Clone ID: PAT_TA_57233
gtcaacagcctcagtggaacccccctttctctctctctctctcccgccggagaaatccaagggggccaaagcggcgctctcgtccgcgtcgcggcaatggtgaaggggaggtttcttggcgcgtgcttgctgctgctcgcggcggcgctggccgacggcgagggcgaggaggggaagcggggcgtccccctgctggacgccgggaggctggagaagttcgtggacgagctgccggacatgccggtgctgcgcgggtacggcgtggccgagggcggcaggctcgtcgccggcgagctcgccgtcggcatgtacgacaccatgtggaaattccaccgcgacctaccggcgacccgagtgttcgcctacggcgcgagcagggagacggccaccgtgccggggccgaccatcgtggccatgaagggggtgcccacgcgcgtcacctggaccaaccacctcccgcctcaccacatcctgccgtgggaccgatcactcgcggcagcgcgggtcggcaacgccgctggcatccccaccgtcgcccacctccacggcggcgtgcagcaatcaacctccgacggccactccatggcctgggtcacgtccggcttcgccaccacggggcctcacttctcctcgccggcgtatgagtacccaaaccagcagcttcccggtaacctatggta

SEQ ID NO: 57234 - DNA, 741 bp, Triticum aestivum
  unsure (1)..(741): unsure at all n locations
  Clone ID: PAT_TA_57234
ctgagggtgtggtgcggacgaggttgccaggtcggggcgcgtacaacggccgaggcctccgccggccacggcagtccgagcgccccggcctggctcgccatgtgccgtctccccctacgacctgagggtgtggtgcggacgaggttgccagattggagccatcctgatggggtcatctccttcatccgttgcatcacagcagagggatattgatcattgtcccttgccctcgtatggtttttgtagtcggggtaactggtaaggctgcttatggctgaaatggaaagaaaaaccaatcctgcattggaagactgcaccaattgtatcattgccatgccaaggatactgcatcaccatgtctaggtttgctaaactaaattgtttgcaactctctgttgtctgcagaaccacttctctatagtcgaaaagctgtgaactatgtcacatcatttgtcttagttttatgatgtgttacccccccacaactgcagtccctgtctgtccctttatgaagtttgggctaattaaccttgttatcatgtcagtgcttcgcatgtgatcttgccatgtttttttatttctgaactgtatggagatgtggaaatatgttgaattgtaaacattgtttctttcaatctgtgaagctcttgttcccttaattctactgaatgtgatgattgntggtatttgcattctaatactagtgtctcatctcattgacattatgtgtttattcatgga

SEQ ID NO: 57235 - DNA, 217 bp, Triticum aestivum
  Clone ID: PAT_TA_57235
aaagtttttaagatacgcatgtggtagcataattaactacgtataaatgtttgataatcgaactcgttgaattagctacgcaatcttgacttaaaaaaaaaaaaaaaaaaaaaaaaaaaaaaaaaaaaaaaaaaaaaaaaaaaaaaaaaaaaaaaaaaaaaaaaaagcgaaagaaataaaaaaaaaaaaagggggggcgaagtgcaagaaattgaaa

SEQ ID NO: 57236 - DNA, 644 bp, Triticum aestivum
  unsure (1)..(644): unsure at all n locations
  Clone ID: PAT_TA_57236
gcaagaacatccgcaataaaagccgccgccgtcgctgtcgctatcagcgcaccgcagccgccgccgtcgccgtcaacgccaccaccgccatcgccatcggcttcctcttcttctccggcaagctgctctcaccggagagaaaagggcttgggctggaaggggctttgatgaatggaaggggatttaggggattggtggagggcatgttttcaccaaatccccacaaatccccagccccttacgggcttgaaaaccacctgtgccaaacaaagcctgaaggggggaatcccataatccgtaaccttagcgtgtagcgacgatgtagattacccagtcgctggcgaagattcttgttcaggtggcagagggcaatgcgaagaagctcgcaagctttgcgagatttgtagttggtttctgaacatggcgatcctctacgagcaatcagcggagattgcattggctgccatgtaggaggagaaggcatggatgatcgaagatggagccattccgatcgtgataatccgttgggtgatgatggagacagagggggaggatccggcgcatagagggtgttggaaggcttacaggtctngcgttctttatctgncgggtccgtgctcatggggatttcgggcgccaatacc

SEQ ID NO: 57237 - DNA, 280 bp, Triticum aestivum
  Clone ID: PAT_TA_57237
cgacccagcgtccggggacggggttaccccggcacgaagggggggcacgcgcgagcgccgaaagggaacacacggaagacttcccgagccgggacgtgaaagttgacagaggagcatcgggacaccaccaccaacaccgacagccacggcggccgggcccgggcccgggccccgggagcggcagcgccagatcaacaggggggggggacacgtacatttttcttctaagccatagcacatcgatagcgaaacccaaatcaaaggcagtggccgtacaacc

SEQ ID NO: 57238 - DNA, 774 bp, Triticum aestivum
  unsure (1)..(774): unsure at all n locations
  Clone ID: PAT_TA_57238
ctccaaattgggttttgactgttggaaaaaacatcatgcccaaatttatcatccattcggtcatatgcataaatttgggcatgatgttttctccaaattgggttttgactgttggaaaaatgcggttgcagcattccgtaaacatgttggtgggccatgtagcatccacaatatttcaaaaacagcatgtgatgattttaaaaatcaaagggcaagtgtgaaaagtaaagttacaacttatagcaaaggttcactagtcaagtatgaaactcgtgtggatacatctttggccattgtaagttatctagcattgcaaggtgaaccatttcgtggacacgatgaatccagttcttctttgaacaaggggaattttttggagctacttgattgggtgaaagaaagaattccagaagtgaaggttgcatttgatgagctatgccctaagaatgcccaaatgacttccggaaaaattcaaaaaatccttatttcccattgtgcaaatgcggtcaccaaagcaatcaaagaagagatgggtgattgtcttttctctgtccttattgatgagtgtcgtgatatatcggtgaaagaacaaatggttgtggttattaggtacttgagcaaacaaggagagactattgaacgatttttaggtattaagcatgtcccggaaacaacatctgcttctttaaagaangcattgttgggaagtttttgcanaacacggtctgggttgttgcgcgactaccgaggcaagggtatgatgggggatctaat

SEQ ID NO: 57239 - DNA, 639 bp, Triticum aestivum
  unsure (1)..(639): unsure at all n locations
  Clone ID: PAT_TA_57239
cagacaatgccttgtgctgctatttcctaaataagatatacacatgtcttcacaccgccattgctgttgcgcccataacgcaagctccggtgccgccgcgatgttggtccgcgaagaggatgcaaacactatagctctgaactccatgccagacattgctctcattctgttgctattggtgtggagcgccgaggacgcatgtcccatggccgccggttcttccagtcaggggatgcgaaatctgccaccatcgtttctctctgtgcgccggtatgttttgtgtgtgatttgaagtttggcaactggcatgagagaaaaacatcagtggatatctcccatcaattgcagacagttggtttgttactttagactgacgactgaatccacggtcggtttgcagcatgcagcaagagaagccccagttgtagattattttgtatgctgatggtgccgtggcggctgcatgccggagggctgcatacttgacttctacatcgccatcttcaacaaggagaagatctccctcgctggccacgacgaggtccgcgcctgcactcccattcccattctttctcccnctccaggaaattggggttctattgctnttttttttggttggtgtgtgcctctggagtatac

SEQ ID NO: 57240 - DNA, 722 bp, Triticum aestivum
  unsure (1)..(722): unsure at all n locations
  Clone ID: PAT_TA_57240
gtgaaagactcgggagacgacgagaagcaaagcagcagagagcatggctcgtggcgcccctatgcttgcagcggtagtgatagctgcggtggcacttgggtctgtaggggcgagagagcaggaggccgccggcggagggggcgacgacttgaggcagcctacattggcgcagggcctgtcattcgacttctaccggcagctctgccccagggcggagtccatcgtgcgtgacttcgtcctggacgccgtccggaaggacatcggcctcgccgccggcctgcttcgcctacacttccacgattgcttcgtgcagggctgcgacgcgtcagtgcttctagacgggtcggcgacggggccgggggagcagcaggcgccgcccaacctcactctccgcccgtccgccttcaaggccgtcaacgacatccgggaccgactggagcgcgagtgccgcggcgccgtcgtttcctgctccgacatcctggcgctcgccgcccgcgactccgtggtcgcctcaggcgggccggagtaccgcgtgcccctcgggcgccgcgacagccccaggttcgccacggcgcaagacgttctctccggtcttcccccgccgtcctcgaacgtgccgtccctcctcgatgtgctccggaagatcggcctcgacgccgncgacctcgtcgggctctccgcggccacaccgtggggctcgggcactgcacatcctttgacga

SEQ ID NO: 57241 - DNA, 441 bp, Triticum aestivum
  Clone ID: PAT_TA_57241
aggatggccatcgttgatggacgaagggtggtcccgaagcgcttgctgcctacagggaggcgttcaagggtacatttatggccaatggcgggtacgaccgcgaggaagggggcaaggtggtcgctgatgggtacactgatttggtctccttcgggcgatcgttcttggcgaatccagacctgccaaagaggtttgagatcggcgcagagctgaacaagtatgataggatgaccttctacatctctgaccccgtcatcggctacactgactaccccttcctcgattaatagttgatgggggttctttgttcagtgatgcaactaattgtaccacacatcattaataaaatgtatcgtgcaagtgttgtgttttatccaagaacaaaaaaaaaaaaaaaaaaaaaaaaaaaaaaaaaaaaagaaaaaacaatataaaagaaac

SEQ ID NO: 57242 - DNA, 767 bp, Triticum aestivum
  unsure (1)..(767): unsure at all n locations
  Clone ID: PAT_TA_57242
gtcggggtcgaggagcagccgcacccgcagttcgacctcaacctcgccgtcgtgctcgccggcttcgcgttcgaggcctacagcaccccacccgcagatgcgggctggcgcgagacggacgcggccgagtgtcagacggtgttcctgtccgatgtgtttctccgtgaagtatacgatggccaactagttgtgaggctcaagaaaggcaacagtcttcctgcaatggacccatggggtacaagtgatccttatgtagttctacaacttaacggtcaaactgcaaagagccaaattaaatgggggacgaaggagccaacctggaatcaagatttcacatttaacattaggacttctctagaaaatctactccaggttgaggcttgggatgcaaaccttatcaccccacacaaacgaatgggaaatgctgggttgtatcttgaaacactttgtgatggaaataaacatgacatcactgtcgaattagaaggccttggtgctgatggtggtggaactattgatttggaggtcaaatacaagagttatgatgacattgagcgtgataaacaatggtggagaacaccttttgtgtctgactttctcgaaaagagcagcctaggatctgctcttaggacggtccttggatctgaaactgtaaatgcaagccagttcgtccaatctgcatttgngcaactgagttctttaactgacacaaaccttctaaagccatcgtcttctgatagtgaagctgagatttctgaaaggcctga

SEQ ID NO: 57243 - DNA, 775 bp, Triticum aestivum
  unsure (1)..(775): unsure at all n locations
  Clone ID: PAT_TA_57243
aacgaaaccaaaccacccgaacccgagtcgaccgcttcgagaagcgtcgccaccaaggcacccagaccccagacctcctcctcccgggaatcggaaccgcgtcacattcgtcgctcccctgatccatccggcgacgcggcggagcaaggaaggaaccaaggctcgagcagcgggcggccggagagatggcggagaacccgcagctgttcgggaacgggatgcccgtgcccttccacggcgagatgttcgtcctcgcccgcgacggcgtcgagttccacgtcgacaagatcccctcgtgcgtaatccccttccctccctcctctcgccccggttgctttcgcctcgcttggacagattgatattttttttccccgatctagcatcgcgggcgatcgcgctgtctggatggggatttttaatcggggtcaggttagggttggacgcgaggaaacggcgggggattggttgattggcttcgaggaggatggctttagcagctcttcggaattggcccgtctgagattcatggtgttgcgcgcggcctgaattgtgctgggcccttggtttgagaggggaattctgcccttcagtggctggcacgtcgccttgcaactaatttagcttttcaagggttgcaaacatacaatttcgaaggcttgatgtgttggtggatgcgtggttgacctgtatgtatagcttgtttncatcactacataacttggaacgcttgggtgggactgctaggtgacagggagaaaaatatgctgctgctgca

SEQ ID NO: 57244 - DNA, 700 bp, Triticum aestivum
  Clone ID: PAT_TA_57244
cagcggtggcctttttcctgaagggattgagattgcgaagatttggtaagctgttacatcatcatatttcagcacatgagttttggtcatgtctacatatgtgttgatgtactacttaagtagtttgttaatttcattttaaaatggactgtttaaactaaataacagactggttgaaatctgaaacatccccttgggaaattctagcagctcgataccttttacccttttgacttgtatcagttagactcgtgaaaactgggagcttatttgataatctttatgcctaagttgttctcataatatgtggtaattctgagatgaaaactactatattgattcttgctgctggaaggagggacattgtttttagctttagacgattcaattattcaagtggatataagatgtagaaaaacaatattaaaggatgccagctgattcttttccaagcaaggacgatacgttcttcgtaaaggtaattttcttcatatggaccgtagtagcacatatcttattaaatgtctctgccatcagtgtgattgatttccctttgatgaggtgcatcgtgctcattgatgagtagattccgccaaatgttttttttatgcaattgctattggaggatatcatttcttcttttatcacatcatgtctgcacattcgggacttcagcacactgttaaaaatggagttgact

SEQ ID NO: 57245 - DNA, 289 bp, Triticum aestivum
  Clone ID: PAT_TA_57245
ggcgcccgttttgttccacccgcagggggcgaccgctgagcaccactaccacagccagagccagctgcatcggctctgtgcgtcttcttcgactcggacaacatcggcatcatggatcccggcagaggacttacgacccttgcctcgcggtctgccttcaacgccgcatacgtcctgccttcagtggcgtggcatgcgtgaacccgtgtgcgtgatgctactttcaccgctgcaccggcatggcgtgaccaccacccgtctcttatcgcctatctttacgccgcacaca

SEQ ID NO: 57246 - DNA, 640 bp, Triticum aestivum
  unsure (1)..(640): unsure at all n locations
  Clone ID: PAT_TA_57246
caaagcacaggtcaaagcagagaaccacttagagggcatggggccaccaacgaatacttatttgccacataatcaattcccagagcaatctggtttgagtgaagttaaaagcgaggatacaggagcaatatttgataacactggtcaggagggtaatcaattcataccaatgaacacattctcttttgaccataatgctgctatccctgatatttcttacactgagctgaacattggtgaggcgactggaagcatgaacaatggcaatggcagttgcctaactgtacagggagattatctgcagggggagtttggagaatgtcccaaagcagagtatggttctcttgatatggctggtgaaatgccaatgcatgatttgccgcataacaatcagtcatatgagatggaacagattccacagaatatatgtgaaagcagttcgatgcagacaggctctccggatcaatattgtgatgatacatctttatcaggttactacatgtcgtccncagagtcattatcctgtgagcagatccagtctgaatatattggtttcaagagtgagtctagcactgactcttctccaataccctcaagcagaaactctactacagaggatgctgataaatacttaagaggc

SEQ ID NO: 57247 - DNA, 696 bp, Triticum aestivum
  Clone ID: PAT_TA_57247
gccactgctccaagcgcaggaagtcccgggttcggcggatgactcgcgtgccggcaatcagcacgaaggcggcagagatccccgcggacgacttctcgtggcgcaagtacggcagaagccgcctgtggagaatgccctggactcatcagttgacgcaactcggttgagctgcggtgcactatatttagctgattttattgggaaggaacattatttatcgagttttggatcagatgcggggatttctcctgaactccaccgcctcaagctgtcgtagttggtgttgtccgtgctggattcgattgacctaccattgtctgctaccgtgagaggtaggtccgctgcgggtgctcgtgcttctggttgattcgccctgctgcgccggtctttgttctgcagggccatgtctgttggtgccacgaaacggccgtggcactgcttgtgtgagccacgacggcgctacccgcgcgcctgccccgaaacgctgccgcgagccgagccgccggcgttcatctggagaagcgcgggaagaagaagatgggttagatgttcaacgaaatgattcttcggcatccaagctaggtttatatggcatcaaaggccacggcgcatgctgtactgacagatagttcagtccatcgtaaccatagtgccctcaccataacatgaacaacagagggccggtgcgctcaccat

SEQ ID NO: 57248 - DNA, 663 bp, Triticum aestivum
  unsure (1)..(663): unsure at all n locations
  Clone ID: PAT_TA_57248
attcttatatggtggtggataccagagtggtagtacaacaaaaaagattgacatcccaaatggaagggttggtgttatcattggaaaagctggagaaactataaagcatctccaagctcagtcaggggcgaagatccaagtaacaagggacatggatgttcaacccggttcacagacaagatcagttgatctttcgggcactcctgatcagataaacagagctgagcagttgataattgatgttcttgcagaggctgatgctggatcatctggcactatctctaatcggaagtacaacgcacctcaacctggtgctgagcaattccaaatgcaaattgctaacaataaggtgggtctggttattggtaagggtggtgagactataaaatccatgcaggccaaatctcaagctcgtatacaggtcattcctttgcatttgcctcccggtgatacttcaactgaaagaacactgtatattgatggtactgcagagcaaattgaaatagcaaagcagcttgtgagtgaggttaccagtgagaatcgtgccagaaatccaatgtcaggtggctattctcagcagggctaccgncctcctcgtnctcaggcaaactggggtgcgcctggtgcaccaancacacaacagcctggntatgggtacatgca

SEQ ID NO: 57249 - DNA, 674 bp, Triticum aestivum
  unsure (1)..(674): unsure at all n locations
  Clone ID: PAT_TA_57249
gtccccttccgctcgctggagaggctctccctctcgggatgccacatcgatctggccaccttcatcccgtactgccctcgcctgcgcgtgctccaggtgaacaccaccggtctgatagacatgagcaacattacggtccactccgcgtcgctggaggagctcgtcgtggagcacggcaaccgatggacccgccgtacccatgtcagcgtcgactcccctgtgcttaagcaattgacagcgtccttccatgcctgcggcaacatcagggtgtccatcttgtcaccaatggtggagaaggtctggtggcggtgctcgtatgccaagccgatttacaggcttggtctttggggcctctcagaggtgggcttgaacacagaagattcacactccgggagagacgcctgtgtgcagctccctagcgtccatgtcctgtccctacacatatctcctgcccaagattcagttagctttccaaatgcagatctcagcctttttgcggcagagatcgataaacatattgttaccaacttctctggtctggacctacatctcagcaccaagggccatgtgtttggagcttttgtgctgcatctccttgggatgcatcggattcgtacagccttaggnaccttaagattgtcctgcaaagatcagaggtgaaagatgcatgccca

SEQ ID NO: 57250 - DNA, 375 bp, Triticum aestivum
  Clone ID: PAT_TA_57250
gacccgccgttcgtgccggcggcgaggccgtccatgagcttcagcgccaaccaccagctgctgctgagcctgcaggacagcgtgtccgactcaacgcgctggggctgaacccgtcggacgactcctcgtccgactcgctgagctcgtcgtcgctcaccagcacgctgcgcaagggcggccacgacatcggcttcagcagcaccgccggcggcgacgcccggtgatcaaccaattggttggttcctcttgaaatgcggacgagattagtttcaaatgtatgtattggtgagagagtacatagattagcattgggctgtaatagagtcctaacatatctctttgtgataataataattcagatttttcagatggttc

SEQ ID NO: 57251 - DNA, 544 bp, Triticum aestivum
  unsure (1)..(544): unsure at all n locations
  Clone ID: PAT_TA_57251
cagatccccatccccaccgccaccgccgccgtccacctgctcccgctcgccgccggcgaccaccgcacgcggagcggcgggggggaggggcctcgcccgagatggcgacgatggggagcctgatcgggctggtgaaccggatccagcaggcgtgcaccgtgctcggcgaccacggcggcggcgccgggggctcgctctgggaggcgctcccctccgtcgccgtcgtcggaggccagagttccgggaagtcgtcggtgctcgagagcattgtcgggagggacttcctgccccgtggatctgggatcgtgacgaggaggcctctagtgctgcagctgcacaagaccgagggcggccaggagtacgccgagttcctccacgccccgcggaagcgcttctccgactttgctgctgttaggaaagagattgctgatgaaactgatcgcatgactggaaaatcgaaagcaatatcaaatgttcctatccatttgagtatatattctccacatgttgttaacttgacacttattgatcttnctggactgac

SEQ ID NO: 57252 - DNA, 632 bp, Triticum aestivum
  Clone ID: PAT_TA_57252
gtcgccggcaagcaaaaggtacttattccaccctactgtcgccgtagtgctgtactaccatagaacaagatcgcgaagatcttctcgatcgggccgtatggattgcggaggaggaggcagtgtcaaagtttgacaaggagaaacaggcaagtttctcctcggctgacggcgacgggcgttggcggtacaccgtaccgaaccttcgcgatgtatggcaaccgcggccagcgccgagctgtcacggtcgccggccggcggcgtgctctgccgctcaactggcaggcaccaccagctcccgcgcgcgcgtgcagaaaaggagtcgctagctttggagctttcccaccagggccaagctaagctagtagctctataaatccagcacctctcgcaccgagcctagctgcaacctgactccgatacactgcgagctagggcgcaccgagaaatcgatccggttgtcctgttgttaggcgagcgagaacagtttacgattcacacactagtccaggtaagaatatactggtaggatttaggatcgatatggcaagcgtggccatacgggaatgcccagccgtgctccggccgaattggtgtatctggtattgccatacttgattatgaccattaggcgt

SEQ ID NO: 57253 - DNA, 744 bp, Triticum aestivum
  Clone ID: PAT_TA_57253
gcgagacggtacgagcgccaccgcctacggcctacccaccagaaagcggcgcggcaaggcaaaagggaaggaaaccctaatcccccgcgcgccaccgcctctccctctctctcccggcgcccagatccggccctcgcccaccatggccgaggctccggcggcgagccgcagggcggaggaggcggggagccggcgccgcgcggatgatgaggcggaggcggctgccgccgccgacggggacggggacagcagcgtctacacctccgaggacgagggcacggaggactaccgccgcggcggctaccacgccgtccgccccggcgacaccttcaagcagggcgcctacgtcgtgcagtccaagctcggctggggccacttctccaccgtctggctcgcctgggacaccgcccactccacgtatgtggccctgaaggtgcagaagagcgcacagcactacacggaggctgccatggatgagatcaagatcttgaggcagattgccgatggcgaccctgaagactcccgctgtgttgtgaagcttcttgaccacttcaagcactcgggccccaacgggagccatgtctgcatggtgtttgagtttcttggtgataacttgctcaccctgatcaagtacacggactatcgcgggattccgcttccgatggttaaggagatatgcccgcatgtgctcattggccttgactacctccaccgcgagctttccattatccacacggatctgaa

SEQ ID NO: 57254 - DNA, 749 bp, Triticum aestivum
  Clone ID: PAT_TA_57254
gaatcctttaacccatctggccctcgacaggccctccgtcccccttccgctggcgccgacccgccgccgcccccttccgcaacgccagtggcgctcccccacaagttggtcctcgccgccggacgaggttgtacgcctccggccatcctcgtgctgctcctccggcgagagcggctccattcacaaccgtcgggccgcgctccaccgctgacccgtctgctcctatccaggtcaccgtctgctggccgctcccttcggatcctaggctcgccctctccggatcaaaggtactagtgagctttcgccatgtcgaggctgcgggcgctctggcaagcttccgtgaacgctaccaagcgagctgttgtatggaattcagaagatttatttccaccaagtgaaagatacatcttcaatttcaattcaaaagatgaggtgaagaagtggcacttgtactcggattcagagtatggaggtttatcatccgcatcactggagataactgatagtgtttctggtggagatacttcatcaacaggtactatgtctttgacatgcttaattttccagctggcccaatcttttgaagtatagctcgcattattttccagttcgtatgtggtgtgtaactgcagtcatgtagaacctatgagaagaaataagcttaatcgctgtctaaaaaagggaatgccttgtagtggttcattgtcatttgtctgtactagtttagtttagcaggaaatatcagctgc

SEQ ID NO: 57255 - DNA, 649 bp, Triticum aestivum
  unsure (1)..(649): unsure at all n locations
  Clone ID: PAT_TA_57255
ctctcccccgattcagatccacccttcgccgccgctgccacctacctcaagccgatcccgccgcctgcgcccgcgcgccaccaccgctcttcctctgcccgccgacccaccccgtccctaaggcctcgctcgtcgccttccgccgcggggccgaacccaacccaagcctctccgcggaccaactcctctcccccaaccccgccgccgcgggcctcctcttatccaaccccgggctctctagcatcggtgcaccgctgccgcccccaccctctccccttcccaagctactcaggcggcgcccagatctgccaccgccgtcctctacaaccacgcccatgtagcggcagatgaaggaggagttaggggcggagcggcagggcccttcctccgcctccgtggtccatggcgtctacgggccattcctctgcctctacctcgccgactctcgccgcctctgtggagtgaagatcttgacaggactgcctccctcccctgcctcgctccccatgggcggtgaggcgagaccgaccggcgacgcgcggccaggctacataaaggtttgaagcagcctacccaacaataaaggagctggctcttggtggtactcctggctctaaggctgtttagccagcatcgcatcancttttgc

SEQ ID NO: 57256 - DNA, 723 bp, Triticum aestivum
  Clone ID: PAT_TA_57256
cctagatcagtttgttggtgcagcgcttgcagtattgagaggctttcttctgacatctcctcttgcaagtacgagctacgtgtgcagactgcgtaagcatcgagcggcggtccatggacgtggacatggattctgttttttggtggctgtagctgaaagttgtgtggttgttgctccaccgatattataatggagctcctaattgtgatacattaatttgcattcaatcacatataatatgtccaagattttagctccatgatcactcatctaactgtggttgtctgctttttagccaatatcaaaatgttcactctcaagtcagtttttctggtagatgtgctaggatcaaatgggttgtcatttctaagctgcatggtttttaggctttatagctcatggaggtgaatctggaaatgatcatagtgtcaatttatattttcctcctggaaatgggattatccccacaacagtacttcatgaactttacactcttcatggttgccaggtgccagcaataattaggaaattagtagaccaatccttttttatggaactctaatctagaataggtactcttcaaattgtgatgttacttgagtgttgcggatacacatacatttgggttattttaaaaaaatgagcatatgtttggcttaatgttaaatgcagcttccaaaatagctcatggggatttcttatgttctttactgaattaacgct

SEQ ID NO: 57257 - DNA, 441 bp, Triticum aestivum
  unsure (1)..(441): unsure at all n locations
  Clone ID: PAT_TA_57257
gacaattcaacccggggcccctgtttaaggggatctgggaaaacacttaaattttgcacaaaacactttgttttttgcgatattcaacccactgtccgaacagattggggtaaagaaaaagaaaacgcgaccacccgaggagcacgggctcgcctgttttcccttatcgccgccaccgccgccaccaccaacgccggccgtttccgggaacctcgcgggggggggggcgttggccatgaaccagaacgactccgaggccgtcgctctggttaaggatgggaaatgcccccgcaccaagggggtggctgtggctcttgatgccaaaacttttgctatccttgggttgggaaaggcgggggcccngctccccccacgtgccctaggtttgggaatggctgcgcttgccccccatccttttgcttaaccgtgctcgggctcggg

SEQ ID NO: 57258 - DNA, 583 bp, Triticum aestivum
  Clone ID: PAT_TA_57258
agaaaatccttgaactgacgaaccgagccgtgaccaagaagaaaaaccctccgtacgacaaacgccgcggcgccgcccaccgagacacggccgatggtcaccccgccgtcgccccggcggtctgccgcaggcgctggcgccgctgcgggggccccgcgcgtgctgcttgccctggttgtgctctacggcttcatgtccttcctagtctaccgcgtcatccacatgcgccacgtcgccccgctggacagcgacgcgtcgccagacgaattctccgagggacgcgtgctgcagcacctccgccgcctcgtcgttgatatccctggccgccaggaggggagaccggggttggagaccgccgcgcagtacatcaaggggcagctcgaggggcttgctgcgcatgctgggccggagtacaggatagatgttgaagaaacaattgtcagtggctctttcagcatgatgtttttgcgccacagagtaactctaggctacagaaatcataaaaatattgttatgaggatttcatcaaatgtttcagaagaggatgaaccattcccttttggtgaatggacatttcgacagt

SEQ ID NO: 57259 - DNA, 650 bp, Triticum aestivum
  unsure (1)..(650): unsure at all n locations
  Clone ID: PAT_TA_57259
cattaatcatctagacaagctctttatcacgaatgatgctgcgacaatcgtgaacgagcttgatgtccagcaccctgctgctaagctcctggtgctcgctgccagagcgcaacaggaggagatcggagatggagctaatctcaccatatctttcgccggtgaactgctcgagaaggctgaggagctcatcaggatgggactgcatccaagtgagatcatcattgggtacaccaaggccattaataagacgcttgagattttggatgatctagttgagaaaggctcggaaaatatggatgtcaggaacaaggaagaggtcgtgttgaggatgaaatctgctgttgcaagcaagcaatttggccaggaggatgtgctgtgtccacttgtcgctgatgcctgtatccaagtttgcccccaaaacccggatacctgcattggcgacaaggggacactgcgcaagctggtggcacggcggcttgccagttctgctgtagtccgtgggatggctctgaaaaatgacgctgtcgggagcataaaaaaagtggagaaagtgaaggttgcggtatttgctggtggtgttgacacttctgncactgaaacaaagggaactgttcttatacattctgctgagcagcttggaaactatgcta

SEQ ID NO: 57260 - DNA, 609 bp, Triticum aestivum
  unsure (1)..(609): unsure at all n locations
  Clone ID: PAT_TA_57260
cattagccaaaagtaatcttgcttttccatttcccgagagagctcagttcgtgtctgcactccagtccagtgtttgtttgagcagcagccatggcctccaaccaggacaaggcaagctaccgcgccggcgaggccaaggcccacaccgaggagaaggccggacaggtgaccggcgcggccaaggacgaggcgtgcgacgccaaggaccgggcgtcgggcgcggcggggcaagcgacggggaaggggcagggcgccgtggaggccacgaagcagaaggccggcgaggcggggcagaagacgtccgagacggcgcaggccggcaaggaccgggccgccgagggcaaggaccggaccggcagctacctcggccacgcgaccgaggggaccaagcagaaggcctccgaggcgacggggtacacgcaggacagggcttccgacgcggcgcagtacaccaaggactccgccgtcgccggcaaggacaagaccggcagcgtcctcagccaggccggcgagcaggtgaagaacgcggtggtcggcgcgaaagacgcggtggcgagcacgctggggatgggggggagacaacacctncagcgcaaccaaggacgcgag

SEQ ID NO: 57261 - DNA, 722 bp, Triticum aestivum
  unsure (1)..(722): unsure at all n locations
  Clone ID: PAT_TA_57261
gccggagagtggagcagaggggtcattaccacaacaaatgcactggcggccatctcctaaggagaacagtactgcttgttcaccagagatggtgccttcagggcatgagaacttgcagcctttgccatatcctgcttttcttcctcaggctcagaccccagatgtggttgccactggggcagtcataggggcattggaccaaatgcatcatccagcgcctgtactggggacaattgaagagggcacatcacccattctgtcaccaccgttggagagcgggtcattgccacagctagagccacagatgaattctgttacagcacatgttgtggacaccccgatgcatgtacctgccacagattgtgttgcagttaactcagagggaacagttctgccactgcctgcattgcaggcgatggttacaaacatggacagtgcaactacatcgctcccgcgatttgagaatggagcagaggggtcattgccccagctaaggcagcagtcatcttctccaaatgttcaggccgcaccttgttcattggacgcggtggaacttctgccaccacccccacctcctttcgttaacaaagaagtaggtcaaatggtgtgtggaagctgccgtgaacttattgcttatcctagaggtgctgntcatgtacagtgtgctgcctgtcggacagtaaacctagtagtggaagcacatgaaagtgggaatgtacact

SEQ ID NO: 57262 - DNA, 706 bp, Triticum aestivum
  unsure (1)..(706): unsure at all n locations
  Clone ID: PAT_TA_57262
ctggcggcagcagcaccagaccggcgaatggcgcagttaccgtcaattctgctgcgacgacggtcggttcggccaacgccagattccattcccaacaaccacatcaagacaggcagagtagatgggctagctgttttcctggcttgtcatgttttggatcgcagaagggtggaaagcgtatagttcctgcagcacgtatgcctgatgggaatgcatcaactaaccgtggaaatgctcttcaatctggtagaaattccaaccaaaatggggctatgaatttatctcttcttgcgccaccatcatcgcctgcatccttctcgaactctgctcttccttcgactgctcagtcacctaaccgcttcctgtcaatatctgcaaactctcctggtggcccaacgtctaatatgttcgctgttggaccatatgccaatgaacctcagcttgtctcacctccaacagccttttcaactttcacaactgagccctctacagcaccactgacccctcctcctgaactagctcacgcaaccactccgtcctctccagatgttccatatngctcggtttctttcattcatatacgggtcttaaaactgctggcaaggagcacagcatgcattacttgtcaacaacatanctctggtggtttaggactccagggatcttatccactttacccagngagcccttctagcagcctcatatc

SEQ ID NO: 57263 - DNA, 645 bp, Triticum aestivum
  Clone ID: PAT_TA_57263
gacgtggccgtcctcgtggcgctctccggcgcgcacacaatcgggaggtcgcagtgcggcagcttctccgaccggtcccagcgcgctgacgacaccttctccaggaagctcgccgccaactgcagcaagaacccggaccgtctgcagaaccttgacgtgatcaccccggacctgttcgacaacgggtactacaaggcgctggggttcatccagggcgtcttcacctccgacatggcgctggtcaagaacaagaccaccgcacccatcgtgaagcagttcgccgcgagcaaggacgccttcttcgcgcagttcgccaagtcgatgaccaagctcgctagcgtgcccaagcctgcgggcaacatcggggagatccgccgcttcagctgcttcaggaccaacgcccagagcgtcgtcctcatcgaagccgccgtcgacgccgccgatgaggaggagggcttcgccgcttccgcatgatcggtcgttccggcagccgaccggccagcatgcagtacttcccgcagaccgtgcgtgacgttagcgtgtagtgcactgctgtcctagtggtgttcgtgcgtgtgtttgagggtttgtgttgactgttttgtcgcgttgtactagtaggtataataaggcgacacatgcgcg

SEQ ID NO: 57264 - DNA, 609 bp, Triticum aestivum
  unsure (1)..(609): unsure at all n locations
  Clone ID: PAT_TA_57264
catggctctcagcgcgactccaccactctgccatgatgactatgccatttctgagtccacaggcctattccaattcatctccgtcaggtcgccagacaggaaattgtaaggcttccgaaccatttcaggttttttgttagagatgcgcaagattctgcttttggtcttggattgtatcgcttccgcaatggtttgattagggatgttgtagttgggaaaagttacttgcttggtgaggacaatgaggttacttttgttaagcatgatgaaggtctgaacatgcgcatgccttcattgggtaggcagatttggtttctgatgcttgctttccctcaagactatcaaaaaaaattcgggattgataaggcagtttctcaatttggaaaattaattcagtggttcacacctcaggatccagtctctagtgtacttgtcaaatcttggatcatgagtctgtcacttgtgcctagtagttntgtgatgcggcaaatgggtggtcagcgtagatcttggacagtgccagtttactaattgcattccgaagagtcgaatgctcatactcatgatgttcctctggcgggggaggacccccctctggccgatggcagt

SEQ ID NO: 57265 - DNA, 684 bp, Triticum aestivum
  Clone ID: PAT_TA_57265
cggattccggtcgcccacgcgtcggcgaccgagccgagtaccatccctctcctcttcctcctgggcacaagccttctcttcgccgcggctgtttcggcctcccatgacgaggaggaggacaggcgcggtgggcgctcgcttcagcagtgcgtgcagcggtgccatcaggaccggccgcggtactcgcatgcccggtgcgtgcaggagtgccgggacgagcagcagcagcatggaaggcacgagcaggaggagcaaggccgtggccatggccggcacggcgaaggggggcgtgaggaggagcagggccgtggccgtggcaggcacggccagggggagcgtgaggaggaggagggccgtggccgtgggcggcacggcgagggagagcgtgaggaggaggagggccgtggccgtgggcggcacggcgagggggagcgtgaggagcacggggatagccgccggccgtacgtgttcggcccgcgcaactttcgtagcatcatccggagcgaccacgggttcgtcaaggcccttcgcccgttcgacgaagtgtccaggctcctccgaggcatcaggaactaccgcgtcgccatcatggaggtgaacccgcgctcgttcgtcgtgccgggactcacggacgcggacggcgtcggctacgtcgctcaagcgagggcgtgctaacggtgatcg

SEQ ID NO: 57266 - DNA, 685 bp, Triticum aestivum
  unsure (1)..(685): unsure at all n locations
  Clone ID: PAT_TA_57266
gcatgttcgtaagaacttgaatatgatcaatacctggaaggcagaataccatggtttaaggaacatgcatggcctcatctttgtgcttattggtgctcaaaagagttcaagactttaaggaagagagggcaggaatctcgcttcaagagtgaagatattgctcaaaatcggggaggttcactgccatttgtggaggctcgacaaattctggcacagaaatatgggcctgagaaggctaccaccctgaatacgtatgctgcactgaaatctggattaaagaattgggatggcagtggcagcatcagttccaccctcagcgggaaggcaaaaaaacgccacgatgattactgtgatttggctagagccgcacatcctgatgattgggaggagcgagagttagatgggcaaatgttatatgagtcatcaggtggcattcctcatgggcgactagcaatagcggatggagcaattaagaaggcttatgttatctcaatagctagagagaagaaactgaggccgttatcttcagcatcatttcggcgaactattcaaganaacgaagaactgaagcgacgagctattcaaganaacgaagaactgaagcgacgtaatgagaaccttcaaaagatagtggatatgcatggaagacttttcttggccccttttaggagatgggaaaagacta

SEQ ID NO: 57267 - DNA, 783 bp, Triticum aestivum
  unsure (1)..(783): unsure at all n locations
  Clone ID: PAT_TA_57267
gcagaattgaccaaactgagtaacctgggacatctcaatctctcctccaatggcttcggtggtgcattgccggtgggtttcagaagcctgaggaaactgaagtacttggatctccgtggcaacggcttcgtcggcaaattggatgacatatttgcacagctgcagagcccggtccatgttgatttcagctgcaaccagttctcggggtccctggcatcaatctctgataactcatctgtggctaccactctgcagtacctgaatgttagccataatgtgctgtcagggccagtgtttgcgagcgatcccacgcctttgttcgacagcctcgaggtgttcgatacaagttacaatgcgcttactggcaacgtcccgtcgtttaacttcatgatctccctcaaggtgttgcttctgcagaacaataagttctcggggtccattccagaagcgctatttcgggagacctccatggtgttgactcaacttgaccttagctgcaaccagctcacaggtccaattaggcgtgtaacgtcagtgaatctgaagtacctgaatctgtcatccaacagccttcagggaactttaccaatcacatttgggagctgttcagtggttgatttgagtagaaacatgctttcagggaacatatcagttgtccatacatggngagattatgttgagatgattgatttgagctcaaatagattaacaggaacttggcccggtcagactacccaatttttgaggctgacttcattgaggatttctaataacttgctagca

SEQ ID NO: 57268 - DNA, 386 bp, Triticum aestivum
  Clone ID: PAT_TA_57268
atatccacctcccttggcgggtatcagatattagatgactaggagagcagagtaggcaactaatatctgatatccacctcccttggcgggtatggctgcccatccccttctccattgttctcacaggtgctagcttctaattggctgaaggttgaagcccatacatagactatactgttgaccaattgactattaatatggtgcacgtgagggtggtggtccatgtgtcttgctgttctggttgacccagagatatttttgtgttggtccaactgtatagcttagcatagcatggtctccctatattttttccaaagatatgtaatacacttttacagctatactgtctgagttttatgaatataaatatatatacttgagtggtt

SEQ ID NO: 57269 - DNA, 539 bp, Triticum aestivum
  Clone ID: PAT_TA_57269
cgaaccggtaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatctttctaatgccatgaacgctgctgaaatcactgacaagcttg

SEQ ID NO: 57270 - DNA, 343 bp, Triticum aestivum
  unsure (1)..(343): unsure at all n locations
  Clone ID: PAT_TA_57270
ctcactcgtcgctctcctccccttcgcctctcgccggccaccaccacctcgaccaccacctcgaccaccacctcgctcaccatcacttcccgtcgccgccatcattcttccgcctctactcacacccgtcgtccactcgcaccctgctccactcacaccctgcgtccaaggtcaaagtttagatttttgctccggcggcgagcttatggcgatggaggagctggatccgcgtgcgcctgctttggatctggcgacggaggtggtggatgcgacgtttgaagtacacatgggcggcggcctgctccccgccgcggcatgngaggtncgaggnggcggcgcggcg

SEQ ID NO: 57271 - DNA, 707 bp, Triticum aestivum
  unsure (1)..(707): unsure at all n locations
  Clone ID: PAT_TA_57271
gaatagcatcatacatgatatcaccaagggtcaatactctgacaaggctctaactgtgcttccagttgttggtcccggtggaatggggaagacaactctgatacaacacatatttcgcaaccaacaggtgcagaatcattttccaatcaggatttggatatgtgtgcccttcatttccaacctggttaaggtgctagaacagattagaagaaatacctttcgggttgaaggtgaagatcggcgtagtacaacaaaagagctcattcaacacaggctgagacacaaaaggttcttacttgtactcgatgatatatggcagattagtaattcggatgactggaaaaagctattgttgatattcggtcaatcacaagaaaagggttgcgtgattctagtcacgactcggtttcatgcaattgcagagatggtcagaacaaccaaccattgtatagaactgaacggcttagaacatgaagagttttggaagttatttcttgcatttgtctttggctatgagcatgctgggagggaccatcatgatttgcttcagactggaaataagataatggaaaaactaaagggttcccctcttgctgcaagaactgtttctagattactgagaaataaccatagtttgcagcattgngaaagggtcctagaaagtaaagaatgggagatgaagacctctagcantgacattatgcctg

SEQ ID NO: 57272 - DNA, 713 bp, Triticum aestivum
  Clone ID: PAT_TA_57272
cgatctccctacgtggactggaacctgtacctgaacactctgttctggaacctcaactactgggactcgatcagcaccttgtccggcgagatcaggaaccctgccaagactctgcccaaggccctgttctacgcggtcatcttcgtggtcgtcggctacctgtaccctctcctcaccgggaccggcgcggtgcctctggacagggggcagtggacggacggctacttcgcggacatcgcgaaggtgctcggcggcgcgtggctgatgtggtggatgcaggcggcggcggcgatgtccaacatgggcatgttcgtggcggagatgagcagcgactcgtaccagctcctgggcatggcggagcggggcatgctgccggccttcttcgcgacccggtcgcggtacgggaccccgctggtcggcatcctcttctcggcctccggcgtgctgctgctgtccacgatgagcttccaggagatcgtggcggccgagaacttcctctactgcttcggcatgctcctcgagttcctgtcgttcgtcctgctgcgggtgaggcggcccgacgccccgcggccgtacagggtgccgctgggcacagccgggtgcgtggcgatgctggtgcccgcgacggcgctgatcgtggcggtgctcgcgctgtcgacgctcaaggtggcgctggtgagcctcggcgccgtggctgtcgggctcgtgctgca

SEQ ID NO: 57273 - DNA, 761 bp, Triticum aestivum
  Clone ID: PAT_TA_57273
gccaagaccccacccattggcagatgatccccgcccgccaaggttcgctctacgtaaccgagatctgatctttcgtagtctgacgacgacttgatccttttcaatcgatcaaccatttggggagcagggagcccctaggccagatctgctggaatttttcgtctgcttagctcacctctcaggcttagcaaatacagtactctgtacaattttgtaaccgagctggtcttagagtttgtgacatggaatgctttgtcttgtttggtgtccgcggttgctttcctgcctcgttccctctcgattaggactgaaacctgtgaatcatgggacatctctgaacgaggcatcagagtcaggaacctagtcttacctgattggtgcctcccggctgaccttagacacagttcgctggttccccctcagcacagcagtcaccctagagtcaggattgtgattgaattgccttatctgctatggttgctgttagtatggagtgaaatcagaactagatgtttctgtttattatgatgtgcatacacctgacctgaacacaatcaagatggtcttgtcttgcgtgtgcctcacattttcttttcacttgttcctaaaatgtaccattagggcactcacaatgcactgcatcttaaactgtatactgttgcttttaatagaggtattgatgcatctttctcaatgggttatatctttgtgcgtgctgtatttagaagctctgttttgttgcatataatcagtagtaacat

SEQ ID NO: 57274 - DNA, 753 bp, Triticum aestivum
  Clone ID: PAT_TA_57274
gacaattgcaacaaccagcacaagggcagcaaccagaacaagggcaacaaggtcagcagccaggacaagggcaacaaggccagcagccaggacaagggcagcaaccgggacaagggcaaccagggtactacccaacttctccgcagcagtcaggacaagggcaaccagggtactacccaacttcttcgcagcagccaacacaatcgcagcaaccaggacaagggcaacaaggtcagcaggtaggacaagggcaacaagctcagcagccaggacaagggcagcaaccgggacaagggcagccagggtactacccaacttctccgctgcagtcaggacaagggcaaccagggtactacctaacttctccgcagcagtcaggacaagggcagcagccaggacaattgcaacaatcagcacaagggcaaaaaggacagcaaccaggacaaggtcaacagccagggcaagggcaacaaggtcagcagccaggacaagggcaacaaggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggca

SEQ ID NO: 57275 - DNA, 772 bp, Triticum aestivum
  unsure (1)..(772): unsure at all n locations
  Clone ID: PAT_TA_57275
caatttccacacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaattcttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaaaaacaacagttgcaacaacaacaacaacaacaacagcaactgcaacaacaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagtacgaggaaataaggaacctagcgctacagacgctacctgcaatgtgcaatgtctacatccctncacattgctcgaccaccattgcgccatt

SEQ ID NO: 57276 - DNA, 772 bp, Triticum aestivum
  Clone ID: PAT_TA_57276
gacatttcccaacaaccactattttcacaacaaccaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggcacc

SEQ ID NO: 57277 - DNA, 572 bp, Triticum aestivum
  Clone ID: PAT_TA_57277
aataccaccaagaccccccggtaaaagaaaagaagggaagcgccacgacgcccccgaaggcccgctaaaaaaaaagaggttctttcacctttgagacgatgaggaaggagccggcgccgcgctgtttttggcctttggccttcttggcaacgacgaccaggagcccggcgtgcggggtgctgcggggggggccggccgcggcggggtccgccgggcgggggggggggaggaggggcccccaggggcggccctccgggggggggggggcggcggcggggggcccctccagcggcctcccccggcggctcagggggaccctggggccctcctccgcccccttcttccccttttttttccgcccggggggcaccgccgagaaaaagaggtacttgttgtttttcgcccgccgggcgccggggggaaaaaagggggccccttgggtccggcggcccgcccctggggggccgccggctgggaggctacaagattacggcgggcggccgggggggggccacttttaaggtgccaaaaaaaaaaacccaaccgggggacgttgttctcctttgtggggg

SEQ ID NO: 57278 - DNA, 531 bp, Triticum aestivum
  Clone ID: PAT_TA_57278
aaaatataaaaaaaaaaaaaaaaaaaaaaaaaaaaaaaaaaaaaaaaaaaaaggaaaaaaaaaaaaaaaagaaaaaaaaataaaaaaaaaaaagggggcgaaacgatttggaggttccataatttaaaaccacgttccttgcgccgcctggtgtcttctttcgggttgcttggttcaatcctggggctgttttttttcatcgccttgtttggaattccccttggggggacccccttttttgccgttggggccacgtccgtctcttcgcttccctgcttttgtcgcggcgtgggctgggcacttgtgggcccttcccgtcttttggccttcctgggggcggatggggtcgccccctggggcggctcctttaccctggccggtccggtggctcccttcgttgggcccccttcccttgcctgttcgctacggccccctcctttccctgccttcctttgggtttgtgggcctgtttcgggctttcccctgattgctttacgtgggggcgttccctgttgggttccttttgggggt

SEQ ID NO: 57279 - DNA, 481 bp, Triticum aestivum
  Clone ID: PAT_TA_57279
ggccgggggaacaataaattccatcgacccactgcggtttgactgatcaataaggatgatggaccattccaatgcagagtttcttgagtcatacttccactctccatcaatctgtttaacagttggagcctcccgaagtgcaggcagaggaatagatatgacaacattgttcaggtcaaacatctctgaagcctcatattcaatgttgacataggtttcatttccagatactgagggcccagagcctcccctcaaagtgcaacatgggcgccgactgcaagttccctagtggctattactggtgatgatatagcctctattcgtgccaataaaatgtcacatatcatagcaagtggcaaataagagtgctgagtgatgtagcttccatttatgactagctaataaactgtcacataccactgcgtgtgacaaataaaagtggtcatggaataatttatgaataaaatttcagcatgtgcca

SEQ ID NO: 57280 - DNA, 677 bp, Triticum aestivum
  Clone ID: PAT_TA_57280
caaccacttattttcgcagcaacaacaacaaccattatcgcagcaacaacaaccaccattttcacaacaacaaccaccattttcgcagcaacaacaaccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatggcacaaagtcttgctaggacgcaaatgttgcaccagagcagctgccatgtgatgcaacaacaatgttgccagcagctgccgcacatcccacagcaatcccgctatgaggcaatacgagctatcatgtactccatcatcctgcaagaacaacaacaggttcatggttccatgcatactactcagcataaaccgcaacagttgggccaatgtgtttcccaaccccacagcagtgacaacaacaactcgggcaacaacc

SEQ ID NO: 57281 - DNA, 735 bp, Triticum aestivum
  Clone ID: PAT_TA_57281
ggagattggcctaccatatcaactagtttcgattgtctctggtgcgcttaatgatgcagcagctaagaagtatgatttggaagcatggttccctgcgtcaaaaacattcagagaactagtatcctgttcaaattgcacagattatcaggcaaggagacttggaataggctatggccagaaaaagaatgacgagcagtcgaaacagtttgttcatatgttgaattctacgctgactgcaactgagaggaccctatgctgtattctggagaactaccagagggaggatggggttgaagtgccaaaagcactgcagccattcatgggtgggatagatttccttcctttcaagcgtcctcttgatagcaaacaagctgctgactccaaacccagcaagtctaaaccaaagggaaatgcagcttgagctgtaaaaggggagaatggaagcttatttccatcaggcagataatgatacatccttttgttaatttctgggtcgtctgtggtgtcccatttccttttaacaaaaagacatcgtggcgctatatttcattaaatgaagtcgaagttacaaagctagggcaaccaaatgaaaaaagggaaaccgacaccggcaatcgggctatacagccggctgtaaccacattcatggcggcttgtataatctttctattagcacaacctggcatctggcctcatccgcgattcgactgaagatctggacggcgcagcagtttg

SEQ ID NO: 57282 - DNA, 508 bp, Triticum aestivum
  Clone ID: PAT_TA_57282
cggacaacctgctccgctccggcgacaacctgctcctcctgcacgtcctcaaggaccccgactacgagcagggcgagaccctcctctgggaggcctccggctcgcctttgatccccctctcggagttctctcacccttcaactgcaaagaaatatggggtgaagcctgatgctgaaacgctggacatgctcaacactatagctaagcagaaggaggtctccgtggtttcaaaagtcctgtttggagatccccgcgagaagctgtgccaagccatccatgacatgcccatcagctccctggtcattgggagcaggggccttggcaagctcaagagggtgctcttgggcagcgtcagcgattacgtcgtgaacaatgccgcaacttattgaaccatccagtgttatttgtaataataattgacaattagcctgtggatgattcccaggtgtgtgtaatctgtgcatgtgtcctgtacatcctgtacatttgtgtgcttatcttcagccta

SEQ ID NO: 57283 - DNA, 507 bp, Triticum aestivum
  Clone ID: PAT_TA_57283
ccgggctttactctcgcaacacacctaccacgcgcagcgcgcagagggagatcgagatggcgacggagctgacggcggcgcagctgcgggcgtacgacggcaccgacgcgtccaagccgatctacgtcgccatccgcggcaaggtcttcgacgtctcggccgggcgcggcttctacgggcccggcggcgactacgcgctcttcgccggccgcgaggccgcccgcgcgctcgccaagatgtccaaggacgccgccgacgtctccggcgacctctccggcctctccgacaaggagctcggcgtgctcgccgactgggagtccaagttccaggccaagtaccccgtcgtcgcccgcctcgccgcctgatgtgaagtcaatcgggccaccggcacccctcttccgtcctcagctactatcgtatcctcctgtgaccagcagctccaccgtgtgtgtcttaagtgattacatgttgcaaattcatttgtacactttatgtctgttgaaggtg

SEQ ID NO: 57284 - DNA, 770 bp, Triticum aestivum
  unsure (1)..(770): unsure at all n locations
  Clone ID: PAT_TA_57284
ccccatgaagactctttctcattcttgccctccttgctattgtagcaaccatccgtcacaatcgcagatagagttccagagccacaattgtatgcacaaaactccatctcatgcaacaaccacaaaagcaagttgcattgagacatcaacaacatttttgaggggagcaacgaccatttccatcactacagccatatccggagctgcgaccatttccatcacaacaagccatatatgcagctgtaaccatttacgtaggcgaaactaccatatccgcagacgcaactaccatatccgcagccgcaaccatttggaccacaacatttatatccacaaccgcaaccacagtattcgcaaccacaacaaccaatttcgcagcagcagctgcagcagcagcaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttggtcatgctattattctgcatcaacaacaacaacaacaacaacagcaacaaccgttgagccaggtctgcttccaacagtctcaacaacatnatccatcaggccaggggctccttccagccatctcagcaaaacccacaggcccagggctctgtncagcctcaacact

SEQ ID NO: 57285 - DNA, 213 bp, Triticum aestivum
  Clone ID: PAT_TA_57285
gccatgccgggcgaggaagaaggaggtgggcggctgttggattgatatccaatggttggggtgaatcaacttagaattaaaaaaagggaaattgttttataagttctcatttattacatctcctcatcgtgttttcaggagttagggtatcacagaattaagtgaagactttccgcaaaaaaaaagaattaagtgaagacgtggttgtttttc

SEQ ID NO: 57286 - DNA, 268 bp, Triticum aestivum
  unsure (1)..(268): unsure at all n locations
  Clone ID: PAT_TA_57286
cgccccgcgtccgtcacatattgtcaatacccggttgtgaccatcattgcccctgcgcttcttttcttgaacccctggggattacggcggccgttgtgccttctccgccatggccggcggcgtcttcggctccaggcttacggcccccagcttgcgccgttgtcgctcttgtataggggggggctacttccagttttttttctgcttctctccgtcgccgtggctggcatctccttgccgtttccgancttccccccccttcctctgg

SEQ ID NO: 57287 - DNA, 322 bp, Triticum aestivum
  Clone ID: PAT_TA_57287
taatcgccttgcaccacatgcccattctaacgcggacaagcacagaagatgcccgcacagtgccgctttgagcaggctggcaggctgagaggcaatggcgacccgccctgatacaactctttagacgcggcatggggcttaggcacgcacacactgtacgtttaccttgacagcgacctatggccacatcctttcattttcttgcattactttctagccataatgcgcaatgaatacctgttcatgtctaaaaaaaaaaactaaatttaaaggggccggacgacctgcttttacggcaccttcgaccccagaaaaactcaga

SEQ ID NO: 57288 - DNA, 797 bp, Triticum aestivum
  Clone ID: PAT_TA_57288
ccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgtatgtattgcagcaacacaacatagtgcatggaaaatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagccctacagacgctacctgcaatgtgcaatgtctacatccctccatattgcaccatcgcgccatttggcatcttcggtactaactgagaagaaataactctagtactagatatatgaaacaccgttttctcagtccatggttttggtcgttgtagcggtgaaaaaatatgtgacatgcactatc

SEQ ID NO: 57289 - DNA, 371 bp, Triticum aestivum
  Clone ID: PAT_TA_57289
caaacgttgtgctaacatatgaaccagtttgggccattggaaccggcaaggttcatgatggtctgaggaagtggctccaagctaatgttggtcctgcagttgctgaatctaccaggattatctatggaggctctgtaaatggggcaaactgcaaagagcttgcggctcaacctgatcttgatgggttccttgttggcggcgcttcactgaagcctgagtttgtggacatcatcaagtctgccaccgtgaagtctgcttctgcttagttgtttttgagatggacgcagttgcttgtaggagtgaagtctgcttattatctttataagactgttcgaccatcttgttcaaattcgagtgcactgtcatgtcgt

SEQ ID NO: 57290 - DNA, 281 bp, Triticum aestivum
  Clone ID: PAT_TA_57290
ctcgccccagttcgaggaaataaggaacctagcgctacagacgctacctgcaatgtgcaatgtctacatccctccatattgcaccatcgcgccatttggcatcttcggtactaattgagaagaaaataactctagtactagatatatgaaacaccgttttcttagtccatggtttggtcgttgtagcggtgaaaaaataatgtgacatgcactatcatgtaagaacccgaactatactagttcaaacttgggaataaaagacaaacacaggtcttgtctac

SEQ ID NO: 57291 - DNA, 646 bp, Triticum aestivum
  unsure (1)..(646): unsure at all n locations
  Clone ID: PAT_TA_57291
cttgttgatggtcctggtgaagggagtaagagacttggtgtgcggaccaccgttgctattatttttgcacggttgatcttggttccaattgctggggttggcatcgtaatgctagttgataagcttggtttcattcccaaagatgacaaaatgttcaagtttgtcctactactgcagcattccatgcccacatcagtgctctcaggtgctgttgcaaacctcagagggtgcgggaaagaatcagccgcgatcttgttctgggtgcacatttttgcagtgttctccatggcggggtggattattttctacttgacgttgctcttctaaatactgcattcaacttgaatatccgcaaatagtagatcatcagaaaacatggaagaagataatagtgtcatgaactgtacaataggccaccgaaaccatggtggcagctgctctggaggtacgagttgtatcagtacagatatgggttcctcgtacccggtttgtgtaaatgcctttgtcatgttaattttggccttgttcctctgccacttgtcatggcgagggacgagaatcgccggcatctggtgcctgcccatattattaggtcgccctgaanaaccttttagatccgtannaanaaannnnnnnnnnnnnaaag

SEQ ID NO: 57292 - DNA, 761 bp, Triticum aestivum
  Clone ID: PAT_TA_57292
cacaagggcaacaagggcagcaaccaggacaagggcaacaaggtcaacagccaggacaagggcaacaaccaggacaaggaccatcatccatcgttacacaactgaagcacaagcatcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggcaccggagttggtgcctactgataaggaaagatctctagtaatatataattgg

SEQ ID NO: 57293 - DNA, 775 bp, Triticum aestivum
  Clone ID: PAT_TA_57293
ggcagatgctcccttctttaagtgagctagtatcaggtcaggttgtctttttttgcatggatgttatcagttgctgttcggtggtttcacaacaacaaccaccattttcgcagcaacaacaacccgttctaccgcaacaaccaccattttcgcagcaacaacaacaatttccgcagcaacaacaaccacttttaccgcaacaaccaccattttcgcagcaacaaccaccattttctcagcagcagcaacaaccaccattttcgcagcaacaacaacaaccaattctactgcaacaaccaccattttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaacgttgtggcagagtagttgccatgtgatgcagcaacaatgttgccggcagctgccgcaaatccccgaacaatcacgctatgatgcaatccgtgccatcatctactcgatcgtcctacaagaacaacaacatggtcagggtttgaaccaacctcagcagcaacaaccccaacagtcggtccaagggtgtctcccaaccccaacaacaacagaagcagctcggacagtgttctttccaacaacctcaacaacaacaactggggtcaatgggcctcaacaccaacaggtaccccaagggtaccttgttgcagccacaccaaatagctc

SEQ ID NO: 57294 - DNA, 821 bp, Triticum aestivum
  unsure (1)..(821): unsure at all n locations
  Clone ID: PAT_TA_57294
ttatgtccgggggattcaagccaagcaagcagtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacatcaatttctggggcagcaacaaccatttccaccacaacaaccatatccacagccgcaaccatttccatcacaacaaccatatctacagctgcaaccatttccgtagctgcaacaaccatattcgcagccgcaactaccatatccgcagccgcaaccatttccaccacaacaaccatatccacaaccgcaaccacagtatccacaaccacaacaaccaatttcgcagcaacaagcacaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaantccgtgctatcatctactccatcatcctgcaagaacacaacaggttcaggggtccatccaatctcagcagcagcaacccccacagttgggccaaatgtgttttccaacccccacagcagtcgcagcagcaactcgggcaacaacctcaacaacaacaat

SEQ ID NO: 57295 - DNA, 374 bp, Triticum aestivum
  Clone ID: PAT_TA_57295
gaactgttctgccccgctgatgtgcatagggcggtcatagtggcttgaagaaagtgatcatcaagaattgaagaaggtgattgcagcagttttgaagatgcaactttgcaatttttggaaatacattgttgccagtagtgtgctatgttcttttttttgtgtcaaatgaactccatgtaaagcaaatcagttatgggcctctatttggctggaatgattctcaatagtttgtagtaaggaaacataattatatgtttcagtgattttgttggaagctataaccgtgtggtggtttgttggaaccaagttataccagttttgctacttggtactcaaccttttcaagttttatggaacacttctcagtttttgtt

SEQ ID NO: 57296 - DNA, 534 bp, Triticum aestivum
  Clone ID: PAT_TA_57296
tcattatggtgtacgatgttacccgccgagaaacattcacgaatctgtctgacatatgggccaaggaaattgacctgtattcgaccaatcaagactgtataaagatgcttgtcggaaacaaagtggacaaggaaagcgagagggccgtcacaaagaaggaaggcattgactttgccagggagtacggatgtctatttctggaatgcagcgcgaagaccaaggtgaacgtggagcagtgctttgaggagctcgtgctgaagatattggacacgccgagcctgttggcggatgcatcctctggggcgaagaagaacatcttcaagcagaaggcaccagaggctgatgctgcggcgagcggctgctgttgatttcagtcacgctagctaatcccggacatctatctttgtggaggatggatgaaaacgtttgttgtttgacatctaagcagctcgtttgtgtcgttttcttttgcttgtgttgctgtatatgaatcaatcagtcagtcagtcagtcaatgctcctcatgttgaatca

SEQ ID NO: 57297 - DNA, 525 bp, Triticum aestivum
  Clone ID: PAT_TA_57297
cccacgcgtccgcccacgcgtccgaaaaaaaaaaaaaaaaaaaaaaaaaaaaaaaaaaaaaaaaaaaaaaaaaaaaaaaagaaaaaaaaaaaaaaaaaaaagggggccacagctctaaaagacccacgatttaagaactcgtataaaggggggtcataggctcttctggtaggcggcccgttaaatccacgtgacggggggggggttccccgccgttgtggactggcaaaaccttgccgttccccccctttttttccttggggggattcccgatttaggccggctttaccaatagttatcagccccgaaccgaccgcctttcccaccgtggcgcaccctgaatggggaatggaacgcgccctttcccgtagctttacccccccgggtggcggaggttacccgcaccgtaaccgcccctttttccggggctttagggccctttcttttcgctttcttcgttttttttcccgacggtttagccgggtggccccgccatggtctaccttgggggctcccttgggggct

SEQ ID NO: 57298 - DNA, 762 bp, Triticum aestivum
  unsure (1)..(762): unsure at all n locations
  Clone ID: PAT_TA_57298
gtggcacatcgcgccgccggagggccgcgccttcttccaccaccccaccggccgcttctgcgacggccggctcgtcatcgacttcctctgtgaaagcttaaacataagctatctgagcccttatctgaaggcaattggttctaattacagtaacggagtgaatttcgctattagcggttcaacaacactaccacgggaagccctttttgtattgcatggacaggtgcaggaattcttcttctttaaagccagatcattggagctcatcaatcaaggtcaggaagctccaatcgatgcagaagcgttccaaaatgctctatatatcatagacataggacagaatgatattaacgctcttctgtccaacttgccttacgaccaagtagtcgccaagctccctccaatacttgcggagattaagtatgctgttcagcttctgtacggcaacgggagtcggaacttctggatacatggaacaggggctcttggttgcctgcctcagaagctctcgattccacgtaaaaacgacagtgaccttgatcagaatggctgcctcaacacatacaacagagctgcggtcgcgttcaacacagcgctaggcagcctctgcgatcagctgaatgtagagctgaagaacgcgaccgttgtgtacaccgatctctntgccatcaagtatgaccttgtggccaaccacaccaaatacgggttntgacaacccaatgatgacgtgttgcgggtacggagggccaccgtacaactatg

SEQ ID NO: 57299 - DNA, 637 bp, Triticum aestivum
  Clone ID: PAT_TA_57299
aattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgtttaaaggaaccaaagttaacgaccccgggctggcaaggaaaaatttttttaaaggggcccccaaaataaaattccgggcccgggttttaaaacgggggggaggggaaaaccctgggggtacccaaattaaaccccttggaaaaaaacccccttttccccagtgggggaaaaagcaaaagggccccaccggaccccctttccaaaaagtggcccacccgaaagggaaaagggacccccccctgaaggggccaataaaccggggggggggggggggttccccccaggggacccgttacattggccaggccctaagcccccgttcttttggttttttccctttcttttccccccaggttggcgggtttcccccgaaaggtttaaaagggggggcccctttaagggtcccaattaagggtttaagggcccctgaccccaaaaaaattggtttggggggagggtccccgaaggggcccacccccctgaaaaagggtttttccccctt

SEQ ID NO: 57300 - DNA, 574 bp, Triticum aestivum
  Clone ID: PAT_TA_57300
cccacgctgtccgaaaaaaaaaaaaaaaaaaaaaaaaaaaaaaaaaaaaaaaaaaaaaaaaaaaaaaaaaaaaaaaataaaaaagaaaaaaaaaaaaaaaaaaaaaaaaaaaaaaaaaaaaaaaatattgtatagagaaacaaaaaataaaataaattgaaaagggggtgtcccttcttgggattgccattttccgtgccgttccccgtcgtactccgcctttttttttttggggccttccacctttctgtcgttgtgccggggtgttccccccccctggcgcgggtaacaccccggggcgctcccacgtttggtttcttggggccgcgcctctctttttttgcattggggggggtgggtgagggggccccgcccattgtcctttctacctttggcggccccctaggggccgttggttcccccctttttctttcctttttggccgggggggggggggtgcctcccccgccggcccccgttctttttgcttcccctttcgccttattttttttcgtttttctccttccttttatgccgttttggggggttttcccccgtctggggccttgggggg

SEQ ID NO: 57301 - DNA, 239 bp, Triticum aestivum
  Clone ID: PAT_TA_57301
tgtgtactttgtgtctaatgaaaaacttgtcttcatgaaatgtcatattccccaagtttggtcttggtagttagtactgttttaatttctaaaattatgaatctatctgcacagatcataatcaagcaggcccagaagctctggctgtcgttggtaagccagggcaacaaagggctggcacaccacaccagttcatgattttgcagagaccaatttgttcagtaccagatggcagattt

SEQ ID NO: 57302 - DNA, 561 bp, Triticum aestivum
  Clone ID: PAT_TA_57302
gccggggtcatcaactatcaggcattcacaaactccgagggcatctacagtgttgcggagacgatgccggagagcgaccgatgggactcgtgcctggcgaggcccatcagcagcttccaccaccattgcaccaggaggggcgatgcacactctggggtcaagttcacatacaacaaacagtcagggaactcgcacaacgtcaaggcattcctgtacaagcctgccaatgttccgctgtactgtagctgaaatgtgtaggatgggttcatgcccgggcctgatatataagtaaacatgttgtaagatctgaaagggaaggtgttggtcggtccctatgcttgtaatggtctgcgcatctagaatgtcagtcgtttgaagggatctgatgtcgaatgcctacttgttgtaaatcattatatgtttttgagccatataaatataatagatatgtgtaaagagttgaataagaaaaaacataggaaaatcaatacctggaatcctggagtacatgctactgttgaaaaaaaggagaaccagggaaaaaaagattggatcatatgg

SEQ ID NO: 57303 - DNA, 572 bp, Triticum aestivum
  Clone ID: PAT_TA_57303
caaggacttgcatggtataagaacatcggacgtctgcaactacaccgtgaccaagctcgaccggctgctacggtcatgaaaaaattccaccggcacgtttgccagatggaaatgcgggctggctgttttaacgactccatgtttaaggcctgcggcatgcgcggtattcatgtttcctgtttacgtcaccataggtttcttcagagacagcctttttcatgacccgggtgtggaaaagccgggcagcaacctgattaagacccctgggcaggtgctcctcttttgccctctgcagaagtggacaagagtccctcccaagtcaccctttccacaagaggatcaaagccaacatgcagatggtcacccgccatatccctgaggattactcccagggcctgtgcagcattaacgatgagaagcccgttctgttccgcagaggacctagcccccgaacatttcccatgtttcgctttcttttgcatccgaggtctgggatttccccaactgagctctaacctgaggccccattttacgtctacgattactcgcttcacgggacgctgacccagaaa

SEQ ID NO: 57304 - DNA, 779 bp, Triticum aestivum
  Clone ID: PAT_TA_57304
cggacgcgtgggtggagcctatgggtgtggtgaagcagtgtcgcctagaatgtggatggagtgcccattgcactggcatgaattatgtgttgccaagcggtgtctagaaaattaattttgaaattttagaaataagatctacacgcagtgataatagggtggggatttttagaacctaataaagtgttgcggagagacatggaggatgtgtttagtttagtggatagccacccaatggactgggatagccagttttagagggtataccggtgcttgcatttgtagtatccagacaaatatggtatgcaatgatgaaatcctgacgatctacacccacatcactgtattttgttcacttgcttgctttccttgctattattgatggagcaacagaagaggcttttagtgttgtaatatatgcccgacttataaattcaatagctcaagaaaactttcaaaaaattactttgattggctaaagtatgcacatgtatataacatgttatctttttttcttcagttaactacatgtgaagctgaagctaagccaatgtgcttttccagaagaaggccaaggcacatcaatccaacaccaacccacctgctatggaactaagggaggaaggaaaaagaacattgcccctgaaggctcgggacgcacaaacaggaagctgagttcggcaaaggtatttgatctcaggctttcttaagtggtccgtactaacaaatgaaatgcgcagaaggagatacttatgttgttctattgttgcagacacctt

SEQ ID NO: 57305 - DNA, 559 bp, Triticum aestivum
  Clone ID: PAT_TA_57305
gcggatcaggagacgtatgactgtctaacctcttgtgctgatgtccgatcatcctagctattgcggtatccgtgtcggctgacgaatgccagggtgatcgacacgccgtgatcaatgagtgtgctgagcataacacactggccagctgaccccaagctagatacggaggacgcatgctgcgccgacaggcagaaggcacacattccatgcctttgcgctactgtcgccaaggagaaagagaacatatattgtatgcacaatgctggctacgcatgccaatttctgcaagaggcgcggcccacatggctacaaaggcagatgctacacattctctactctggcgcagcgactctagtttagctatggcaggatgagcgcatgcttctacattccatgtgcctggcctcacaataggattccttgcagatctgtaattatagatgttgggctcagaatagtttatgtcgagcactgctggagagaacattatgcaaactaatcaaagcttctgctcatctgtaactaggctcgttgagggctcgtcgctctataggatcca

SEQ ID NO: 57306 - DNA, 488 bp, Triticum aestivum
  unsure (1)..(488): unsure at all n locations
  Clone ID: PAT_TA_57306
cccacgcgtccgggacaccaaccaggacaagggcagcaatcaggacaagagaaacaaggctacgacagcccataccatgttagcgcagagcagcaacaacaacaaccattatcgcagcaacaacaacaaccattatcgcagcaacaaccaaccaccgttttcacaacagcaaccaccattttccacatagagtttcatctcttcatcgtcagcagctgcgttgaccatgtagtcacacacggaagacctacatcccaagttgcaatactcaatggtgtctggttcatctgagttggactcaagggccaatttaggacctnttggggaaacacattggcccaactgttggggttgctgctgctgagattggatggaaccctgaacctgttgttgttcttgcaggatgatggagtagatgatagcacggattgccacctgttctgtatgaagcttcaattgtttgatgagaccttgctgtttctttctcg

SEQ ID NO: 57307 - DNA, 394 bp, Triticum aestivum
  unsure (1)..(394): unsure at all n locations
  Clone ID: PAT_TA_57307
taatgcaacatgcatccacatgatgactgtnattngatcagggntggcgttgctgccttgctctccgcgcggggttaagagctgtccgaccccgcgtggttggttctgcctgttgcgggctcctacgctgcgcgcttgtcgtagctgcgtgtcctttggtgcgctggcccagtgcgggcgggtgggggcatttttttttgtgggggtctcggggctgccgtgtgtggggggtgggctacagngggccccgccgcccccgtcttgtgtgtgggggttgtgtgtgtgggtgacgctggagacctttaaaaaaaaaaaaaacctgggggcgggctcgttgccgggtgccggggggggggtggcgggtttttgttttttttggggggggggggggggg

SEQ ID NO: 57308 - DNA, 492 bp, Triticum aestivum
  Clone ID: PAT_TA_57308
gaggcattttggggggctgtgcggcatcaaagcatgacaagggcgtgctggccagcacgcagctgctccgtgagcaagacccatgggcgcgaacaacagggactcgggaagcatgggatctcgagaactgatctccgacctaagtgaccagggcgccctctacgacgactgagaaccatgcaggctagtgggaggggagcaggacatgatgcagcaggctcttattgatgttatgcacacaacgttgggcacggcactctatataagatcaagggcaacagggttactaccgccctttgttgttgcaaccaggatcaagggcagcaaggctacgccagacccataccatgggaccgcggacttccaggagccacgcttactggcgccaacggcccagcatctagcgcctcaattgtcggcactgagccggctggctggcctgacgtcttgccgaccaggcatggataaaccttgctgcaactctcatgaagc

SEQ ID NO: 57309 - DNA, 770 bp, Triticum aestivum
  unsure (1)..(770): unsure at all n locations
  Clone ID: PAT_TA_57309
caatatccagggcaacaacaaccatttccaccacaacagccatatccgcagccgcaaccatttccatcacaacaaccattgccgcaaccgcaaccatttctgccacaactaccatatccgcagccacaaccatttccaccacaacaaccatatccacaaccgcaaccacagtatccgcaaccacaacaaccaatttcacagcaacaagcacaacaagcacaacaacaacaacaacaacaacaacaacaacaacaacaacaacaacaacaacaacaacaacaacaacaacaacaacaacaacaaatccttcaacaaattctgcaacaacaacaactgattccatgcagggatgtcgtcttgcaacaacacaacatagcgcatgcaagctcacaagtattgcaacaaagtagttaccaactgttgcaacaattatgttgtcaacgtttgtggcagatccccgagcagtcgcggtgccaagccagtatacgaaatggccagcagagccaaagctagacccatcgaaggcgtgttgtgctgtgtggcagaaggcgaacatcccatgcctttgtgccggtctcaccaaggagaaagaaaagatatggtgtatggagaaggtcggctatgttgccaatttctgcaagaagccattcccacgtggctacaagtgcggaagttacactttcccacctctggcgtagtgatgctattttagtcgcgggaggagaaccattggttnttactttcatgtggctggcggcctcacaacaact

SEQ ID NO: 57310 - DNA, 245 bp, Triticum aestivum
  Clone ID: PAT_TA_57310
accctttgccgcgttcccatgctggagacgatggcgaccacaccgccgtgttgctcatgctgctggtcgccaatataacggaaagaggcctgtagggcctgatgattggggcgttcgcgctggggtgttttcctcccgaacgagtgggttcggttgatcttcgtccggtagcgaacgagttgttcggtccggggtctcccataccgaacgtcagtgccttatcggggtccttaatatatattgcc

SEQ ID NO: 57311 - DNA, 749 bp, Triticum aestivum
  Clone ID: PAT_TA_57311
gtgtgatcaccacagaactaaaagacagtgtttggtactgaattgtagttcgctttgttaatttctgcaacaccatttcatatttacatttgaattgtacttacttagtttgtaaggccttatagtttcaatgctttatttgcttgtggagctacggctctgttacattttgatgattatatatttttgtatatgaaatttgtagaacaaaagtaaaaaaattgaaggcccaacttactttggtattaaggtaattaactctaggttccattgcaagagctcaagcatgttcttacatgattactccaacttaggagtactaccaaacattggttcatttttctgatagattcagttatggcaatactgaatcatttttggtgtgattagggacaaggagctgcagtgtcatggattggagcgaaggggaggtcctgacggctgaagatggtgtggataggaggagctcaaagcggcattcccatggagggatggctgatgtcaaggtgctaaaatcttatgtgtcaagggcattgtgatggcacgatccatgtctcctgcgagtgctcgacatcccgtagccccaaagaggagggctccaaggttggacaacaagcttcactggatgaaagcatttcccttctaaaacagagtgctgctgacatgaatgcacaagttagtcttgatactaagatggtcatggaattgcttgatctatgctaggtcaacatgtcagccaaccacttaaa

SEQ ID NO: 57312 - DNA, 216 bp, Triticum aestivum
  Clone ID: PAT_TA_57312
cgaggacggcatggacgaggatgtttgaactcttgaagctgaaatgaagcttgctgaagtgcctgtcggatggagtgtgtagatgagttgcggtgaggctctgtgacgcgtgtgtcgtgtggccggaagctgttacggcttcgggaataatcttccttctgtgtttttgtgagtcggttgaaagcgaagagaatagagtgtcttgtgaattgcctt

SEQ ID NO: 57313 - DNA, 418 bp, Triticum aestivum
  unsure (1)..(418): unsure at all n locations
  Clone ID: PAT_TA_57313
cggacgcgtgggcacgcagcgccccacctccctccccacgccgcgccccacttctccccctgcgccgccccacttcccttcccacctccggagcggagcacccctacccaacccttcttctccggcggcgccgcccaccaccacctccggctgcgtgccacgggcaccaccatctacaccggccgccacgctcctctttctcccacaccatccagcggacatggcaggatccggccgccctcggcccccggcgcggcctcagccaccggatccggccaccgccggcccctcagcgcggaagccaccccgctcgcgcagctcatcgccgaatccggcgagatccgtgtgggtgcccctgtcccgcgccgccgagaccgcccctgtcctgcgcccttccgatgggaggatgngggaggag

SEQ ID NO: 57314 - DNA, 530 bp, Triticum aestivum
  Clone ID: PAT_TA_57314
tatgcctgctcagctgtacattcatggagtcagggccgtgcaatattcgggagtggaagcccatttgatccggtgaaatataatgagaagcttttcgtacccgcacaggcgaacaatgcatacatcttcccaggatttggtttaggtgtagtgatctccggggcgataagggtgaaagacgatatggtccttgctgctgctgaggccttagccgaacaggtcatggcggagcatttcgacaaaggcctgatctatccacccttctccagcatcaggaagatatcaactaacatcgcggctcgagtcgctgcaaaagcctacgacctcggactggcaagccatctccctcgcccaaaagacttggtgaagtacgctgagagctgcatgtacagccccatctaccgttcatacagatgaagccatggcgcctcatactctgaccatgaataatgttccgtcgaacctagactgtaattttgtatgtatgcttgtttagtcgtatttcctttgttatcatattatgcactctt

SEQ ID NO: 57315 - DNA, 731 bp, Triticum aestivum
  Clone ID: PAT_TA_57315
gcctcctggcctagttcctcgtcaccgtcctcctcccggtccccgtccacctccgcctccacctggtggtcccagaggcgacgactccccgtcgcctcggccaccgtagagctccgcgaggccgccgcgggtggtggagactccgtcatgacgccgcagcccaactcaagtgttaagttcagcgtggaggcagccctgcaggagctgcagagcagcgggttgcactcggacgacgtcgggatcggggctgcggaagcctggaaggcctacctcatggctaagaaggccaagctggacgagaccctggctgcagcccgccagttcagagcactgcttcggcagcagctccagaaagccttcgcgtcacaggttagggatcaaaaggcagcacaaaactgactagttatgtggtacaagcaaaacgacattcattagctagctcatcaatcgcttcagattaaggatgcaatgcaagtgtggcgggctagtggacagtaacatagtagtacaaatgtagtgttacttataggcagatgttgagcaaattttgaactaatggatgagtttcgtgggacgaagcgggctgccacttgcactcctcctactgatgaaacgaacttcaaatgtctctacatgcaagtacctgtctcatgctttttatttcagtcttttttagaggaggccccggcggcgtcgagctgctgttgctgcgggcacagcgacgtcggcgt

SEQ ID NO: 57316 - DNA, 275 bp, Triticum aestivum
  Clone ID: PAT_TA_57316
cgcgaataagtctagtcacggcactccactccatcctactacttggaacttgtacatagcacgagctaaatacaagttccaagtagtaggatggagtggagtgccgcgaataagtctagtcacggggacacgcattttggtccaaactttttttgtcttgttttgtgggagtaaaagtaggaactgtatatattaattgtccacatgacagagttgtcttgtgggatttgcctcgacatggctcgtcaataatgtaccatgattcttgtgctgta

SEQ ID NO: 57317 - DNA, 777 bp, Triticum aestivum
  Clone ID: PAT_TA_57317
taaattcaaaggtcatgtaatattttacttaggttcattcaaatatctggaattgacatgcatatgtttcttgtatgtgcacacattgttggttgtatcttaatatgagttctttatatgttgcttgcctaaattcagaagtgaacttttgctgtatatttggtcgatgtgtgtcctgtaaaccgtaaacttactaggtgtacatgtacatgcgtatttgttacactattatcatatataacacttccagatcagaatatacagatatctcctttttacataaataatcgtgattgttctcatacaatttggcatttcaagaatatcgcagccacacaagctaaaggttcaggaagtttagggaaagaaaagttcttattgacaaagatggtggtatggataagtccctattctcattgtcactggtacttcatttttcttatattttgatgcttattttttcgtatgtaggtgagttttatctggtatcactttttgacatggacatgtaccatatgattgttgagtttcatctgatttcactttttgacatggccatataccatggggtatagtatttatgaagagtggcttggaaattgcaagtagatggttactctagccgtatagcttatttaattaggagtgagatgcttgctaagatgaatggtgtttctgtaagggcagacatattcctagcactggattatgcacatgtaaggatacttctgtacgaatgcagctcacacttaccacggtcagaagagtcttgcatga

SEQ ID NO: 57318 - DNA, 657 bp, Triticum aestivum
  Clone ID: PAT_TA_57318
ggcagctcctagggcggatgatgaggagtttgctgatgctggagaaactgggtattcggagtcaccatctcagggagtggatggggcatcaccgtcctctagtactggcacttcatcaaatgtaccagtgaagcagccggcagctgcagccgcagcagttgctgctccgatcccagatctcctaggtgatttaatgggtttggataatgccctggttcctgttgacgaacctaaagcatcttcaggacctccactccctgttgtattgccttcaaccactggccaaggtctccagatcagtgcgcaactggtgcgacgggatggccagatatactatgatatatcttttgagaatgggacccatggtgtattagatggatttatgattcagtttaacaagaacacatttggtcttgcagccggtggaccacttcaggttcctccactccaacctgggtcctcagccaggacgctcctagctatggttttctcccagaatgtctctcctggagcaccaaactcgttactgcaggttgcagtgaagaataatcagcaacctgtgtggtgtttgagcgacaaaggcttgctgcgtgtgttctttggtgaagatggctctttggtgcggacgagtttttcttgtggccctggaaattcttt

SEQ ID NO: 57319 - DNA, 583 bp, Triticum aestivum
  Clone ID: PAT_TA_57319
gttacttaacgttatcattgcagattgaagtttgccttccaaaccaatatcgagttgtagggatattgaactgttataatttacagtacaatgttgctcttgttgacatcatgggattctggcgtcctcgtacaataaaaatccatgggcatccagttacctcatctatggacgtaatagctgtgggtagtctttttgcgtgtcgcaaactaatggctgttgaggggaaggtgttgattggcaaacaaagcaaacttgattgcaaagaactttgtgtctccacctgtaaaatcaccaaggctgggattggggggcctcttattgacaatgatgggaattttgttggaatgaacttttatgatgaggaagaaactccgttcctgccgagggatgttattcaccacctcttgttgaacttcaataaaaaacggtatgtcttaaaaaaaaaagaagctttgtaggttttagggatgttgtcctatctgtatattcatctctagttttcacatcgttcaatcattttcacttaaatataattttggcccaattggtttgggctgatatgacaacttgtgtgtgcccc

SEQ ID NO: 57320 - DNA, 415 bp, Triticum aestivum
  Clone ID: PAT_TA_57320
caccgtgacatcgaggatgtacggtcgtggctttctgacgtgccgggttatcaatggttcgggcccttgggggcgctcgctcctctatggttgtttggagtggtcggcgtacagcattggccgaatgcatagtttggattctgatttagaggcgtttatgcataattctggagactgtatcttcgagcttctggtttttcaaccaagcgcgatttccattggtgtgattgatcggttcctctgatcctgtgtttacttactattgctacattggaatttgtttggtattactaagctgtcttacgacgggatactctcaggtgacgttcttgttttgctgggtgatctatctatttacttggtgatgtttgcttgactatgatatgaatagccggtgtcgggggatcttaaaggt

SEQ ID NO: 57321 - DNA, 198 bp, Triticum aestivum
  Clone ID: PAT_TA_57321
cccggggtcggacccaacgccttcccgaaccatcagagacagcagcatgtccgataggcagatagcaggcaagcagcatcagcaggctttaacgaagtctgcagccacagctgaagccatgccaaggtgagggattgatacaacccagacaaccagcatgaatatgtaggagatcaggcaatagagaacgtaaaccct

SEQ ID NO: 57322 - DNA, 241 bp, Triticum aestivum
  Clone ID: PAT_TA_57322
gtcgagacgaggaccaagacagtactagaagacatggaggcaaacgacaccgcgtagccgccgcaaggctatatagacataaataacaaagggatctaagtggccttaaggtcctatatcaaagacttagaggcacgacggtgcagacggacaggagccttgccacctagtgcagcatatgcaccgaagttctgcaggagccccatgactaacggatattactggagatggagataccatt

SEQ ID NO: 57323 - DNA, 678 bp, Triticum aestivum
  unsure (1)..(678): unsure at all n locations
  Clone ID: PAT_TA_57323
ctaaaacccgcgaactcaccaggcggcggcggcggcggcgacagcagcagcggcgatggggagcgacacggagacggagaagaagaagaccccggtggcgctggcgcccatcgccaagccgctcgccggcaagaagctctccaagaaaaccctcaagctcgttcgccgagcctcggaggccaagtgcctgaagcgcggggtcaaggaggtggtcaagagcatccgtcgtgggagcaaagggttgtgtgtaattgctggaaacatctctcctatcgatgtgattacacatcttcccatactttgtgaggaagccaatgtcccatacatatatgtgagctcaaaagaggagcttgcgaccgcggggaccaccaagaggcctacctgctgcgttttggtgatgaccaagccagccaagggggagatcactgaagaggtgaaggagaaactggaatcggaatacaagcaggttgtaactgaagtcactgaggctacatcagctctgttctgagaacatttccatggcctgcgtggaggaaccatgaacatctttctgcctgtattatgtagcatgattttgtcaccctatccttgctagtgattgacgtgtttatcagcgagctttaagcattgcgagtatggtactgcgtgattagataaaanaatagtcattgttaacta

SEQ ID NO: 57324 - DNA, 689 bp, Triticum aestivum
  Clone ID: PAT_TA_57324
gtgaactcttcatcggagaaattagggggagcagttgttgctactgctgtggttccagatgaagtggacaaaattaaggagattctggtgaagtggagcgatattgaccgcgttaacctcatcttgaccttaggtggcactggcttcacacctagagatgttactccagaagcaactaaatctgtaatagagaaagaagcacccggccttgcgtttgttatgattcaggagagtttaaaggtgacaccatttgccatgctatcccgagcggcgtgtgggataagaggatcgacacttatcatcaacatgcctggcaacccgaacgctgtcgcggagtgcatggaggctcttctcccagcgctgaagcatgccatgaagcagctgaagggtgacaagagggagaagaacccccgacacatacctcacgctgaagccacaccagtcgatcagtgggagcgcagtttcagagctgcatcatcgggtggtggctgctcatgcgacccctgatcggcgctcatccacaggtggtggaacactcctggggaacctgttttcgtgatcctgctgcatccagtttcaagatcaatcggcgatggtttcggtttttctcgttatggctatttcgttactcttgacatccgaggacccgtgtgtatgtgctaccaataaagcagtgagagtttctttct

SEQ ID NO: 57325 - DNA, 296 bp, Triticum aestivum
  Clone ID: PAT_TA_57325
catgtatccaaactcctgtgtcttgcatttaagcaagaggcgagttttggctaagtgaagttttgtagcttgaatcctctttcatttcgcagcgatcaaacaaactcccgggggatgttcgtgtaaataaaactctatctagacttgtgaaaaaaaaaaaaaaaaaaaaaaaaaaaaaaaaaaaaaaaaaaaaaaaaaaaaaaaaaaaaaaaaaaaaaaaaaaaaaacaaaaaaacaaaaaaaaaaactcttctaaaaagaaaacataaaggcaattcattagggcgcccatttat

SEQ ID NO: 57326 - DNA, 580 bp, Triticum aestivum
  Clone ID: PAT_TA_57326
ccgcgccccgaccggcacgcggcgacccgctctcgcgcggagagcagctcgagcaatccgccgacaggcgacggacctcggagccgagacctcagagcccagtcctcagagccaatactttatcccgaagtgacggatccgtttggccgacttgcctagtcgacattgggccattggccagaggctgctgaccttggagacctgacgagggtatgagaacgaccgtgcgtgaacggtactcggatctcccgattttgatgggccggaggcggcgcaccggacaccgcgcgacgtgcggcggtattctacccactggagcctacctacgagtgaaccgattccagggttggcaagacgttaagcataaaagataactcttcccgaggcccccgccggcgaatgcggacttcctaacgtagacgtcaaccggcacataccgactcgggaaatcttaacccgaatgcgtttcagcggatgcgcgggatcgcgctatctgccggtgataccccgttcattaagatcggattaccgatgtgctagtgccgttcacatggaacctttttactgttcggacttcaaa

SEQ ID NO: 57327 - DNA, 759 bp, Triticum aestivum
  Clone ID: PAT_TA_57327
cgcctccgggcgccgctcctcttaggtgggccctcctaccacccttcagcgacgccatctgcgccggggttgacgggggcggcgtgtgtgaggctcgcccagactgcgccggtgaatcaggtcggaggcgctggtgttgacggcgccttcggggatgccgcagcggcaaagccagatgcaggatgtgacgggcctccacgcgggagtcgatatcagtttgtgatgctgcgcaacagtactcgggagaaaatattcgactatatgggaaggaagccatcctcggctatctattgggggcggctgccggagcttgcgaggcggctcgaggaaatcttgtttagagagtacccaaccaagagtactacaatatgatgaggggggcgattgagcaccacttgcggtttgccgtgaacctcttgagtgttgagaaccaacaacaacaacagaaccgacaatcgtcaaggggaagctcctgatgagcatgtgaacacactgccgcctctgggatgaaccctacacaccatgatcgtccaagagcatgcaacaacaacctcgtgatagacacagtggacacagctgcaaccaacggactcttgaaaccccgtgtacctgtgaaggaggcccgaaaggaaccaaagttcagctgcccagtctgcatgaatgagctggtcgatgcgtcatcgactatctgtggccacatcttctgccagaactgcattgaggcctccatccaagctcagagcaagtgaccgacctgtc

SEQ ID NO: 57328 - DNA, 172 bp, Triticum aestivum
  Clone ID: PAT_TA_57328
cggggccggaaaatcccgggatcgaccacacccttcccggttgatagagctgttgtagagataaagcagaaagctgaaggtgcatagattacatggctctttataaggacacccctggggatgaacctgcatgcaatagataaatctaaatgcattgaaataatgactgggc

SEQ ID NO: 57329 - DNA, 702 bp, Triticum aestivum
  unsure (1)..(702): unsure at all n locations
  Clone ID: PAT_TA_57329
gaagatttgacttacagaaaggagcactgcaggngatagggagtgtctgttctctgcgtgtatatgcacaagaaacatagcaagctgaagcgtgtaagccacgccgaaaggggctcattgacacactgcggaatcaaaagcccnctgttattgatacgacctatagacgcctggtgatactcgngttagatatatggtgcaggcacagcgtgctactacttgaccgcgggcaaatgcaaacgaactactagacggcactaacagaaccacgtgaaactcatatacggaggagtcagcttgatgcaagcacgagctcagcgatctggtgctgccagtgcatgctgcgacgaattgttgagtcgagaaagtctcagacctcggacttaaatatgtcaaatgctgtcgccggaagacctgatgatgaaaggcttgatgtgatgcggatattcgttcactgctcagcagggtctgcactgagatacctgatcatctgtgacaagctttggacgataagggagtgagggcattcacagagctggtaacatcacacggacgacctggaggaactctatgctgaggaacgatggaatgatcaccggaagctgctaaaggtctgtgtgagcttattccttaaactgagaagcttaatggtcttcactacctcaacaatatgactggtgatgaaagtgctatgggcattgc

SEQ ID NO: 57330 - DNA, 689 bp, Triticum aestivum
  Clone ID: PAT_TA_57330
ctgcatagcaccacacctagagctaaaatcaagtaaccttcatggattttgttgacaagaaagacaacgaacttaatttaacggcttgaagtcaattgcacatgtctcatactgtattgaaccttggccgaagcactcgaccacgacaagcagcagctcgggaagcctttgcaattcatgtatttacaacatctacagttcatgtatttactgtcatgcattgcaccttcatggtttttgttgtacttctgcatttgcagcatttacagcttaatgcaatcaggaattggttatagatttcatgtgatttaatttctaaatgttaactacagtgacaacttatgactttcataggttttatttccattgagagagagcgggcaatggatcgtgaggtggaatgaaattataagcaaattgatctgaccatctcttgttgtcagggaatctgtgtgatctgttctactttgacttggagcgtacaactatgatattgtacgtgatgatattttttttgattctgctactagaggtcagtcagaggtggtaattattagtggcacaaaagaggcgggaattattaccactctttttttgcaaaaaatgtgactgaaacaatgcctattgcatatggtttgtccttgtacgaaggctttggaaagaagcggccctcccttatttttatgaag

SEQ ID NO: 57331 - DNA, 804 bp, Triticum aestivum
  unsure (1)..(804): unsure at all n locations
  Clone ID: PAT_TA_57331
ctgaaaagtagataaaagtaaacgacaatattcttctctgcttcattgagaggggtcggcccctttataatagacaagacttggccaacaagccggtaaatccattcaaactctaatactatctctaaactgactggactctttcctaacaaagatggttaatcaactaggactctaattaagggaattaagggataagactccacgtttgatgggctggtccacacaacaatatgtgccatggatccatcaggtacacgtaccttatcctttcctgaacaaggtgtataggaagtgaatatatttgaagctcctgtcatgtgtttagtagctcctgcatcaataatccaagatttgattgtgttgtagaactgtgggcctgggtgaggtgntcatagcttggttcttccacagcctcgatctcatgcaagctagattcagcttttgaggaatcctgggaggaagacaagtcttctgagagtctaagcttgggaggtgaaaccctcaagagctcgcacatctaccacctacaactggtagcccccccccccctccccccgcggatgtagtcagattagcttgtcttgtatgagctccctcatctcccccttggctgagactttcatttttcccaccaaatttgatagccatgcagctcaaagcatgtatccttttgtgtgtccaacaggcttttttgcagtggctgcaaaagagttagcttttatctattttatcaaagtacttgggagcaccatgagcttgcatggacagggctgcacgtgcatctgctttttcttgaccatg

SEQ ID NO: 57332 - DNA, 167 bp, Triticum aestivum
  Clone ID: PAT_TA_57332
cagagcttcgagcaagaagagcagcatccagagcactctcagttagcttagtagtagtaccaacaccacttgtaaaatagccactatatcgaagatgttgtaatcgccaagaataataagggaccctacaggagaaactctgctagtagttctctgtttagccttgt

SEQ ID NO: 57333 - DNA, 718 bp, Triticum aestivum
  Clone ID: PAT_TA_57333
cgtgcgcgtacgtacgcggcgtgtgccagtggtttgcgggtgcaggccgccggctgctcgagtttagcgtgcccttttgcatgaagtggcactctccttcgtaccagcgtctggttctcgtgcttctagctttacccgcttcttagtttcagtagttctagtgcttttagcttagttgaagtgtttcttgtgcttctagcttggttgaagtcaagtcttctcaagctttttgtaaaaatgtataataattccactgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggtttaaagggaaaaaaatataagaggggggggtggaaaggaaaaggttttttttggggggcccaaaattcaattggggggcccgcgttttccccgcgggggggggggaaaacccggggggcccccaaattaatgcgtttgggaaaaatccccttttttcgcggtgggggaataacggaaaggccccccccaaaccgcctttccaaaattgcgccccccctaatgggaaatggacccccccctctttgcgggccttttaaggggggggggggggggggggttccccc

SEQ ID NO: 57334 - DNA, 513 bp, Triticum aestivum
  Clone ID: PAT_TA_57334
gacgaggtctgttccgattctcgcacgactgtgtctgcttttgactgactcacggtgcagctatcaaccgcgcagatgctgccacttattacgcctgaggaccgcaccgttaatccgcaccatacgatgaacaattaaactagtggagaccctgactattgcttctttgcctgctggacgcacctaagacagttgacacacctttatactcttgtgcagcttgcatgctttaatacaaattactacctccggtgtgacccggctttccagtcagcaagtaggccatgtcctgggaaggacactagcccctattaatggggacaacaccatcaaccatagaggtcaattcttggacaatatactgctgacaagcatgtcgtatgagtactcttcatgaccaggtgttctggcccaaacagggcctgctattcctttcctatcctacttgatgatgctcctcaccttgttggcgcactttctgtattcgggagcgtgactactggtgccgataca

SEQ ID NO: 57335 - DNA, 338 bp, Triticum aestivum
  Clone ID: PAT_TA_57335
cggggcatcaactaagagtggccattatggccgacacctgcgcagtcattcaaacgacactagggaaacagctttagccctgaagaagatgtcgctcaacaaggccaagaggtacctagatgctgagtagccacacacgcaaatcatccacttccggaggcactggcgtgatgatggacgcacagcccaggcgatagaaccttcagcaccaatgctcagggactctggcctgccaagccagatgagctcgctctggatcttctaaataatgctgagagcaatgctgaggcgaaaggtatagatgacgatgctctctacatttcacacatccaagggaa

SEQ ID NO: 57336 - DNA, 744 bp, Triticum aestivum
  Clone ID: PAT_TA_57336
ccgcctccctcggccccgcgccgctgcgccacctcgcctccgcccgccggtgcgcgtcgcaacctcaccggaccccaggagccccgccgcctcgcgctgtcacctgcgtcgcgtcgtgcgccgccacctccccacaagctcgtcgccccgtcgcggaagcctcgtcgctggtctcctcgacctcgagattcgtcgccgccatgggagcggagcatcgagctcctctgcaccccgcccgcgtccccgcgtcgccgccgccgccccaccctgcctcgcgcccggatccagccatgggaggtccggccactccggatccggcctcctcctcgctggaccttctacctcgggaccttgctgatgacggaggagcggcggcgcgccatatgggccatctacgtgtggtgcaggaggacagatgagctcgtggacggtcccaatgcgtcgcacatcacgccgcaggctcttgaccggtgggagaggaggctggaggacctgttcaccgggcacccctatgacatgctcgacgccgcgctctcagacaccatcgccatgttccccatagatattcaggtaccagatagccggtgcataattgttcagtccacattgtatgattctggtagaacagagtggtggtggatattccctgtcagcatcagattcccccggacctcacaatctcagtgcaagatgactagctaggcctttcgaagttgaccagaaagtcgatgatttgtcaaaatt

SEQ ID NO: 57337 - DNA, 552 bp, Triticum aestivum
  Clone ID: PAT_TA_57337
aggcggtggaggaggatggcggccgccgggagagagagagaggaaagagctccagccatggtgctcgtctactgtctaccgcaactatggtctgacattcaagaaaccaaggcgcgcttatgtgaaggagccgtgtgatgcagaactgagctggttggcgagtgtggactgacgtgcaagcgtgagctctggagggtgcacgtatgccttgagcacgatccgctatgcgcgtgcgacacgttgctcacactggatgagaagaatccccgccgtatctttgctggcgcggctacttctgcgtcctgtgaaccggtatggtctccttgctgagggccggcacaagctggattacgtgcttgccctgactggtgagaacttacttgcatggcgccttcatactctggtgttgaaggctggcatggcaaaagccctccaccctgcccgtgtcttgatcaggcctcgccacatcagggttggtgggcagatagtgaatgccccgtcgctcatggcgagggttgaatccgacaagcacatttgcttttcactgacaag

SEQ ID NO: 57338 - DNA, 551 bp, Triticum aestivum
  Clone ID: PAT_TA_57338
tgcggatccaccagaacatgcgagtggcaatgcttcaggacaagcagccagcgacggcatagcttcacagaatggagtacgacgtaggtgtccaagggttgtatcaggtcgcatacgaagatcctgaagttgcaagtagatacagtcaatagcatagttaaaggtgatatgggagataattaagttccctaggcaagctggattgaagcttgatgagccgaacccaaggggcgtgcttagtttctaccacaaaattctatcattcacatcaaccgatgttgcaaagcaagtaaaaatgtactagagtcagatatttgttggcaacggcttattgggctttttcaaatcaatattacttccactagcaggaaatggttcaagcatacttatccaaatcttataatcctgatgggagaaaacattgtgaaggagttcaggctgaatggccagttaacaagaatcgggtggatctgcgtgtggtggatgatcgtttacagggaaaggtgaatgtatgggttctggagatgatcagatggggccacgtattttga

SEQ ID NO: 57339 - DNA, 370 bp, Triticum aestivum
  Clone ID: PAT_TA_57339
aacgaggtttcgccaacccaattaagaggctcaagaggaatggatttctataacagcacatagaatctgatggaaacgaacaaaaaaatggcaaggcgacgccgtttgacagaaaccagcttcagtgacccgagaaggggaagtggtagttattcctttagcgttacctaatttcaatcacgtgcccgatctattacatcgaacgggaatggcaacacctggccgtcacccaatttaatcgcatgagaaaccgtccccctttcgcgggattgctgaaattggaagaggcccgtcctgtctgcctttccaaaaaatgccctgcctgaatggggaatggtactcgccctgaagcgtccaattatgcgggggg

SEQ ID NO: 57340 - DNA, 385 bp, Triticum aestivum
  unsure (1)..(385): unsure at all n locations
  Clone ID: PAT_TA_57340
ctccttccagcccacgctacccacgctcccccaccccgattcccccaaatctccatgccgttgccgctcaccgcgccctaggtcatgccgtccgccgggccgtccatgtcggcggcggatgggctcctcgcgctggcggaggaggccgagcgccgccgcgacttcaccaccgccacctcctgcctggagtcggcgctcagcccgccccacgccgcctcgctcctcccgctcgccgaggcccgcgcgcggatgcgcctcgccggcctgctgctcgcccgctccaaggngctcgccaacgccaaggcctacctcgagcgcgcgctgctcgttctcaacccgatcccctccgcgccgncgagcctcaagctgctggcgcactccgtcc

SEQ ID NO: 57341 - DNA, 513 bp, Triticum aestivum
  unsure (1)..(513): unsure at all n locations
  Clone ID: PAT_TA_57341
gaagaaccagcatgcccaaaggttcttggtgatattgtcgaatcttgtgttgctgcagttcttttagattcaggattcaacctgaactacgtttggacactagtgcttatgcttctaaagccagtgttgagcttctctgacatgcacatgaatcccatgagagaaattcgggaactttgtcaatgtcatgaacttgagttaggccttcccgaacctatgaaagctgatggagagtaccacgtcaaagtggaagttaacataaacagccaggtgataagttctgccgctgcaaaccggaattcaaaagttgctaggaagtttgctgcacaagaaacactttctaaactgaagaattatggatacacacataaaaacaagtcactggaagagattntgcgagatgctaggaagaaagaaccagaactactaggttataatgaagaaccaatcaaagtcgaggcggacatatctgcagaaatgaataatctgaagataggtaaaagaaagggatgc

SEQ ID NO: 57342 - DNA, 371 bp, Triticum aestivum
  unsure (1)..(371): unsure at all n locations
  Clone ID: PAT_TA_57342
aaaaaaaaatacanaaaaaaaaaaaaaaaaaaaaaaaaaaaaaaaaaaaaaaaaaaaaaaaaaaaaaaaaaaaaaaaaaaaaaaaaaaaaagggggggcggtccgttgtaaagaatccaacttaccctgcccggccatgcaatggctttttttttgtgtagcgtaacttaaattcattgcccgggcctttacttcacaacgacgggaaagacaaagccctgccccaaccaaatttattggccttgcatcccctttccctttggcgaggtggtgaaaaagagaacaggcccgaacggctttcccttccaaagagttgcccaaatggaaaggggaacgggcctcgccctggagcgttacattaggcggggggg

SEQ ID NO: 57343 - DNA, 240 bp, Triticum aestivum
  Clone ID: PAT_TA_57343
ctatctcgccgagaagtctccgatgtgatgcgaagcgaagccaagctctctcctcctcctcctaagatgcctatcttagtgaagacccttaccggcaagagcatcaccctatgaggtcggatgccttgtgacaccatcgacaacgtcaaggcaaacatccagcacaaggagggcatccccccggaccaggaagcgcctcatctttgctgagaagcaagctcgaggatggccgcacccttg

SEQ ID NO: 57344 - DNA, 618 bp, Triticum aestivum
  unsure (1)..(618): unsure at all n locations
  Clone ID: PAT_TA_57344
aaaggaaatccctgaacttttcctctccgaatcgaaacacgagagggcaccggaatccttccggtctccggcggcggctcgccctaaaatttactcgcgcggcgatctcctgcatcctaacgccacgccgcccccctcttttcttgcttgctaggtttagccggcttgctcgaacccgaaggcccccgctcgtcgcggcctccccgctccgctacctccagggatcagtcggtccaaataatttgccctcctctgtcatggaacgggcgcagggagcttcaaataatgcggcgaaacacaggaaaactaatccacctctgcagacatggaggccagtctcgacacaagcatctccccgggaagctcaccttgatgagatatccaattccagaaggaagcaaatggcagggacttccatcactgatagtgagaattcggtgttggatgaaacaacgaatgttggcattgaagtaaccaccaataatactttcttgtcagaaagtagttccacctttagttccagtgcaactaaagtagctgcagaaaacactatgngaggtaatcagagaanaatattcctcttctgttgaggtagatggtcctctaatggcatttctg

SEQ ID NO: 57345 - DNA, 609 bp, Triticum aestivum
  Clone ID: PAT_TA_57345
cttccatcccctcgctcagcttcagtcttctgtcatcgtcctccccatctcacatctgcatcgcgccgcccctcctcccaaatcccgtccggcgccgccgcaccccacacccgctgctgcccccactcctctagtgccatctccctcctcatcgagggccgatacctcatcgtccagccactctagcgccgcttccctccccatcgaccagcgcctcattggccgtccagtgcagccaccatgcctccaacgccagtctcccaccccaccgagcgccgagccctcgccacccagcactggtggtccttactccagagaggaaaagaattgctcaacgtggcatgcccaaatcaggatatgcagggaggtcggcccttgtgcagggtgaaaatcagcaccatgacagtgaaagacaacctcctggcggctggtggtttccatggggagcagatctgcaatgcatcccaccgccgatccatatccagatcagctgcgtcgccggtgccggttctacacataggtcaacatgccctgtttatatgaattgttttgtatctagcgactagttgtcacactgattaaaatctccgcgcaacgagcaaagtatca

SEQ ID NO: 57346 - DNA, 231 bp, Triticum aestivum
  Clone ID: PAT_TA_57346
gcggactagatttagatcgagccgacgtcgcctgcttcatccgcagaagctgcctcctcgcaggctcgatggtgtcataaagaaccagatgacatggtcctactgctagcgttttcgagcaagatcaagagaaggtgccaggggtaagaccgactacagggacagtctgaggctaacagaccagcacaagaacaaatacgttaccctcaagggcacgtttgttgtgcgatt

SEQ ID NO: 57347 - DNA, 346 bp, Triticum aestivum
  Clone ID: PAT_TA_57347
caaagataaaaaaggatttggctacccaggcaaaaaaaaagaaaaccaaagaaggaaaaccaaaaccgaaaaaaagaaaaaaaccaaaaggcggagaaaaggaacccaagggagggaaaacaggaaccccccggccgcccccttaaaggacccaacctaacttccccgggggggccccgaaataactttcttgggggggggcaaaacaagggggggccgggggaaaccctacacggacccaacggaaaaaacccggggggcaccccacttaagaggccgggagaaaaacccccttggccccgcggggtaaaccttaaaaagaacggcacagaccgcctgtccaaag

SEQ ID NO: 57348 - DNA, 546 bp, Triticum aestivum
  unsure (1)..(546): unsure at all n locations
  Clone ID: PAT_TA_57348
gagaaacgaactgaacgcgcacggcgacacatccggtggcacgcttcgtttggctctcagcgctcctcgtacgcacgcacgcacgcacgcacgaacacgcgcgacgcgggagccgtgacgcctcgccggcggtggggatgacgaggcggtgctcgcactgcagcaacaacggccacaacgcgcggacctgccccgcccgctccggcggcggcggcggcggcggcggtgtgaggctcttcggcgtgcacctcacgtcgccgccggtggccgcgatgaagaagagcgcgagcatgagctgcatcgcgtcgtcgctcggcggcggcgggtccgggggctcgtcgccggccgcggggccggggggcggcgccgccaggggaggggccgaggggcncncccggntacgtctccgacgaccccatgcacgcctcctgctcgaccaatggccgggccgagcgcaagaaaggtacaccttggactgaagaagagcatagattgtttctactgggtctgcagaagcttggcaaaggagactggcgtgggatatct

SEQ ID NO: 57349 - DNA, 425 bp, Triticum aestivum
  Clone ID: PAT_TA_57349
gaaatggaacactcgcttgtcatgttcaaaaaaaaaaaaaaaaaaaaaaaaaaaaaaaaaaaaaaaaaaaaaaaaaaaaaaaaaaaaaaaaaaaaaaaaaaaaaaaaaataaagaaaaagaaaaaaaaattaactgaccgaaagataaacaaaagacgagacgtgcgaaaaccctgacgtaacccaactaaaaaagacctggggggggccccccttttgggggctgaccttttacccccccggcccgcaccgattgctcttttttacgggtgcccctactgacatgtcgagggggcgggcccccgcaggggcgccttgggcaacccccggggtgccccctttttgcagggggggcgccactctcccctttcccctagcgcgcgatagttgaggtggccccccctcctgccctttcaccttggttg

SEQ ID NO: 57350 - DNA, 304 bp, Triticum aestivum
  Clone ID: PAT_TA_57350
aaggagtacaagcagctgcagaagggcgggaaggaggccgaccaggagagtagtccacaccatcgccaaccaggtccagaccatgctcgggatcacgctgatggagatcctgtggaagcactcctacgacaaggggcacctaggccagcgcgacgcgccggagtgaacgagggacgccgaggccctgaaggcgtacaagaggttcggaactccgctgatggagatcgagacgcgcatcctgaacatgaacatggacccggcgctcaagaactgcaccggaccgatgaagatgccctacatgctg

SEQ ID NO: 57351 - DNA, 385 bp, Triticum aestivum
  Clone ID: PAT_TA_57351
ccggatttcccgggccaaccccccgcccgcatggatagacgggagggcgcgcttcgttcttttatatctaagcgagcagcacgtccattgacggctccatagcggggaggaacaatattatcataatgctgggatgaccagctgtcgtacgaggacggcctgcgcagcctctcccgtataatccgaaacgaccacggtgtcgacaaggctcttacaccgatgcaccaagcgaccactctccttcgaggcgtcacgaactaccgacttaccatgatgtcgatgaacccgagcgctttcgtgacagccagacactcacggacagagacggcttcaatctactgagttcaggggcaggctttgctggcagggatcgacagcggtgaga

SEQ ID NO: 57352 - DNA, 612 bp, Triticum aestivum
  unsure (1)..(612): unsure at all n locations
  Clone ID: PAT_TA_57352
ccctattctanntggtggctacaagcccacaacacacacacacacacacacacacacacacacacacactctctctctacctcctcaggccgcccatcctcttcgtccccatcactggagcgaggtatcgtaggctcgcactctccccaatcttctcggcccctcctcatcgagtctgtcgccgaagtgcccaaggatccgctcgagctcggcatggttgctgggcgcgggactcatctccatcagattgggggcagtggcaatcgtgcgtcgcaacctccgcgcccggtgcctccatctccatctcgctcgttggtggctggtccctgcaagtgcaagccggcgccattagacaatctattccccacttcaactttcatatctgcccattacccacttcttctaatccccattacccacttcttctaatccctaattgctattcattcttgtatagtacatatgtagctcagtagtctaggtttaagcatgagagtcattntagaattggggagaaaaatagaagttggggtgatcctattttggtatgcctaatcttggagtaagttgntcgattagacgttcttaacttgggtgcnggcactgttatga

SEQ ID NO: 57353 - DNA, 637 bp, Triticum aestivum
  Clone ID: PAT_TA_57353
tgtacatccatattatacttaccgagcacctaccttctctcctctgcaattgatttcttttttaaagacacatttgcgttatgctcttgcaagggggcgttttggctagatttgcagctggattgtggccgttaggaggaggagggggacgaggatgtcagacatggcgcatgattcgtgggacgcagacgagatcttggatgtgtacatgcatgactacctggtgaagcggaacttgcacaacactgcagacgcgcttcactccgtgtccaatctctcttcagatactgctgcaattgacgccccagggggtttcctcttctagtggtggtctgtcttctgtgacatcttaatttcaaggaccttcgacaagcattccgatgttgctactttgtacattgagacgcactccattaaagctcgagagcatgatacatcattgcttcgaccgcagcagcatactgattcccagcagtcagcacagttgatccaactgcagcaacttatgctactgaggcagtagcaggagcagcaacaggagcagacccatctgctgcaacagcatcctcaggagcagcagcaggagcaggaacgtcgccagcagcaacatcatcagcgtaacgagagcaggtatttg

SEQ ID NO: 57354 - DNA, 288 bp, Triticum aestivum
  Clone ID: PAT_TA_57354
gccgatcagatggatacagccatgcctctccactttctgcatgtaaccactcttctattctccagggctgagtctgtctctgatgcgcagacggactacgggcggcttgggcaagtactgcatgagtgcgagttattggcccaggaggagcgagcagtgtactcaggtgcccgaatagcgctaaagtgtgcatgcgaccggccgtaacacggagagtgcaagctggtagagcaatgcgagcgtcattgtagggccgcctaagggatgcctgatgaggagcacggccgc

SEQ ID NO: 57355 - DNA, 531 bp, Triticum aestivum
  unsure (1)..(531): unsure at all n locations
  Clone ID: PAT_TA_57355
ctcttgaatagcaacgatgctggaagaggaggaagtggaagttccggtttcatctacgagtgaggtgccaaaggatgctactagaatggagacagatgatgcaccgcaggaccctgcgtctagtgctggtgaccatacgcaggaacctaaaggagctgctgatcctgctgagggtgctgctgaaaacggggcacaagattctgaggaaaaaactgttccaatggatactgacacaaaggttgagccatcaaaaaagaaagttaagaaaacaaatgttccagttgccgaaatggtgtatggggcgatgggcactgttgagctagagaaagctgttgagaaagaatatgaaatggctcttcaggacagagtgatggaagaaaccaaggacaagaaaaattcagtcgaggcttatgtttatgacatgcgtaacaagattcatgagaagtacaatgattttgtcatgttggagatatanaaaggggtggatggctaaacttcaagaggttgaggattggctgtatgaagatgggg

SEQ ID NO: 57356 - DNA, 326 bp, Triticum aestivum
  Clone ID: PAT_TA_57356
cggacgcgtgggcgactcctctgccccgctggcgccgcccagtcctcgctcgcgccgccgcgattcgccgcactcgccagcaccgtccgcgccgccggccagcgccgcacctccgtccacgccgtccgcccgcgccgcccctccgtctgcgccgccacccgtccgcgtcctccaatcgtcgtggggacctccgtccgcgccacccgcgccaccgacttcctccatcgcagagacaccgacgaggaggcctacgccgcgctccgcggtcgcgacctggctccccccgagatcgctcataagctgctcctccggggaccccaccctgc

SEQ ID NO: 57357 - DNA, 411 bp, Triticum aestivum
  Clone ID: PAT_TA_57357
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaaccaaatttaactacccggggctggcaaggtaaaattttttttatggggcccccaaaattaaatcccggggccggggtttaaaaaggggggaatgggaaaaacctgggggtacccaaattaaatcccttggaaaaaaacccccttttccccagggggggaaaaagcaaaaaggccccccccgatcccctttccaaaaatttgcccaccctaaagggaaaagggaccccccccttaacgggccctttaagcgggggggggggg

SEQ ID NO: 57358 - DNA, 558 bp, Triticum aestivum
  Clone ID: PAT_TA_57358
gcgtgtacacccgcctagtctaagggttgagatcctgattcggactttcccaatgggtttatccatatgactgggggaactgctgctgtggctatgactctggttgtggctgtggctgtgattgttgttgtctccccctatgtggcagttgtcaaatagaccaatggtgagtactgttccatggtcaaagacatcccatgtatactgctcattgaaccgagggttcaagttgtcaacaattgtgcgtgtccgcacccatttatgaccatacttggcaacacaatatggatcacatgaccccctttcttgcctggtctttgttgggttgaggccatttgcacttagaatcccaacttcaagcaacccaattggtggcttccacaactgcttcattgttggccggagatcgctacaatactgtgttgactcatcaagcacatgataaccaccttcaaggcaaatacgaaggttcacctttgcgtagaatttgtcttcctttagctggttcacatcaatcagtcctggccttctgagatcgaacacaatggacgtactact

SEQ ID NO: 57359 - DNA, 190 bp, Triticum aestivum
  Clone ID: PAT_TA_57359
gaccacgccctctagcgccgcgaccccgcggggggtggcagccgccccagaaagaaaaacacacacacgcagggggagagcttcagcatgccccagagcgcgagagacggcggccaagggcgacgggccggcgaacggggtccaacgggacacacacgccaccggggccgggctgtggggcacgaccacc

SEQ ID NO: 57360 - DNA, 421 bp, Triticum aestivum
  unsure (1)..(421): unsure at all n locations
  Clone ID: PAT_TA_57360
ncccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaggggaaaaagtataaagaaaaaaaaatttaattaggggaacaataattaaattttggtttgttttttttttttaattgaaatgaattttatttgacctggtttttgcaaggtgggtgggtgtttttagaatttccttttttgcttgcttggggttggtggggaaggggctttttttgtgggggttgagaaacattaaaggccgggggcttttttactttgccctgattgtaaaaagcctggttgtgccccgtggtttggccttgttacggccatttttttttgtggggtgggggggttaggaaaaacggcacccttacctttttt

SEQ ID NO: 57361 - DNA, 142 bp, Triticum aestivum
  Clone ID: PAT_TA_57361
cgcaaagaggacaacaagggaggccgaacgatgtaggaggagcaaacttcaacgcatgcaggctaagctactagctgccaagaacatgaaaccaccgtggtcgtctatcttcgaggacgatgaaccgaactaacaagtgcta

SEQ ID NO: 57362 - DNA, 229 bp, Triticum aestivum
  Clone ID: PAT_TA_57362
gacgaatctctttcatttacgtcgagcagcatattagaatggctgatgactgctatagaagagctggagcttctcgcgattatggacaggccactctcataggtctttgtgcatattgatagagctaaagctttttgatcttgctctggctccatggaacagcagttgaggatattgcccaggatgaggctactgcctccttgcttctcaaagaggtggctctacagat

SEQ ID NO: 57363 - DNA, 648 bp, Triticum aestivum
  unsure (1)..(648): unsure at all n locations
  Clone ID: PAT_TA_57363
cggacgcgtgggttttgatgcatgggggatgttctcctttggggcaagggagtaggtgatggcacgcttgcttattcttcacatttatctggaaacttgtatggacctagaattgatgcatctttaccaaaggcactggaatcaacagttttgctggatattcacaatatagcttgtgggagtaagcattcggttttggttactaaacaaggagaaatgtatagttggggtgaagagtcaggtggtaggctcgggcatggagttgataccaatcttacccaccctaagcttattagtaccttgagtggaattaatattgaatccgttgcatgcggggaatttcatacttgtgctgtttctttttgtggggatctctacacctggggtgatggaatgcacaattttggtcttcttggtcatgggaatgatactgctcattggattccaaaaaaggtctgtggtccattggaaggattgcatgtctcatcggtatcatgtggaccttggcatacagccgtagtgacttcaacgggccagttgttcacttttggcgatggagtatttggtgcattgngccattggagatcgccaaagcacaaatgttgcaaggggaagtgagctctctaagagcttgcgtactgtacatgc

SEQ ID NO: 57364 - DNA, 544 bp, Triticum aestivum
  unsure (1)..(544): unsure at all n locations
  Clone ID: PAT_TA_57364
cccatcccacctcgcgctgctctgccgaccgcccccacctctccactcctctcctcctcccgcgaccgcgaggccacgccatgaacgaacccgcagcgtaggcatagcccagcgcagcggaggccgtgaaccaaccatgggccgtgcgagggccaaggacgccggctacggcggcgtcaagtcgttcccgtcgccggcctcgtcctcggcgtcgtcgtcagagttcgagttcacggtgacgcagtcgccggggtccagncagcggtcggcggcgcagctgtgccccgccgacgacctgttctacaagggccagctcctgccgctgcacctgtcgccgcgcatctccatggtgcgcacgctgctgctcgcgtcggcgtncacctcgtncgcctccgcctccgactccacctccaccttcaactcctcccgcgactccaacggcagcacctcctcctccttctccaccgactgcgccgcgctcctgctggcggactccgncccctcgtcctcccgccccagctccgccaccgacgacgaccggcac

SEQ ID NO: 57365 - DNA, 431 bp, Triticum aestivum
  Clone ID: PAT_TA_57365
cccaggcaaacattaaccaggacagggggggaaaacaaaaaacaccccatacaaagggaaacccttttaaccaaacaaggggggaaaaacggccaggttcccccgaaaaaaaaaaaaattttttggcaacaaccatctttgaattatccggaaccaggacaaacaatttgttttaaccccaaagggaacaacaaaatttttttcctaaaaaaccaccaaaaccagggccattgttgccaccagggggttaacaattaaaatatttaaaaacagcctcctcaacccagggttggtaaaaaaagccggcccccctttccctttaaaaattccaacccgcttaaccagaaaaaagtttaaaattttaacttggggaggctatcaacgcataaaggaactccacggaaaacgggctgaaccaaaggaaaaacccc

SEQ ID NO: 57366 - DNA, 458 bp, Triticum aestivum
  Clone ID: PAT_TA_57366
atcaagaaagagagacacaggcacaggagcacgagcggcgtaaggctctccagggacgatcattcaaccaaccagaccctgtagggctgccgaggcctctgcagctgcggatccgaatgtacttgcgaaaacttcctgcttgagggtgcatgatgtaccatgagatgagcgagggtagttgaacaccagctactacaccgctgtcatgagcgaggcgctctccaaggtgaccaccgcgttcgaggacgctgacgtgaacgaaggatgcaagggcgatcccaactgttcctgcaaccagtgcacctgtgagtgatccatcagatcaagacagggacacgctatgaacggacctgatgaaagagcactagtgcctatgcatggtgtgtgttgggattctaatcgcgaccgataataatatgagatctatgcgatgggatcgagccactaggatggtcatg

SEQ ID NO: 57367 - DNA, 664 bp, Triticum aestivum
  unsure (1)..(664): unsure at all n locations
  Clone ID: PAT_TA_57367
tgaggttcattaatctagtatttgatgaggttcgcaattctgcactggcaatcgtaacacgtcggattgattggaaaaagctggccactatggaaactatagatatttttttcaactatgtccagcgaattttcaaaaatatatttgatcacgcggagcaaatatccaaggcaatggttgctcgaggataccgcggtgatcctagcaagcacaagatctacttcctcgcggagtcttcatttggcatcgtggatgcattgtcgttgctctgtttacttgctgtaatgggcctggcttccttttcagaaagattggtttgatggtatcaggagctgttctagattgtcatgtggccatcataccccacatgttgctcaaaattgtgatttacacaatcaattttgggacttaatgggagcagcacattcggcaagtggaaacaaagcagtagcatggacagtggccaagagccagtttgtaatttctttgtacagcgtgactcgcgtggacaaaagaataacatccagaaaccgtttacactcacattggngttctaagcaggtgctaggtcaaatgaccattaaccattntaggggcacaacctgcgtgtggtcatgggagggtacagctgacgctagtgaagcgaatgggtgttattagcccg

SEQ ID NO: 57368 - DNA, 561 bp, Triticum aestivum
  Clone ID: PAT_TA_57368
atgtactgcggattccgcgggagaggaacacgcggttgaagaactaacatggaggatctgaaacctcgcaaggaagaaggagaggacatctctctctctgtttctcactctggaatgacgtgatccaagccccagaatccatgtggcagcacgacatgtactcgaatgcctctgcgagaagcggcggtggcgggatggtctcggctgttgagaccgtcaccaagctcttcatcaccaatttgtactttggtgtttcaactaaggacgtgaagattcacatttaggatcattaccaaaagatgaagaacaaaaggttgaccaatctcagtgtgacacttgaggaagctcaacttatgatggatcaataggtttaggaactccagccatatacacctaatgcgtcattctgctttggagcataaagatctgatgtcaaatatagcttaaccaaccttgttgttcctataattgtttttgaattctgctcacatagagtatattttatgtatgcaattcttgaattgtcatgttgtactaaacaaggcattttgataaggtcct

SEQ ID NO: 57369 - DNA, 271 bp, Triticum aestivum
  Clone ID: PAT_TA_57369
gcgtccgcccacgcatccgacgaattggctttagagcggagagagacggcccttgactatgaggagcccgatgtgtacgatcataagatccacctggactgagagatgcaagcatcccacggcgacatgcccgcccacggagccctcgcatcgaaggagctccccgagatgaagcgcaatctcaagcagatggctgaggtaggccgccgccctgcgcagcatgcatgccaaggtcgtcaacgagatgactggaggatgatgccagtcgcgt

SEQ ID NO: 57370 - DNA, 561 bp, Triticum aestivum
  Clone ID: PAT_TA_57370
aacaacttgagcaaaatattgtgagcctgttgcgactcatcaaggcttagccatgaggccacaataagatgggatatgggccagggtgagcatgagcgtggcatcgtggaaccaggaagcacctgcccaggaagatcatctacacccgcccgcctgtccatgcaccagtggtggactggagctacaaaaaatatattgggcgggtcacagcgaaatcgccgtggtgacggatttctctggtttgacattcaaaattaccgatgtgccaacgactcctcgcctttgttcctcgacgcatatgcccctgcgcccgttcctcagcatagtcagcgacacagacgccggtgctgtcgttcctctcatagcggaggactcggaagccgctactgttgttcctctacgcgacaccgatgttgtgccctccagaaccatggcaggacgccatgtgaatgcctcagggagtgtgtggatgcccaccaaatgtttgatgggttcccctaattgatctttctatgtagctagccctctctatttcagtctctccctactcctatacagcta

SEQ ID NO: 57371 - DNA, 549 bp, Triticum aestivum
  Clone ID: PAT_TA_57371
cctcgttcgtgctcacaccagaagctagctgctaggtagcagccatggcggcgagcaggacgaagctccggtcactcctgctgaccttcttcctcctcatcaccaccgccattgcggcacccaccctcgcctgcgatgagtgccacaagccccccaaggccccaaagccttcccacccgcccaaggccaaggcccccgcccacccgccgaagagccgcgtaccttgccctccggtctacggcccgcccaagggccacctccctcgcacgccggtcgtcggcccgcccaagggcaacgcccctcacacgccgacgccggtcgtcggcccacccaagggccacgtccctcgcccgccggtctacagccctcccaaggggcccatcacgcgtccgccggtcaccgctcctcccgtcgtcgtcggcccaccggtcacctacccgcccatcaccaaccctccgcccaaggggcccaccccgcgcccgccggtcaccactcctcccgtcggcgtcgggccgccggtcacataccccccgccaccggtgatcgccc

SEQ ID NO: 57372 - DNA, 374 bp, Triticum aestivum
  Clone ID: PAT_TA_57372
cccgcgtccgatctacctcgctccccccgtctcccccacacctccgcccccacccaccctacctacggccccgtcccccgccggcgggagaagatggaggccgcgggctccccctacgcctgctgggccgagtccgcgcccaagcgcgcgccccgctcctccccgccgccgccgcccccgcaggaccggggcgagcgccgccacgacgccgccgaccccgaagatgacagggagaagccaacgcatttgaggtttctggtgtctactacagcagcaggatgtgttattggcgggggtggttcaactattaatgacttccaatctcagtctgtggctcgtattcgattatcgcgcagccatgagtttttccctgg

SEQ ID NO: 57373 - DNA, 171 bp, Triticum aestivum
  Clone ID: PAT_TA_57373
cagagatccccatgggggagctcaaggtggtagaccgggaggacctcgacttctttgagcagacggtcgagtacgacacggaagacggtctcgactgcctcaggactatagatcttctcgttcacctccgtcccggctgagctccagaagactcgagaggaaggggatggc

SEQ ID NO: 57374 - DNA, 475 bp, Triticum aestivum
  unsure (1)..(475): unsure at all n locations
  Clone ID: PAT_TA_57374
cggacgcgtgggaactatttgtatgcctctttatcaacttcagcatgaacttccggtggagtgtcgtagggctgcactggagttgccaagcaagtgacctgatagtagacctcctgttcggtgggatggtagggatttgctctagattgatgtctttcggctttcttccacaatttcctttcctctaacttgaaacatctacctctagacctttagcaatttgctccatcgctttcttcccaattctttgtatattccagacacccactccaaagaaactttccccctctactcatgcacaatgtatgcattgcaacataggcagcatatttttgtttgccatctaggctatcccttttctgaactgcttgctcaacacctgcncaaagaaaaatatgatcaaatggagtacaacaatgcatttatacaagtcatttgagtcggttactatctattcatgatcatttgagtcatt

SEQ ID NO: 57375 - DNA, 322 bp, Triticum aestivum
  Clone ID: PAT_TA_57375
cgcaatccctggtattctcatggctcacccttgaccccggctctggttttcctcataccagccgccggcgaccggactcgcttccttcctccgacctgtggatcggctccaccgtccccagaatccccactcccttcgctgactcctgctccaacacggatgcgctgacgccgccgcctcctggtcggcatgcacggccgcacgcccagcagttaccgtggccgatgatggaacagccccgagaccctccttgtgttgcagtgcttggagaagaggcaaggcgcctagggagacctgagaagacgccctcaccgacgacctt

SEQ ID NO: 57376 - DNA, 336 bp, Triticum aestivum
  Clone ID: PAT_TA_57376
cgcaaagctcattagatgtttgttcccaggataagaatacatctattcatcaacttttggtactacatggacaagtcaatccctgagacggaatttatcaatgctttctaacgatttggtgaggtcagtaggtggcacggtcaatcggattgatgggagctgcttgatagattatgaatacacagtgctgctgcctgtgcatagtcgcagatgcatggggcaaggtttggcttgaagttgattagcggtgaatctaggacatgcagcgtaggaactgtgcacgacaaaacattttgacctgttatttgaatgccaggccagaaccttacggacagg

SEQ ID NO: 57377 - DNA, 478 bp, Triticum aestivum
  Clone ID: PAT_TA_57377
ctcgagtaccttcccagctcgagcgcctccttggaccgacggcccttggcgtacgcggagatcatcgagctccacgagaaggcgtccctgtcgctcgtcgcgtcgaatatctccctcgccatcccgacatcccctctcacggcgtacccgtggatcatcgtgttccaggacaccaggtccctgtcccgcattccgtcgaacacctgcctcgcctccgcgacctcgccgcgcgcgacgtaggccgcgagcatgacgttgcagaggaacacgtcccggcggggcgcctcgtcgaacgcggcgcgcgcgagctccgcgcggcccgacttggcgtacatctcgacgagcgcggtgcggacgaagaggtcggcggcggcgaagccggacctgaccgcgcgcgcgtggagcgaggcgccgagcggtcgggtcgcggcggacgatgcgaagcgcgcggaggcggcgcaggcctggaggcgaggga

SEQ ID NO: 57378 - DNA, 456 bp, Triticum aestivum
  Clone ID: PAT_TA_57378
aaaaaaaaaaaaggaaaaaacgggtcgacacgatctaaaggtataccaagcgtctacgcatcgcgacgcatgtcagacgctcataatatctgtctatagaagtcacactaacattcgaatcgcacgtggccacaagcgtttacaaactgggaagacctcggtgaaagaccactcgacgcttacctcaaccttagtacgcactatgcagcatctatccccactttgcgcgcagctagggcgaaaatagccgagagacggcactccgcaccctgtatcgaccactgttcgcaacagctctggaacaggccgagaagtggacgaagcggctacgacgcgcctgcaattcaggcgcagttagagctgcgggctgggtgacggctgcattactgcagcagctacgactcgctacacgttgctcaagcgcccgtagcgtctccgctcctcttcgccttttct

SEQ ID NO: 57379 - DNA, 580 bp, Triticum aestivum
  Clone ID: PAT_TA_57379
ggcacccaagcgccctgttgcctcgcttccgattgccatggccgaggcgagccggagctctcctccggcgtacgagctccaacgccggccccttcttcctcacggcccgttcccgctgcgatccaaggctggagacgccaagttcctcggcgtcctcttcctctgcttcatctccttcacggttcagaggaacgccaagttcctcctcgtcgtcttcatcttcttcatctatggcaggtgctcgtcgccggtcaacttcgtcgcgttccatcgtccccgagctcgatcgactcctccgagcccctctatctccggtaacattgcgattgtgaggatccgttcgactacgttggtgcatctacttcatggattcggtcttcttcctagcgggatttcagttgcaggtacaggttttgcgatgatcatgacgcgagagcgatgttacttgtttggagttcttcttctgcttcttcttcgatcaggggataggttcccggtcggcagcctgggctagcagggtggatgtcgtttgagcttctgtttgtgttccatccgtagtcggatggtgatcttatgtatg

SEQ ID NO: 57380 - DNA, 635 bp, Triticum aestivum
  Clone ID: PAT_TA_57380
gacagagtccactgaatgaatgaatgaatgaatgaaaggcctatttatttagaaattattactccctccttcccataatataagagcgttttttacactagctcttatttatgggacggagcaagtaattattaagcctgcctgccttgggttcctatgtctgtttgactagtgtacatctactctgataaatcaagctactttggctttccaggaattgacttgtttcccacaagttcacattacaagcaattgagccagctttttgctagacagtaagtagaatcgaccagcttagctctggcatgtcactcccccaaataaaacttctggaaacggagttggaaactagttttcataaagaccatttcaatttattttatccgagatgccaattgcttgtctcagtggttgcttagatcttcggcacattctcaacacaaccatatattgcgtgtttactgtgttcatttcatctatcatcttttctcttatttgttcgcagcttaaggcttgctttctttcagcacaacaacctgtccgtgggactgacatgttcatttcagccaagctgcccacatcttcccgtgcaaatgtacgaaaactcaagcccgcacaccactctatctcctttt

SEQ ID NO: 57381 - DNA, 433 bp, Triticum aestivum
  Clone ID: PAT_TA_57381
ttttttttttttttttttttttacaaaaataataatatttaggcaatatttcaagtgaatgggtaaggaagtaataagatggagagcttcactatcatcattaacagaaggaaaaagcatagacaatgaagaatatttgtctcggttcagaacatacatgaacatgactatagacacacaagatttattttccaaaatatgcacaatttaatttaaataaatccatgttgctttatagtaggaagaacacacctgcatcgacaaaaatacaaaaatgtaagatccgagtaactatacagataggcgacacaatagaatgtaagacatgtcaacatagaacactctgtccaggagtagtctttaggaatagcagtcaaatacatcatatagtaatgggatccaacacaatcaatccatggtaccttttctacag

SEQ ID NO: 57382 - DNA, 695 bp, Triticum aestivum
  Clone ID: PAT_TA_57382
atcgccttgaagctatcgtcgtcccatctctgttccccacccccttacacctcgccaacaaacactccgccccacgcaccacagcttaggttccaatggagttcgtcgatcctggtggggatgatatggcaacaggattcaccgagctgctccaccgtcgtgactcgcaaatggaaggcatgctggcatcaatcgccgccaatctggatttggagccaatctccagatccgaagttgtcaacggtaccacttccgatccgtttgggggtgacacgcaagcggccgaggtacccaagttcggacaggacgagacgaatccttcgtcatggcagtcagctggaggttggaaacgcaggtatgcagctgagctgggagctgtctttggatgattcctgggttcgttcttgacaagttaggtgtcccgtactgtgtagttgtcgccaattagagttatatgcattattcaggacatataaggtgctgctcttgttcgttgtgtgtgcttgccttgttttttccaacatatatgtgttgtaccgcaccgctctgatgatcatttgtgttatttttgtttataaatgtgttctccgttcttgtcgttgatggtgtttcttccccactgtctttactgaattttatttatcaccgaatgcgtgatgtttcttggctctctgtgaatgcaggttccatgctga

SEQ ID NO: 57383 - DNA, 284 bp, Triticum aestivum
  Clone ID: PAT_TA_57383
ctctcggcgtccgacctactgtcagagttggcttctgctgtgagcgacatctcttggccagtctatccatacagaacctagttccttatcagattgacactatatcagccacgaatgtcttacgctgcctgaatgggcatctggacagagtccaaacttgtgttaaaatagctgctgatcaagagacttgggatcctatatcccctcaacaactccatggcgttctattgttgaattatcaatctacatagactcagagcctgggggcatttaacgttcctatg

SEQ ID NO: 57384 - DNA, 271 bp, Triticum aestivum
  Clone ID: PAT_TA_57384
acgcgtccgcatcgacttcaccgaccatacccgtgccggcttgaggagttgaacatggacctcttaggaagtgcatggagcctgttgagaggggctgcggggtggccggccggcgcgcgccgggcccggcctctgcctctagtcgtgcgtgtcccgcctctgtcttctgctcgcgccgcccccctggggggggggcgtcgcttgcctgttgtttcgccccccgcctgtccttaccttggttggctcctggcatccggcctccgcccccccc

SEQ ID NO: 57385 - DNA, 386 bp, Triticum aestivum
  unsure (1)..(386): unsure at all n locations
  Clone ID: PAT_TA_57385
cgatgaggaggaggaggaggaggaagaggacgaggagggggcgatgagggaccgtcggcaccagcatcagcatccgcatcatcatcgccatcactacaccacggcgccggccacggccgcgcccccgcaccacctgcacctgcacggccaggctccccaggttcttggctcgcctgccgcggctggctgctcgcccccctccttgatggaggccgccgctttctccaggcccctcctgcctcccaactcctccctcgtctcctcgccgccgcctccgncgcaggcgccgcccggcttcctcttgcctcagcaccagcatccccaccggagaagagtcgacagggagagggagaaggagaggacgctggaggcccctggggaggccc

SEQ ID NO: 57386 - DNA, 406 bp, Triticum aestivum
  Clone ID: PAT_TA_57386
aaaaaaaaaaaaaaaaaaaaaaaaaaaaaaaaaaaaaaaaaaaaaaaaaaaaaaaaaaaaaaaaaaggggcgggccgttttaaagagatccagatttactaacgggggctggcgacgtaaaagtttttttttggggtaccctaatttaatttcgttggccgtttttttaaaagggggggatgggaaaaacctgggggttcccaaaataaatgggtttggggaaaatcccctttttgcccgttggtgaatttttgaaaaggcccgcccctttcgcctttcccaacatttgcccaccttcactggcaattggccccccccctgtatggggccattaagcggggggggggggggggttccctacagggggattgttacctttggcagggccctatcccccccccctttc

SEQ ID NO: 57387 - DNA, 231 bp, Triticum aestivum
  Clone ID: PAT_TA_57387
gataagatctcccgactagcgaggagagacaggaggcgagcgccagccaaaccctaccgagaacagggcagagatgagctactccaaggggatcggcagcaagaagacgacaccgaccggcggacgcgggggcgatccgtaccctcgccgacagcgacccgtgacgcctgcgggctcccaggcgcaggcgggagcggcggcgagtccgatgagccccaggagtactacacc

SEQ ID NO: 57388 - DNA, 498 bp, Triticum aestivum
  unsure (1)..(498): unsure at all n locations
  Clone ID: PAT_TA_57388
gaagatatattgagatgaagcctgtcaaccaagaatctaactttgagtatacaaataaaagtggagttgaccgtcgcttttgtcgtgcttggtttaaagaatttccatggattgagtatagtgtgacaaaaaaaagtgctttctgctttgtttgctatctgttcaaggataagacaaaatatcccggtggagatgcatttgtgaagaatggatttaggaactggaacatgtaatcgagattgaagaaacatgaaggtgaggttagtagtgctcatgctgaagctcaagagaagtatgatatgttcactacaccacaagcatcatttagggagtcttttgcttcaaacacctcacaatataaggctttgtataagcagcgtttgacatggacactcaaatgtttgagatttctattgcaccaaggcttgncatttanaggacatgatgaaagnnaaaacttactaantaaagggaattttctttggccttttaattggc

SEQ ID NO: 57389 - DNA, 296 bp, Triticum aestivum
  Clone ID: PAT_TA_57389
ggggagcccccgcgtgagatattattggagaccttggttatattagtacggcaagcagcaccagactcagagtcagccatgtttttctgtatgtatggatcagggggccacaatttcacacaagtctgcagtacagtatctctgatgacgtacatggctattggttacagttgagtgggagctagttataaatgcagagcaggaggtctatgaaatatatattacaagtggctactggatccttactctagatcatcctaaattggatgagtgggatttcataggtgtgacgttgg

SEQ ID NO: 57390 - DNA, 323 bp, Triticum aestivum
  Clone ID: PAT_TA_57390
tcgggccggggcggcgaagatggcacggctatggcgcctaggcgacagccgcacaggcggtgcagaaggaaaagggtaatatggcccccggctcccgctcctcccgggcctgttcctaggaggagccagattcaaagaaagatgggtatcacttgtttgctgagattgttcggaataacaagctttctggaatcgagatgggctgtcatgcaagatactcgcgtcgagtattctcgtggaagagattttactaccttcatcaagactcatcccataacctgcggaaaatttagggccggataaagatatggatgctgaagata

SEQ ID NO: 57391 - DNA, 188 bp, Triticum aestivum
  Clone ID: PAT_TA_57391
ctaccactaccagaacggtggcggcatgacgccccaactgttcagctggtcccaactaaggacctgtgtctgctcctccaactcataaggagaggcgacctcacgctgcgagtcggcctcgtgagggacctagtgccgagcaaatctgaatcgcagaagccaacttctctagtcaatagcttcagcgc

SEQ ID NO: 57392 - DNA, 174 bp, Triticum aestivum
  Clone ID: PAT_TA_57392
ggcgaccacgaggcagagcagccatccctctcctcctcctactgggcacaagccttctcttcgccggggctgatgcggcctcccatgacgaggacgaggacaggcgcggagggcgctccttcagcggtgcgtgcagcgatgccagcaggaccggccgcggtactctcactgccc

SEQ ID NO: 57393 - DNA, 553 bp, Triticum aestivum
  unsure (1)..(553): unsure at all n locations
  Clone ID: PAT_TA_57393
gggggattcagcaggggcagagcggccgagggaacccgatcctgagcgagacgcaggaggttctggtgcggcgaggaggcaccgggacgggcgggccgccggggaaatccagcgccaggcggcagcgggcaccgccgcccttgacatctcgcccagccggccattgcacggatctatcgaaggccagattggaaacagggttggggcagcaatagatctcaggtgttcatctgtaatccgtcatcatgcagttaggcttttggggtgtatgggacgggccaaggtgcaagtgggcaccggcacaagtttcgtcaccggggaaatccagcgtcggggcacagcgcgcaccgcctggcaagacacaccgcgccgtcggccattggacggattcaacacagaattacagcaagcttaacaagctggccacgatcctggaagaagatgagtcagacaggggcgacgggcataacggtcctactttcagatgttcagtgcagaaggtntactccgttatctcacagtttgaccagcagaaacgagacatcattacatc

SEQ ID NO: 57394 - DNA, 545 bp, Triticum aestivum
  Clone ID: PAT_TA_57394
gtgcgcgtaggtggttgatcctccgtatatatgggatctccgcggaggtggtgggccgtggtggcggggaggtgcggtgggctggaggcccaggggcaagattgggggcgatcgttcgttcgttccttcctagctcctcctcctcgtcccggattttgagttttgattgatggacagcgatcgggtcgcctctaggtgttgacgtttatggttgattgggggctccgatctgcccgattgccgatttcattagtgcattgttgcgagtctagtggatctttgcaggtgttcttttgaattccacgatcaaatttcacccacctagcctacgggtgtgtgcttaggtgtgaatgtgatcaatagattttttttttgctcgattgctgtcgttagtgctaggctacaggttatggtaaggggtgattattgtacttctctgtcggatctacgacgtcgatggtccgttcactgatagttttggccagtcattaactcatcgtatatataggactaattatccatggtagggaactaataatcagagt

SEQ ID NO: 57395 - DNA, 158 bp, Triticum aestivum
  Clone ID: PAT_TA_57395
atgagtttacgagccttgaacctcgcactcactatggccatcattacctcgaagacggcgccgatcccgcgcgtatcgctccggcgcgctgggacatgacaggggcacaccggctgcaccgctctgggaggcagagcatgccccgccgtgaccgcgcg

SEQ ID NO: 57396 - DNA, 673 bp, Triticum aestivum
  unsure (1)..(673): unsure at all n locations
  Clone ID: PAT_TA_57396
aaggatcatacttgcgagaggaggaattgtcgaaggccgaggttttcctggtgagaatggcacagttacagcaaaagattgcccgaaaggtctttatggtacattttgcaaggagtgtcctgtaggaacatacaagaacattactgggtcttctaattccttgtgttctccatgccctgcatatgagctccctcatcgggctatttacatgcatatccgaggaggtgtcgctgaaaccccatgcccatacaaatgtgtatcagatagatatcgtatgcctcactgttttactgctcttgaagagctaatatacacttttggtggaccttggttctttggcttgcttctttcaggccttcttgttttattggctcttgttttgagtattgctcggatgaaatttgctggtactgatgagtttcctggaccagcaccaactcaacatggctcccaaattgatcactcttttcccttcctagaatcactgaatgaggtattggaaacaaatagggccgaagaatctcactgccatgtgcacaggatgtttttcatgggcccaaataccttcagtgaaccttggcatcttccgcacacgccgnctgaacagattacagatattgtatancgagatgcgtttaacaagtttgtcgatgagatcaatgctctgccagct

SEQ ID NO: 57397 - DNA, 716 bp, Triticum aestivum
  unsure (1)..(716): unsure at all n locations
  Clone ID: PAT_TA_57397
ccccttctcgccttctccgcccataatctttctcggtctaagaaggattccacgggacaaggcacagcgggaggatctcgaagggagaatacgggggaggtggctgcctgactgctctcccgcccccctccgagaaatccccaatcgtgttcttgcatgcaccgccctggcaaaatcgttctcatctatttccatttcctggagtggcttcttggttcttgattacggcatgccgtactctcactccgcggctggtttgaaaaatgttgcttggagctaagtgataccgtcgtataacgctaacacttgtgcgtaaaatggaggatcatcctggccatcctatttccaactatgatttcttgtcagggaatggttgtcatacgaagaaattagttcataagaactacgaccaggactcctcatcagccaagtctggccggtcacaacaagaagcatctgcaacgagtgacagtaatctaaatgagcaacacacctcaagacccccatcacaatctgacaatgacaatgatcatgggaagcccgaccagcacatgataaagccgctnttatctttggggaacccagagactgttgctcccccgccaatgattgattgtagccaatcatttgcatatgttccttatgctgctgatgcttatgcttgggatctttccaggatatgcctcacacgctattgntcatncccaataaatgct

SEQ ID NO: 57398 - DNA, 176 bp, Triticum aestivum
  Clone ID: PAT_TA_57398
ccacgcgccgcgctatgtttagatataccataagccgaccgcctccttctcactcgtagcccctgcttcatcatcgaagagccgtggacccgaagcgaagaccggtggccgggatcatgcatcacttccccatagtcgctcgacactagtgggttagtatcgggcccgggtgagac

SEQ ID NO: 57399 - DNA, 137 bp, Triticum aestivum
  Clone ID: PAT_TA_57399
tgcgatgatgagcggagagggcaactagaacgagcaggacctgctggtgcacgatcagacgtggctgtccctgtacctggacaccggcggcggcggcatgagtacggctcatgccgaggaacacctccgtccccacc

SEQ ID NO: 57400 - DNA, 258 bp, Triticum aestivum
  Clone ID: PAT_TA_57400
gggccggggcaggcgaagatggcaggcaagggcgccaaggcgacggccagaaaggcggcggagaaggaaaaggggaagaaggcccccggctcccgctcctcccgtgcctgtccccagaaggagccagttccaaagaagagatgtgtatcaattgtttgctgagaaggttcgtaataacaagcatgcggaatggagatggactgtcatgcacgatactggcgacgagtattctaactaaagagattctactaccttcat

SEQ ID NO: 57401 - DNA, 590 bp, Triticum aestivum
  unsure (1)..(590): unsure at all n locations
  Clone ID: PAT_TA_57401
cccacgcgtccgctcacattgccaataccagcccctcgaagtagtattatagcctctatcactcaaataacttgatacaatttgtctcctatcatttcaaatgtgattgccttctattccgcattatttgaagttgttgccgaaaccttctccatgtagtgcctttcctcatcatatgagctgctagcccgcgcgcactagctaatttttgttcaccctttcttccctataatctttctctctgcttttacttcgcggtcctgtagctgtatattaggatgatatgctgagcacatataagatcgtcacaagcaagatagctggactatggagtgcctagggcagtggtaattcataaattgcatgatgtttaatgggaagcatctgagagtaccaatgtccagtagtaagatctgattttataggtgatcaagccaatataagtgtacgtgcatccctttttagtacagatttataaaaaatatgatatatgctatgatattttccagaacagttggcccttgatcttgangcactcatgtgtattgcttttcttcctagagaaatacatgtctattgattattattgg

SEQ ID NO: 57402 - DNA, 177 bp, Triticum aestivum
  Clone ID: PAT_TA_57402
gtctggtggtgagtttaggacctttcccctgtgttgagcatatgcgctttggcccgcccaaaggtgatgacgcttttgctgttatggcaattggcaagtggtagcaaattgatgaactatttgtcctttactgtgttttggggttacgtttctgctctacttttatttgttgctttt

SEQ ID NO: 57403 - DNA, 582 bp, Triticum aestivum
  Clone ID: PAT_TA_57403
gctgtacgagctatcggcagacggcaacatgctctctggacctcttccctcctctcttggcagcctagcagaactcggccggctcgtcctccacaacaactcgctatctggtcagttgctccggggaatccgttcttggaagcagcttagcgagctcaacctcgccgacaatggcttcaccggagccataccaccggagctgggtgacttgccggtgctcaactaccttgacctctccggcaaccgtctcaccggccaagtaccagctcaactggagaacctgaagctgaaccagttcaacgtctccaacaaccagctcagtggccagcttccaccccagtatgcaacggaagcataccgcagcagcttcttgggcaatccggggctgtgcggagacattgccggtctgtgctctgcctcgcaaggaagttcagggaaccactctgccattatctggatgatgcgctcgatattcatattcgcggctgtcgtcttggtcgccggcgtggcatggttctactggaggtaccggagcttcaacaaagcgaaactgaaagccgagcgctcgaaatggacactgac

SEQ ID NO: 57404 - DNA, 207 bp, Triticum aestivum
  Clone ID: PAT_TA_57404
gaaaatatctgcggaacgagctgagatccggactgccaatataagactgagggcgcgactttgaggctccagatggggaaagactgcccttagctgcgaaggaattaagcagatatgatctttacccacagaacttgaagcctaaccacaatggtcgtcattgttgttgaatgcagagatggcgaacacatcatctacatctgaact

SEQ ID NO: 57405 - DNA, 234 bp, Triticum aestivum
  Clone ID: PAT_TA_57405
caagactgtctcggctgggacccgcagagaggaggagcgacacagcatccctgccttcctccacgcccgtagggttcccggatcgtagtagcgcaagccgcctcagccatggttcgcggatcgttcggcaggttggcgtcgcgcaccctctccgtctctcggctatggcctcgccagctagctccagccgcctgaacattcattagtaccagtgcgccgttttgatctggaagt

SEQ ID NO: 57406 - DNA, 474 bp, Triticum aestivum
  Clone ID: PAT_TA_57406
tttttctcgaatccccgtgtctgtaatttcaggagaactcggatcttgtgaagctcctggaggagagagagtgagtatttgcctgcatcgattgttctcttttgtctaggatggatagggcttcttgatgtgcgagtgttctggtgttgactctatttggtttgatttggtgcgtgcagcaagttcatagagttgagcggggctgtgctgcagaatctgcggctggcaaactggcagcttgcgcaggctaattctcagatgttagcagtaagttatccccaaactatctgcaagaaactccattgtccccgttttataaccgtggacttgatcgtgttcatcacgaggctaatctctgtctcgaaatgtttgcttcgcaggagctaaatcttggcaaaaatagggtaagttggtgcttctttggtcaatcttgacacatgtgctcacattttctagagaaaaatttgatcctga

SEQ ID NO: 57407 - DNA, 480 bp, Triticum aestivum
  unsure (1)..(480): unsure at all n locations
  Clone ID: PAT_TA_57407
ctaacctatgatttggagacctcttaaccctatgaaacaaattttcatctgtatcataaatatatagctgcaaatgtcgagggccattatcaccagactccagatcatcaagagcgtggtataaccccccacacgcacgaaatgtatatacgccggttcctgctgcggtgctgactcgccgatccagggtgactcccagacttgtgaatgagaagtgggagttgaaataccgtatattttccctgaaatatttagcatcctcatcatctagacttgtaaacaactgtttcaactcctcacaaacatctggagtaaatacatccactttcccctttctgcagcaaaacgcaggcccctcgtattgaaatcgcaaagctccacaatggcggcaatcaccaacttttctaagcacatgatgctttttgggcagggtaatatagactctgtcatgagcatcattattggngagctccatcacca

SEQ ID NO: 57408 - DNA, 515 bp, Triticum aestivum
  unsure (1)..(515): unsure at all n locations
  Clone ID: PAT_TA_57408
gttctttcaattgaatcgaaggatgaacaaagtcaggcacagattctttctgcggcccttgaaattgctgaagacgatgcccaagatgccgattcgaaatacagggcgcttgttgcaatcggctctcttatgttgaacggcctggtcaagtccatcgcccttgacctcgacgtgaagagcgtcacaagcagcgcaaaagcttcgatggactcgaagatcgccgaagttggagctgatattgagctgctaacaagatgagagaaaagagtgtcgcagatactacattcgagagaaaaggtgggaacggagggctgggcggagcgttgcagttaagtagtggtagcagcccacatccgcgcaggtgggagcataacttttgcgtgagtgcaggagagtttgctgcaccttgtaatcagtatggtatcgtgcgaattcttcgccctgatcacaaagtttactatttatgcgcacgcaggcgactgancgcactnttacataataaacactctaccacc

SEQ ID NO: 57409 - DNA, 445 bp, Triticum aestivum
  Clone ID: PAT_TA_57409
atgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaagaaccaaagttaacgaacccgggcaggcaacgtaaaatttttttaaaagggcccccaaaattaaattcacgggccggggtttaaaaacgtgggaacgggaaaaaccctggggtaaccaaattaaatcgctttgaaaaaaatccccttttccccagtgggggaaaaaacaaaaaggcccgaaccaatcccctttccaaaaagttgcccaccctaaagggaaaagggaaccccccttgaacgggccaataaagcccggggggggggggtggtccctccctggggaaccgtttcatttgcggtgcc

SEQ ID NO: 57410 - DNA, 282 bp, Triticum aestivum
  Clone ID: PAT_TA_57410
ggacgcccgcccggcacgcgagttgctgatgttaatgttaggaagatctgattatgacgtcgacatgattagtgaagacactggatatgtgagacggtgggcaatggcaggaatagagatggagaggacagggttgggtcctacactacggcgagtacggatggacaggcggcgctggagaagagaagcgggatgacattactggcgcgagcccagactgtgctatgacgctacaatgagggacggagaactgagggctgggttctagcaccggcagaggag

SEQ ID NO: 57411 - DNA, 385 bp, Triticum aestivum
  Clone ID: PAT_TA_57411
gtcgactaggcaatccaatctagccctctgtctatagcgccatcgcttcttatttacttctactgatgtccactaccgttgactgatactcgctcctgcccgctctgcgcctaggagacggacaatcgtagaccagcacactcatgcgctagccaggagcatacaaagacacgcgaatgccgctgcatccgcctctgtgtcatgagtacgaactaggacacaaaggagcgcttgcctctgctctgtcgcacacgctatgacaaggacaggatctgctaagatgtctgactagtgagacagaacgtattctgatagctgacctacaagacccataagaccctgtatggtaagacctagacactggctgccgaaactgataagcatg

SEQ ID NO: 57412 - DNA, 544 bp, Triticum aestivum
  unsure (1)..(544): unsure at all n locations
  Clone ID: PAT_TA_57412
gtcgcccggattcttattcctccgcggaaacctcacgcaatcccaacagatatcccccctcgcaagtcgcaatcccgtcccctatccgcggtaattcgttcggatcggagccccttctgcgtctcatccatcccgtctcggatcccctctccccacgacctcataagcgactttcccccctccttggttcttgattgcagcagcgactcctggtggtgcttcgccggcagtctcctcgcgtccgtactgtgtcgacaccgtcagcaattccggtcattggtttggtttctgagataataacaggtccaagagaagtagaagcaaaggtccaatcaagatgttttacgcgggatatggttaccatgctagtaattttgagcaaacgtaccgctgctatccagcatctttttttgacaagccacacctggaaggtggtgacanagtaataatgccgccatctgcccttgatcgtctggcttccctgcacattgagtatcctatgctatttgaactgcacaatggtgtcaccgacaggatttacact

SEQ ID NO: 57413 - DNA, 488 bp, Triticum aestivum
  Clone ID: PAT_TA_57413
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaaggacccaattttacccccccggcctggcaaagtaaaattttttttaaggggcccccaaaattaaattcctgggccgggttttaaaaacggggggaggggaaaaccccggggggtacccaaattaaatcccttggaaaaaaacccccttttccccgggggggaaaaaaaaaaaaagccccccccgaaccccctttccaaaaattggcccaccctaaagggaaaagggaccccccccttaacgggccaataaacccgggggggggggggggttccccccaggggaccctttacttttgccagggccttagcccccgttcttttggttttttccccttctttttt

SEQ ID NO: 57414 - DNA, 532 bp, Triticum aestivum
  unsure (1)..(532): unsure at all n locations
  Clone ID: PAT_TA_57414
ctctcctgccgccgccgcctcgtcctcgtctcgtttcttgccctcagcgccgcctcctctccttcctctctctccctctgcgccacctcctcttctcttcatgcgtggtggcgtctcgtcatccccagcctcctcaatcccctcctcccgcacgaaccctagcagagagagaagatgagagggagagagaaggaaggagaggagaggagggagaaagagagatgaaagaggagagggaggtgtggcggctgacgggagagggtcatcggccggcgtcggcctgcgccggcgaggtcgggcgcgacctggcggttggcgacgactcgatccgttcctggattgggagctgcgaggaggctggggctcgggcgcgatgcacgggaggctgcaccccgcctccatctccacgcgtgcggcggcgacctcgggaggagctcgagccacaacggtggtccacggcgccggcgtcagcaggaggagcgtcggccgcagaaacggncggctccgttcggttttcgcgcaggagagtatt

SEQ ID NO: 57415 - DNA, 564 bp, Triticum aestivum
  unsure (1)..(564): unsure at all n locations
  Clone ID: PAT_TA_57415
atcggggtcatcgaggaggaggggctgctcgacgaggaggaccagcgccgccccatgcccaagcgctgcaagtactgcctcatcttcgtcggcggcttcgcggtgctcttcaccttcttcgccctcgtgctctggggcgccagccgctcccagaagccgcagatcgccatgaagagcatcacgttcgagaacttcatcatccaggcgggcacggacgcgtcgctggtgccgacggacatggccaccaccaacgccaccgtcaagttcacctacaagaacaccggcaccttcttcggcatccacgtcaccgccgaccccttcacgctctcctactcccagctcaacctcgccgccggagacctcaagaagttctaccaggggcggagcgggcggcggacggcgagcgtgaacgtgaaggggaacaaggtgccgctgtacggcagcgggccgacgctgatggcgcagcccgcggngggcaagggcggcgccggcaaggtgatccccgtgccgatggtgctgcggacgacggtgcggtcgcaggcgtacgtgctgggggcgctggtg

SEQ ID NO: 57416 - DNA, 355 bp, Triticum aestivum
  Clone ID: PAT_TA_57416
gacccacccttccaatacgtcttgatattctatatctcgcggctctcaagaatttcccacagcgagcgagatggcgacgcgcgcgcgaaggtgatacaagtgcacagccgcggtggcatgtgaggcgcggaagccgctgtccatgtaggaggtggaggtggcgccgccgcaggccctgtaggtgcgcgtcaagatcctcttcacctccctctgtcacaccgacgtctacttctgggaggccaaggggcagacccccatgttccctcggatcttcggtcatgaagctggcggcatagtggagagtgttgcagagggtgtgactgctgcttgcccctgctggccgtgtccttcctgt

SEQ ID NO: 57417 - DNA, 466 bp, Triticum aestivum
  Clone ID: PAT_TA_57417
cccatttacattctctctctctctccatcgccattgttgcttctgaagttcttccctctggttatgagtacttagatttgaagccacggagcagctgtagaacatctaagatctgattttactggcggatgagatcaacgcactgactggtatctctctgtcaatcattttccaaagaactaagctggaccgcaaactcctttctaccggtggtggtatcgccgctgagaaaagcaaataaggttaatatggatattgagagggacaacattccaggaagttttatggaactactgaacatggttgagcagcccatgtcaaatttcaatcaagaaaacactatgaactcagtaccagaagaaagttcgtgcttttctgatagaccatattgttcagaagacactgatgtactttcgagacctaacttaagggttgacacttatgattatgtcgatgactcaaatga

SEQ ID NO: 57418 - DNA, 100 bp, Triticum aestivum
  Clone ID: PAT_TA_57418
agctgcgacgggatagctcttctataatgcccctaaggagagaccctggccgagagtttactgcgtgcgtactgggaagagcctgccgtaacgcaacctt

SEQ ID NO: 57419 - DNA, 452 bp, Triticum aestivum
  Clone ID: PAT_TA_57419
cgcgctccggaactacccttagaatatttctagtttgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaagaacccaattttacgaccggggggtgggaagttttttttttttttttggggcccccaaaattaaatcaccgggccgggttttaaaaaggggggcccgggaaaaacctgggggttcccaaattaaatggctttggaaaaaatcccctttttccaagtgggggaaaaagaaaaaagcccccacccgatcccctttccaaaaatttgccccccctaatgggaaaagggaaccccccttttagggggcctttaagccggggggggggggg

SEQ ID NO: 57420 - DNA, 429 bp, Triticum aestivum
  Clone ID: PAT_TA_57420
ggagatcgcctcgtcccgcggcagcagcaacctccaggtggtgtgcttcgagatcaacgccgagaggaacgagagggtgtggctcgccgggaggaacaacgtgatcgccaagctcgacagccccgcccaggagctgaccttcggcaggcccgccagggaggtgcaggaggtgttccgcgccaaggatcagcaggacgagggcttcgtcgccggacccgagcagcagagccacgagcaggagcaggagcgcggggaccgccgccgtggtgaccgcgggcgcggtgacgacgccgtgggggcgttcctgaggatggcgaccggcgcgttctgaggctgcatggccactgttgagtgggtgtggggtgctggagcccgtgccgtttgagagctggacttgtatggagtttgtgggtactgtgtagtggttcg

SEQ ID NO: 57421 - DNA, 573 bp, Triticum aestivum
  unsure (1)..(573): unsure at all n locations
  Clone ID: PAT_TA_57421
gtggatggacaaagcaaaacactcacaaggataggtgttgaggaaaatcccaaagaaatcactcaggaacaggagaaagaatttgacaacgatacagtggaatctttaaagaattcaatcaatagtttgttatgtagcccagccatcatacagtcaaaagaagggcagaaggaagttcctgttgaaggcatgacggagaagcactgccttcaggatgttgggttgataaatgagagggaatcattgtctgttggagctgctatggagattcaaggagtagatgaccacagaactttggacatgcatgaggaagtgtctattaaacagatagatgagtgtggaataatattcacaaataaggagacacaaatattggaagacagccatatggtaggagatggatctaacgatttggttcttatggaggntgatgaaacttggtctacaatcgaaattcagaaccaggaggctttggacttggacaagcaacaaacaactgaggaaagacaagatttaggacctacaatcgagaacaagaaaatggcaatgttagggagatgtcattacgcttgg

SEQ ID NO: 57422 - DNA, 588 bp, Triticum aestivum
  unsure (1)..(588): unsure at all n locations
  Clone ID: PAT_TA_57422
cccatccttatctcctcctcccgcatctctcttcctccacttctttttccatcgtcagccatgggagcggcagccccaatcttgctcatctccttcctctctctactcctccctcccctaccccctgagctaaagaggctattgacagcgcccgcaccacacccttcagagctgctgcaaagggaggagttgcacagccaggacgcactcgtcactatgggtcgcccaggtgagctcgtcgccatgtcgtgcacgtcatcgttcttgactgttgcgaccgcacctcctgctgatgccctccttttctgggtaggggacggcgagcggggggtgctgcaagcagcggaggacggggctacaagcggggcggccaccaccaaccaccgatgtgtattcgcggtggagatgctgctaccccggtgcggcggagctacaaccgtaggccggtggagttgcaaccagcanaaaaaatgctggaaccggtgatagccgtgttgtgatggccatggctgcgattcatcgntgctgggaccagcanatttttttgctggaaacagcgatttttttttgctacgaccccagcgacga

SEQ ID NO: 57423 - DNA, 288 bp, Triticum aestivum
  Clone ID: PAT_TA_57423
acggccgatcgaacgaggcgctggagagcctctcagatcggcccagacccccttgagcgcatcgccagcgacgccctccgccatgtcgctctttgatgcacccgcctccgtcgactccacctctcggatcgtacggaagctgactgtgatgccataggagcgctggcgcgctactgtccccttcttgaggacggtgacttgctcgactgcggcactgaagatgaggctaaccttgacgacaaccactccctagaatagctggactatcacccgatgctaaaacaaaaa

SEQ ID NO: 57424 - DNA, 435 bp, Triticum aestivum
  Clone ID: PAT_TA_57424
gcccagcgtgcgcttggttttttctgcgcctcctgtgggggcggggccggctgttgatgttgaactttgcaatgccatgtcttctctgagcgggtccatgtgctgcaaaatggctaagaaggcaaggatcccttaagctcagttggtctggccatatctcagaagcctctggacttctcctgctatgagaaaagatgagaggagaggccaccgtttttttttgatgccgacgatgcagatgctgcatggagtgtgcctttacaggcgtgcgtaccccccttgccggttggtccgcctgtccgaggatcagaatggccagagactgtgcctctgtggctggtgaagacccccttatgggttggtggtccgtcgggccggagtttatgggaagccagcggacgaggactttgaggcagactatgcacactgtaaacg

SEQ ID NO: 57425 - DNA, 197 bp, Triticum aestivum
  unsure (1)..(197): unsure at all n locations
  Clone ID: PAT_TA_57425
tgngagatgcatatatttgtgaggaccctcgccggcaagaccatcacccttgaggtcgtgtcctctgacacgatcgacagcgttctaggcgactgatccatggacatggttgtggcttcccttccggaccatgcggggggggggagtgtttgctgttttttttttttgtgcggacgggncntcgaccctcgcgtgac

SEQ ID NO: 57426 - DNA, 644 bp, Triticum aestivum
  Clone ID: PAT_TA_57426
ctcgtccttctctctttctcctttctctctctctctctctctctcgcacgcggggacacggcgctgccatggcgaccccgaggacgatgagagccgtgcagtacgacaagtatggcggtggagctgaaggcctcaagcatgtggaggtgccggtgccgtcgccgaagaagggcgaggtgctgctgaagatggaggcggccagcatcaaccccatcgactggaagatccagaagggcatgctccgccccttcctccccggcaagttccccttcacgccagtgggcgatctggccggcgaggtggtggagctgggcagcggcgtgaccaacttcaagccgggagacaaggtcatctccatcagcttcccgagcggcggcgggctcgccgagtacgcggtggcgccggcgtcgctcacggtggcgaggccgccggaggtgtccgccgtcgaaggcgcctgcctgccggccgccggaggctccgcgctgcagctgctcaagctcgccggggtcagcttcgacgggacctccggcaccaccggcccgaagaacgtgctggtgaccgcggccttcggcggcgtgggccactacgccgtgcagctcgcgaagctcgcaggccttcacgtcacggccacctgcggcgcgcgc

SEQ ID NO: 57427 - DNA, 130 bp, Triticum aestivum
  Clone ID: PAT_TA_57427
gcctactttacgatagctctctccgccgaggctagagtacgacaccctaacctagcacgatggctgactgaaggcggaggcgttcgagcgctaggatagcgcgagcaggacgtccagatgatgctggcgg

SEQ ID NO: 57428 - DNA, 449 bp, Triticum aestivum
  Clone ID: PAT_TA_57428
gagctatcttcttttatggggctttgattcgtcagatgaagcaaatggttgagatctacattaggttagcggaactggagactaggaaggaggacactaacaaaaaaatctcactacccagggagttccgcagcatttgccagcttgaacttgcaaaggttcctgttgtgactgctactattccagttgaccctaattgtcggtatgaagaaggtacctttccacatttcagtgggctggtggattctattactataatgaatggaattaatgctccaaaagttattcagtgtattggctcggatggtaacagataccgccaacttgcaaaatctggaaatgatgacctgcgacaagacgctgttatggagcaattttttagtttggtaaatatgttcttgcaaaatcacagagatacttcggaaaggagattgcgaatacgcacatat

SEQ ID NO: 57429 - DNA, 526 bp, Triticum aestivum
  unsure (1)..(526): unsure at all n locations
  Clone ID: PAT_TA_57429
gtaaggtgtatgcggccaaattgaaggaagaggaagatatatcaaaaagtataatggaccgcgagaagcggctgagtatattgtaccaaaagcaggggagggcaactcaatttaagaatgaggctgccagagatgagtggcttcggaaagaaattcatgatcttgagcgtgtacttttatcaaatagaaagcaggaaagcttacttcaagatgaaagtcagaagcttaaagacgaaattaataagttgacaaaccacattgaatctcggagaagtgaatcaagcaagttagaggctgttcttgcagacaagcaaaagaatcacaatgacttcacgaagcagaaaaatgcacttcaagatgaaaggaaatcattntggaaggaggaaactagtgtgacagctgaaatcgataggctaaaggaagatcttgtgaaggcacagaagagtttggacccatgcacacctgggggatatcaggagaggccctgatttctgttagcccgatcatcagggaccatggtattgga

SEQ ID NO: 57430 - DNA, 445 bp, Triticum aestivum
  Clone ID: PAT_TA_57430
gggatcaagagcgcggtgcccaagaccatcatgcagctgatgaacgtggaaggcctcacccgcgagaacgtcgccagccacctccagaagtaccgcctctacgtcaagcggatgcagggcctctccaacgaggggccttccgcctccgaccacatcttcgcctccacgcccgtgccgcccagcctgcgcgagccccaggtgccgcacgccgccgccatggcccccgccatgtaccaccaccacccggcccccatgggcggcgtcgccgccggccacggcgggtactaccagcagcagcacagcggccacgccgtctacaacgggtacggcggccacggccacggcggcggcgtctccacctacccgcactaccaccacggcgaccagtaaggataaccatccatcccggattcagtcatcaacagatgctctgctctctctgctt

SEQ ID NO: 57431 - DNA, 128 bp, Triticum aestivum
  Clone ID: PAT_TA_57431
agcaagtataagtagtagttcgtgtggtagaagattgccaacgctttgttggcttcttggttgtgagaactgaacgtgttgcttttgcaaactgaaatctatctaaaaaatgttgcggttgtggtact

SEQ ID NO: 57432 - DNA, 521 bp, Triticum aestivum
  Clone ID: PAT_TA_57432
tttgatgtctatattgtcttgggcaatcgcaaagaattatggtgctttcttggagaaggatggagctggatttagagggcaagtaaaactcactggattgccaaatggggacattgacctgactcattccgtttggacatatcaggtaaagcattggaattttcagccacacttctaccttgttcacactttgatgcaggcgtgcagactttgcattgagtatcataggtgctattttcagggtctcccttaggtcctggaactttaatcatcatctgtgtcccggaagtgcaattactcatgctaggtgctagaatgcacttccgggatccagatgacgatctttaaagttacagggcctcgtgagactccgaaaatagtttgacaacctacatgacgcacatgacaaggtactagattgttaaaggtactagaatactgtactagtattcttctgacacacatgacaagtagtccaaaaccatctatatcgttagaccgaatttactggttaactactg

SEQ ID NO: 57433 - DNA, 646 bp, Triticum aestivum
  unsure (1)..(646): unsure at all n locations
  Clone ID: PAT_TA_57433
tgcagatgtactacaggaatacttaggaataagctagagcggagaagatggagcattttggaggcctcatgtgcgtcattcgaagcccctctactgtaaggattctgcacgtgtgatttgaatctcccattgcttcccatttcaatagcatccacaattgatcgcagaccaacagcttctggatcaaatacaatctcaacttctgagagggtagtatttacagcaaactgtcgcaaaccatccattttcttaaggatgtcatgtagtacatctgcatccctctctgtgtgcacgccagtcagacctagcaatatcttatcttgctcgctactctgtaagaatgcagcttcaaaaccagcatcctcgatagcctgaacaatttcatccttgctaatggtagacggatcatactcaacttctcctaatgacgttgccagggcaacgactgctccttttatacccggntgtttcctttagataccctcaactgagtttacacaattagcacatgtcattcctcctatcctaaattgtgctgacaatgtcttctgtgacttangttgnaggactgcagaaatctggagaatttcagcgtcaaatccagcatcttctatagcttctattatatcctcgaccttgacgagcg

SEQ ID NO: 57434 - DNA, 141 bp, Triticum aestivum
  Clone ID: PAT_TA_57434
cccacgcgtccgcggacatatcgtgaagcacaagcagccttgcaaccacaaaccttgtagacttctcttttcatatccaaactttgcaaacatttcattcatgtttttaaacttattctacgtttattttagtgcaccaag

SEQ ID NO: 57435 - DNA, 154 bp, Triticum aestivum
  Clone ID: PAT_TA_57435
acccaccgcctccggcgcactgactggacaccccggcgccatggccagacttgccagagactgttccctcctgcttgatggcgcacccgtcgtactgctcctgccgcgcccgtacgggccgtgcagcagccgcccagcgagtcatggccgtccc

SEQ ID NO: 57436 - DNA, 254 bp, Triticum aestivum
  Clone ID: PAT_TA_57436
gggccgggaattgaccggggtcgacccacagcgtgcggaccttgcagctcatctgaaaatggagaccctggctgaccacagaatgaggctactctcgtattcttgcagtgtgtgaaaaattaaacggaagcatactaccatgcaacgaaataagccagggaaacgctctcacacccatcaagagattatgacaggcgctgaacagacagacggggagggcacttatgattggagaatgaagtcgactctgatga

SEQ ID NO: 57437 - DNA, 744 bp, Triticum aestivum
  unsure (1)..(744): unsure at all n locations
  Clone ID: PAT_TA_57437
ccaaaaaataaactagatctatggcataattagttatatatatataggttcctgtttacagttcatgcatttattgtattgaaaagggatccggatgtacgttatatatgtaggttcctatttacaatactcatataaaaatttcctgtatataaccatggaatccatacttcctaggttcgtttctgaaaatattcatgttcattcctttggagttctactgtctagattttagagatgctacatatacaaaatgtgataatgtattttcagctatgatattgagtgcccttttaatgatttccacatttaaagtggggagctgtgtacattaataatgatccaaataatgttagctaaacatgtttttacgaaattaacaaatttacgtgttccattctgcgcaacagaatatttagagtacatgcatgacactatatctacgccaagcagtactatagagtaggcactttaaaagaaacttatgtaagcaagtttaagaactaccataatcctgttaagtatattgcaaataggatgtataatccgtatctataattntcaaatgattntaactgcctccagttttagtatggccacgttatgagtcgcattgtaactacagccgctattgcaagtttgacttgaatttggcttctgtaggtatggaatcgattcacctctccataggtttctacctctncgaantcctcttcatgttgccacatagttacattctttttt

SEQ ID NO: 57438 - DNA, 130 bp, Triticum aestivum
  Clone ID: PAT_TA_57438
gagcactgaccggacaccccggcgccatggccagacttgccagagaatgaaccctcctgctagatggcgtaaacgtcatcctgctcctgccgtacacaaacgggacagacagcaactgaccaacgagaca

SEQ ID NO: 57439 - DNA, 128 bp, Triticum aestivum
  Clone ID: PAT_TA_57439
agcaagtagaagtagtagttcgtgtggtagaagattgccaacgctttgttggcttcttggttgtgagaactgaacgtgttgcttttgcaaactgaaatctatctaaaaaatgttgcggttgtggtact

SEQ ID NO: 57440 - DNA, 446 bp, Triticum aestivum
  unsure (1)..(446): unsure at all n locations
  Clone ID: PAT_TA_57440
tggaagaatgaccaaaatgttttcatgggctcaaataaatataattaccatgggatgtcaaataccggtgaacggttccttgctggagtttatcatcatcttccatcgatactggcatttactgcccctcacccacacagctacgaccgaattcagccaaacacattcactggagcatatctttgctgggggaaagagaaccgggaggctccattgaggacctcctgcccacctggcgtgcctcctgattttgtcagcaacttcgagattaggtcgttcgacgggtgcgcaaaccctcacctaggcctcgccgccattgtcgctgccgggatcgacgggctaaggagaggcctcaagttgcctccaccatctgatctggtccctgcngattgcgcttcacacgagaggcctccgcatgacttgcttggctctgtggaggctcttgc

SEQ ID NO: 57441 - DNA, 690 bp, Triticum aestivum
  Clone ID: PAT_TA_57441
cgcactgctgattctgaatacaatgtttaaagctggatatgaattaggcagtttggcttctgctatacttgttgataagttatgcacaggcattgtatcttatcctcaaaagttggaggatattttggtgagcagctagtggcatttggatgccctgcaaatcgtacaaatgttcatttgtttctcccttgattgatgtctttgagaaatgtttttattggtgttgttcaaaaggctacacaaatgacttatgtagaaattcagaaccctgatgaccaagaacttgacttttgaggttcatattcagattataacttggcctccaaccattccagtaaatcttggagagacagaaatgtgcaacggcaacggctgtgagtaacagctctgagaggttgtgactgcagtgagcagcgttgatggctaatattcttctttggccctgtaataatccaaatgcctgtgatcgtggggatctattgaacagcactgtagtaccttcttcaggaactgcaatgggcacttcaggatggccatagagctctctgaacacaagctttgtggcccttacatcaccattctctgcatctccattcccaggtgtacattgtgctttggccctgtaataaccccttctattttctgtctattttgaatattcacatcttaacaatagactaaatcaacccc

SEQ ID NO: 57442 - DNA, 381 bp, Triticum aestivum
  Clone ID: PAT_TA_57442
gcctctaccttcttgttttctactcgctcatgatcttgcctgcctgcccgatccagtatcggacagcgatggatattttgttccggggaagaggaaggaatggcggacgtcgagtaccgctgcttcgtcggagggctcgcctgggccaccgacgaccaagtccctccagaacgccttctccaagtacggggacgtcattggctccaagatcatcactgacagggggacgggccgatcccccgggttggggggcgcccccttggggtccccctatgcgttgcgccgggcgatcgccgcctttttccggcagggcctgggcggagcgggcctcccccggtccgtctccccgtccggtcggtctggtggggggtgggggggccc

SEQ ID NO: 57443 - DNA, 571 bp, Triticum aestivum
  Clone ID: PAT_TA_57443
gtcgagtacggcgtgggagctcgccgagctattcgtcctccgccccgtcctcgccatctccttcgccctctcattcatcctcctgagctggtacgtcgcgtggaggacggtgctggtgcacgtcccgctcgtgcaggaggtcgccggcctgcgcccgaagaagaagcccgccaagcccaagccccccaaccgcggccgcatcggcaggttctaccagtcgcaggcagaagcgcagagggacactaaattggaagggacctcttaaggaataatctttgggactttgaaggaagccctcatctcattccaattcagaatgttgtacatccaataaattgacagattttctcttttaggagcagatgtccacacacttatttagcttgcataccccagatacacaataatgtatccactgtatattgcccctgtgtaaagatgcacaataatgtatccactgtatattgcccctgtgtaaaagttaaggatgttgtaataagattgtacatgcctgtcctagaataaagacagcacatgtcctctgcaataatcagtgtaccatttgcttcaa

SEQ ID NO: 57444 - DNA, 605 bp, Triticum aestivum
  Clone ID: PAT_TA_57444
gactccacgccgtcacgaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaagggccccatttttccccccccgggttgggaaggtttagttttttttttggggcccctaattttattttccgggcccgggttttaaaagggggggggggggaaaacccggggggtcccccattttttccccttgggagaaatcccctttttccccggggggggttttgggaaagggcccccccccgtccccctttcccaattttggccccccctgatggggaatgggacccccccctttgggggccctttttccgggggggggggggggtttccccccggggggccgttttctttggcagggccctttaccccgggccttttggttttttcccttttttttcccgcccgtttgggggtttttccccgggaggtttttaatggggggcccccttttggggccccgttttgggggtttcgggcccccccccc

SEQ ID NO: 57445 - DNA, 411 bp, Triticum aestivum
  Clone ID: PAT_TA_57445
cttctcgcccccctcgtctccttgccaggacctcgcgcgcatctcgcccccccccccccctctcactcgcccaggtctagggttccggcgcccgattcgggccgaattggacggcgccgcggcggatcggaggagcgggggagagatgacggggaagaagcgcaaggcggaggcggcgcggctggacgagacggaccgggccatgtacggcgcgttccggggcgccgccaactcgctctcgcagctctacacgctcgccatgggcggccagaagctctccttccaggccggcgagcgccacgccctggaaaagctgtctgaatggatcttaagacagcctgaaaatggtttgaggctgtctgttggtgatatagcctcgcccgtccagcctgagattccgtttgggggcga

SEQ ID NO: 57446 - DNA, 462 bp, Triticum aestivum
  Clone ID: PAT_TA_57446
tgtagttcgaactgaatcgtggaacaaagttaatcgcacatcttgttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggcccccccttttaaagatccaaattttacccccccgtccttgcaaggaaaaattttttttatggggcccccaaatttaattccctggcccgctttttaaaaacgcgggacgggaaaaaccccgggggtcccccatttaaatcccttgggggaaatcccccttttccccgggggggttttttggaaaaagcccccccccgacccccttccaaaaagtttccccccccttatgggcaatgggaaccccccccttgcgggccctttaaccccggggggggggggg

SEQ ID NO: 57447 - DNA, 629 bp, Triticum aestivum
  Clone ID: PAT_TA_57447
gcccttgaaagtgaatatgtaagctctaatcttcatactggattgacctatatttggtttaagcagcgtggcaagcctgccgttgaggcagcaaatatattctactatttgacatatgagggtgctgttgatttggaaaacatggatgatatgttgcagaagtctgctatcgaagaccagattgcaaattttggacagacacccattcaaatttttcggaagaaacacccaagaagaggacctcctataccaattgcgcacccactatattttgctccacagtcgataacagtgacttctgttgttcctagtgcaatcagctcttcatcatctgtattgttcattggcttgttggattcaaacattgtcttgatgggcgaggagctcatactgtcagtaaaactttggctaacaacgcaattacagtctggtggaaacttcacattttctggatcactggagcctttctttggaattgggtctgatgttatttctccccgaaaagttgccactttcttggctgaaaatgttgagctcggaagacaatgcctggcagctgtcccaattcctggggacgattatttaatttttatgcggtactctgggagaacagtttccagattattttc

SEQ ID NO: 57448 - DNA, 127 bp, Triticum aestivum
  Clone ID: PAT_TA_57448
gaggaacggcaagacttgccgaggactcagaaggagcgagcctagaatctactgacacatgatgaatctacattaaagctctgttccgcaaaattgctgctgaactgaacggcagtggataccctat

SEQ ID NO: 57449 - DNA, 425 bp, Triticum aestivum
  unsure (1)..(425): unsure at all n locations
  Clone ID: PAT_TA_57449
ccccgcgtccgaaaaaaataaatatgggggggggggggagaagaaaaaaaaggtaataaagatttagaagtttaaaaaattaaggacggcgggtttggtgggttcgcatgccttgctttcgggggctggcgtggcctttcgctgttttgtggggtcgcccccttgggtttggtgggcccggcgggtgtccccggggggggggggggtgggtccctgtggggccccgccttttttcgcgggggggggcggccctctttgggcggcggccgttctcnccgggggggccgcccggttggccctcgcttcccgtcggtgtttcctgcctgtggggggggcggcccccgggctgggccgtggggtccccgggggggggggcgggtcccccgggcgggccgctccccttgcctggcctggcgcggccgccc

SEQ ID NO: 57450 - DNA, 643 bp, Triticum aestivum
  Clone ID: PAT_TA_57450
cgctcgctccagccgtcacctctcgtcctctgttcctcgttctgcctcactccacccgccgctgcactgcttctgtagaccaccatgaaggtggttgttggttgagtgtgagtgagagctctagtccttcatcgatcgctcatcttgttcgtcaatgaattctgcgcctgtcatcgtcaccaaggaattggcgtcatcagttgataatcgagtttaccttgttatttgatctgctgggcatatcaactctgcagtaaggaaattagctgagccttctatcaccaaataaaagggttgtgatgtcgctacgacagctgctgggatggtcggatggagaggtaatgcggccggagtcaaagccctgctcgcgactgatgcgccacactgctggtatcttctcagttggtggaggtcttgctttctgggtgctttgccgccttcactatggtccaaggataacggttccaaggagtcttatgtgggcatcctgtggagcgataggcacgatcgcgacggcagccatgcttgtgcggctcttcagcccggagtgtgaaccgcagaacatatcagcttttgacagacctgaatacaagcctgcatagtgtcatgataatccagtgccaggtctaccaagccatatgcg

SEQ ID NO: 57451 - DNA, 289 bp, Triticum aestivum
  unsure (1)..(289): unsure at all n locations
  Clone ID: PAT_TA_57451
gaaagattctatcttccaacaccatagtcgccagatccccatcccctccaccacgatggcccgcacgattcatacggcccgcaagtccaccggcggcaaggcgcccatgaagcatctggccaccaaggcggcgcgcaagtccgccccggccatcggcggagtcaagattccgacatgttccgccccggcaccgtcgcgctccgggagattcgnaagtaccatatgatcacggagctgctcattcgnaagcttcncttncatcgcctcgnncgggatatcgcgcatgatt

SEQ ID NO: 57452 - DNA, 722 bp, Triticum aestivum
  unsure (1)..(722): unsure at all n locations
  Clone ID: PAT_TA_57452
gcagtacagcagtagccccacaagcgccctctagctgccctgtccctgcaccgagctgagagagcaatggggccgagcagaggcagcctggtcgccactgtggcggtgctccacctgctgctgctcgctccgagcatggcagcggcgttcaactacgcagacgcgctcgccaagtccatcatcttcttcgagggccagcgctccggcaagctgccccccggcaaccgcatgccgtggcgcgccgactccggcctcgccgacggcgcgcagtacaatgtacgctttttctcgctccgttgttcgtgtgtgtgagtcaccgggtccgggtccggcattgacctcgccgtgtgtgctttcaggtggatctggtcggcgggtactacgacgcgggcgacaacctcaagttcgggctgccgatggccttctcgacgacgatgctggcctggagcgtcgccgacttcggcgccggcgacgacgactactccttcagctgggacgacaagagggtcggcaccaaggtgctgctctcagggggttcctgcggcgcaagctgcaggggctgcagctctacaaggctcactccgacagctacatctgctcgctcgtncccgggacgagcagctttcaggctggccagtacacgccggggagggctcatcttacaagagggcgagagcaacatgcagtacgtgacacgggggacgtttctgctgctcgcctac

SEQ ID NO: 57453 - DNA, 211 bp, Triticum aestivum
  Clone ID: PAT_TA_57453
gtattttaatttagttaggtaactctgatagtacaatctggttggtaaaccttagttatgcgtgcagctctgagacacctcattagaaattttctacatggagaacagtttagtttaaaaaaaaaaaaaaaaaaaaaataaaaaaaaaaaaaaaataaaaaaaaaaaaaaaaaaaaaaaaaaaaaaaataaaaagggccggccgtttttaa

SEQ ID NO: 57454 - DNA, 139 bp, Triticum aestivum
  unsure (1)..(139): unsure at all n locations
  Clone ID: PAT_TA_57454
ctacgcccacacgnccgcacagctagaacactgagctctcctgcgctgactccgaacccagtaggggagattccatagcctatcnnccagccacgctctacgggactgcggacagactctaagnnccatnactactctc

SEQ ID NO: 57455 - DNA, 171 bp, Triticum aestivum
  unsure (1)..(171): unsure at all n locations
  Clone ID: PAT_TA_57455
cccacgcgtccggtcgagnctcgagaggcatctggtattatttcggtaggggcttttggcnctatatccatnaggaagagtcaagcgttaaataaataattgaattgtgcctgcatgcaatgcaagcagaactatggtcnctgcnagctcttgccttgagataaatatata

SEQ ID NO: 57456 - DNA, 484 bp, Triticum aestivum
  unsure (1)..(484): unsure at all n locations
  Clone ID: PAT_TA_57456
cccacgcgtccgcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccntgatcggccaggacctggacggccgcatcatctccggtctcgaggcgcagtcccgtcgctccggcggtggaggcggcggcggcttcggcggcggcggtggcggcttcggtggcctgcgccgtgtgggcggtggcggcggcggcntcggtggcggcggcggcggctccggggcgggcggtgcgggtggcg

SEQ ID NO: 57457 - DNA, 315 bp, Triticum aestivum
  unsure (1)..(315): unsure at all n locations
  Clone ID: PAT_TA_57457
acggaatccataagtcatcaatcatccctcgcccgccgccgccgcccgtcgcggtcggcacggagcatcggcggtgaccccgccctctcgcggccttgcggccgatcgatcggcgtcatggcggcgcgcgggctgcggggcgtccgcgacgacctgtcggagctgggccgccacctgctcgacatcgcctgcttgctccacccgctcctcaacccggcgcacaccgactcgccgccctccaccccgacccacgcgcgcccccaccgccgccgntccccgtncccnnnccccncnnccccggcctncccgnccccc

SEQ ID NO: 57458 - DNA, 163 bp, Triticum aestivum
  Clone ID: PAT_TA_57458
cccctctccttctactttcctacgccgcctgcaaaccctatacccgcgcgcttgcgtcctccgccccgcagcccatggcgtggtctcctcccctcaagatggtgctgtttcccattgcgaacgggacggagccgatgggggccgtattcaccatcgacgcgct

SEQ ID NO: 57459 - DNA, 347 bp, Triticum aestivum
  unsure (1)..(347): unsure at all n locations
  Clone ID: PAT_TA_57459
cccacgcgtccggcgcatcatcagcagcagactcgctcgacagtcgccatggccgcacggatagcggcggcgcttcatgtggcggtggcggtggtggcgctggcgctgtgcgcggcggggggcgcggggtgccggaagcacgtgcggagggtcacggagtacggggcggtgggggacgataggacgctcaacacggtcggcgttcgccatcgccgtggcggacctgggcatgcgcgcgggcgatggcggcgcggcgctggtggtgccggatgggcggtggctctcggggccctttctcctctccagcnccttctccctcttcctccncttcggcgccgngttcctcg

SEQ ID NO: 57460 - DNA, 294 bp, Triticum aestivum
  unsure (1)..(294): unsure at all n locations
  Clone ID: PAT_TA_57460
gcccgccgccgccgccggcggccgcgggnngngnnggcnngggggaagggaggatgccggcggggcncgggctgcggtcgcggacgcgcgacctgttcgcgcggcccttccgcntgatggggttcctcccgctgccctcctgcctgcgcncctncntggtcggcgagcatgtcggggtggggngtgtcggcgccgtcctctgggtntgccgcgcttgttcttcctcggccgctccggtcgcgtctgtgtcgctcccgtgcgcgccgtcggcggcggggtcctcttgccgggtgg

SEQ ID NO: 57461 - DNA, 506 bp, Triticum aestivum
  Clone ID: PAT_TA_57461
gggcacctctgctcatagcgaagagcgaaaggcacggccgccgccacgcaccacccccctgccgccgacacgctgtaggtccgccgccggcaacattgaaggggcaccacagcacacaaagcagagagtaatggcgtcaaccaccatatcgtcctgcgcatatcaggcggtgcaaggcgcgcaccgattgaagatctgtcagtttagtcacgggattgttggcatggacgtcaatgctgatggtttcatccgctccagcaccttcagggttgggggattcgactgggctatcttgtactacccagagggttatggcgacgacagtgagggattcatatcagtttttgttgagttcatgagcaagtatgggcaggcgccagcggtcgtcgacataagactgattgatcaagtcactggaaagcccaaatcgttattgtcaagcgtattctttgaattggatgaggagccgtttcgattcgagtctgacagcttcgcagagcgctcct

SEQ ID NO: 57462 - DNA, 330 bp, Triticum aestivum
  Clone ID: PAT_TA_57462
acaaccccctgccccaaaccaccaccgggggcggtgcagagcatcctcggtgacgacgcgatgcatggcgaagcttctgtatccctgtaaggcggccgatcctgctgcaactgacgcgacgccgtacagaatgcggagcatgcgacaccctgtcgtgacgcacccgtgaccgcccctaccatcactgctttggccgcgtgctggccaagcgcccagggacggtgatccggccgttctcggccattaagacggccgatatggcccgtggcaaggggcctgtcacgctgctttactcgccccacctggtgccggcccgctgcacgtggacgt

SEQ ID NO: 57463 - DNA, 441 bp, Triticum aestivum
  unsure (1)..(441): unsure at all n locations
  Clone ID: PAT_TA_57463
cccacgcgtccggagtcatgatgagtcgcacgtcgaatcatccaggagtcaagcgcatatatacatacgtgtgtgcggtgtattgaatacaggcaggatgtcgggggcacatggggcgcacccggtcggggagacgatgccgacgacgtacgggtcggtgggcggcggggatatccgcacgcgcacggacctgatgtcgcgggatgaccagggcatcatccatatcgagatggtgcaggacataggtggaggatgccgcgtcgcgcatggtcgacgacagcgccttcgctgccatgattgatccgggccaggccggcgatgccggggcatccggcaccggcgcgtgatctgggttctgttctgtggcgccctgccgggcgcgcgcgtngcacgatcttcgatctgngtcgctgcctttgcgcgcggcgcgttgcgtttgtg

SEQ ID NO: 57464 - DNA, 430 bp, Triticum aestivum
  unsure (1)..(430): unsure at all n locations
  Clone ID: PAT_TA_57464
aacccccggnacctgnagcaggagtataaatttcccccgacccgggatctccatcgccgatggcgtcccggagctgcaccttcctcgagatcctgctcgccatcatcctgccgccgctcggcgtcttcctccactacggctgctgcagcatggagttctgcatctgcctgctgctcaccatcctgggctacatccccggcatcatctacgctgtctacatgctcgtcgcgctcggctcggaggagcgtgatagggactacaacacacttgcttaataatcctgcaacaacttgtgattgtgtgatgcaccgcttgcccagttgtgaattgacgtccctgtttatgttagtctgtaaatgcttaaaccgtcctccggtttctccatcctgtaattctgatacaaccgaataaaatttcagcagctccgaag

SEQ ID NO: 57465 - DNA, 175 bp, Triticum aestivum
  unsure (1)..(175): unsure at all n locations
  Clone ID: PAT_TA_57465
gactccacgacgctcacgagtacgaaatgctcatgtgtacagaggatgatgcaatgcntatgatgtctacgatgatgcngtcttattgcaatgcaatgcaacgatgagttttctctaatgtaatgtatatgtaacgtgagtttttccggtaataaaagacgtgaccttgcccgtc

SEQ ID NO: 57466 - DNA, 181 bp, Triticum aestivum
  Clone ID: PAT_TA_57466
acaagtcacagctacatatagtaccgggggcggttcctttggcccgcggggtccctagttgctggtgtcttgcggcggccttggcgtgctctggacttggtgcttggcgcgcctgctgtgtggtcgtgcgggcggtggtgtgcgtctctgtgttcgttttgtgggggggggggggggtgcc

SEQ ID NO: 57467 - DNA, 614 bp, Triticum aestivum
  unsure (1)..(614): unsure at all n locations
  Clone ID: PAT_TA_57467
ggaagggagccaggtcctccgtccactccacttccctatccgccgcccccgccccgcgcatgcgacaccacgtgtccatcacccatctccgtcgcccccgcgcccccattcctccgcgcgccctccccgaggtgagatcaccgcatccttctcctcctgctccgacttgcgctccccatcgccgctccactccctcgacctcgagagccgcgagccgccccatgaccgtgtccacgagcccctataactaagccccggccccgagccaaatccctcccgccaccccgtcccagcacccccgcatttggatggattcggcggcctctacaaatcgctccccgctgcgccccgccgccgccgccaccgcgcgccgaatcagcagctccgtccgccccgcgcttcctaaccgtgtggcagcgagcaggcttggggtcgcgcccgggtgcggaggagggcacttcggaaaggcacagcgatttatgtccgtgcggagtacctcggtgggagctgagactggtcctgctgngagaattgtgaccgcggcaagggaaagcgcatcggcgggtaccgaaatgcccttgaaatatgcttccggcaaagcatcccctctagga

SEQ ID NO: 57468 - DNA, 697 bp, Triticum aestivum
  Clone ID: PAT_TA_57468
gcgggggcgaaatcgaagaaccagaacggccacatcttcctccccaacggcacctcgctctacgacctcttcccacgctcagggaggtgcccgccgagagattcccagcggctttccgtgaggccgccggagtgccaatgacggtgcccgccgccgccgccacctgtccgccccttgcgcatggtcagccggcgagcagggagccggaattgcttcaggctagcgacgtgatggcggagcagcctgcttgggctgcgccggcgcagcaggctttcaacttcgatattacgagcgaagaggcgaatgccggcttgtctcttcttgacttgaggggaaataatccagcctccgaagcggaacctatggatggcattgaatggccttctacggaacacagcttgagtttgatagacgcagtagaacagatcgagaattcagcccgtggtgaccatgagatgcctgatgtggttgaggtaaggatcacaactgggtgatcgacctatggatattggcttgtcgacagccacccatgtgaaagtgaaagtgatggaaacgaagtatcagtcagtgcgaacatcagaaaccaagtacaagccagagagtttacttaaggatgtcagatgatttgctgtccactgggcttcttgaaggtttcatggtgacctacaagataatggggggggagatgactggggcg

SEQ ID NO: 57469 - DNA, 728 bp, Triticum aestivum
  Clone ID: PAT_TA_57469
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccctttttttttttttttaaacaaaaaacccccctggaaaaaggcctttaccggcataaaacccccccccggggacaggaaaggccccttccttccaaccaaatggaagtttggcccgaaaacccccccaaacccttttaaggccaagggctcggtcctttattggcccaaccccccccgggggcagggcccccctccccttttaaaaccccccgggggccccccggggcccaagaccccccccccccccccaaggggaccccggctggaaaccccccccccaagccccaaaagggggggcccacccaaaaaccccgggtaaaaaaggaaccattcgggattgtgggggggaccccccccggggattaaaaccccccattcgttgccccgcggaaacccctcggccgggggggccccggggtccccggggaaaaaagcgcccccaggaggagggcctcccccccccaagattccaaaagggaaaacccccccccccgggggggcgcgtgttaaaaggccggccggggggggggctaacacaagttttgaaaaaggggggggcccccggggggggggccccgggggggggcccccccccctgtgggggggcccggggc

SEQ ID NO: 57470 - DNA, 646 bp, Triticum aestivum
  Clone ID: PAT_TA_57470
cgacggcggtcatcaccgcaagcgaagaagaagccgagagcctggagatatcaggaggagccacagtaggcggagaagcccaactgaagacgatgccggtcgccgcaagcgaagaaaaagccgagagcttggagataccagcagccacagcaggcatagaagcccagccgaatacgacggccgcggtcatcacaagcggaggaagatccgagagccaggagaggtgtcgcctggcacggaggatggcagtgccagaagaggtggaacctctgctgaagcagaccacagccctcgtcatcgatctcatcgggagcagaggcatcatggcggcagcagccgttcccgccacggcgaccgtgctcgctccaggagatccgagagccgagattatagtcagtagatgtctgtcatttccgcggtgtgagaaacaaatggatccctcgcctatgtgctgctcgcttgatttgatgaggttcgtcgccgccatgtgtaggctctgttccgttgccgggttgtttgtcttgccaggcgacaccgcccgccgtatgtgtctggatccacagcctggttcctgagcagctggggatagttctaattctagctctggtaattcaggaaaggatccctggctgtaagtatagcttgc

SEQ ID NO: 57471 - DNA, 587 bp, Triticum aestivum
  Clone ID: PAT_TA_57471
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggtcccaattttacgtcccggggctggcaaggtaaaactttttttttggggcccccaaatttaatttcatgggccgggttttaaaaacggggggaggggaaaacccggggggttccccatttaattggcttggaaaaaaatccccttttccccggggggggtattagaaaaaaggcccccccggatcccccttccaaaaagtggcccacccggatggggaaagggaaccccccctgtaggggccctttaacccgggggggggggggggttccccccagggggcccgttacctttgcaagggccctaggccccgccccttgggtttttttcccttcttttttggcaaggtgggcgggttttcccgggaaagtttaaaaaggggggcccccttaagggccccaattaagggctttaaggcccccggccccaaaaaaccttgtttagggga

SEQ ID NO: 57472 - DNA, 102 bp, Triticum aestivum
  Clone ID: PAT_TA_57472
attcagcgatatggtgatcctcgtgcggcgtactaagactctgggcttggatcgctgctttcttatgtgatgccatatgcgcggagcttgaggggagcacgg

SEQ ID NO: 57473 - DNA, 217 bp, Triticum aestivum
  unsure (1)..(217): unsure at all n locations
  Clone ID: PAT_TA_57473
cttctccgatctcaccacctcaaaggcggaaagggagcgtctcccaccattcttaggcgccaagcaaagcgggagtaaccctagctccagctccgcctccggagccgggcaccttccgcgcggcagatgtcgtcgccgacccgcgcgccggcgccgactacgcccccggcgccgccggcnttcgccggggcgccgnccccggccgccccgtgggcgc

SEQ ID NO: 57474 - DNA, 130 bp, Triticum aestivum
  Clone ID: PAT_TA_57474
ggaactttgaactttttgagcacttttgcggtagagttttgatgtttatttttccaccgatgttttgaattgtggccaggacgccatgtgatggatgcttatataaccaacctaaagaattgtccgttct

SEQ ID NO: 57475 - DNA, 487 bp, Triticum aestivum
  Clone ID: PAT_TA_57475
gagagggtgggcaacatttggaatcatctcttgcatattcattgtcttttcgagcctactttgttgtggggggttcatctacagaagtcgtgtagagcatcaggatggtttacatgcactgcctgggatgactaccgtgtctgcctttctggatgctgttggaagaccaagatgctacctgagagcaggtgatcctagtggaaatcattcaagccaagtatcatgggagaacacttctgttaccacaccagcagcacagaggacaaatgatggaagatatgggacattatgagccatgcttatttttgtggaatttgtcttgtagtcatggaaaaggagcctgagaagggacgcggcgatgcgcggttccttggcaatcgccttcttcaagacggagactacaatctcatcagcttgcgggcatgtggacctgtagaaatgtggagaaaggcctggctttggactgtgtccaattggatgggcaccc

SEQ ID NO: 57476 - DNA, 426 bp, Triticum aestivum
  unsure (1)..(426): unsure at all n locations
  Clone ID: PAT_TA_57476
gagggcgccggcgaggtggtacaggtcgctgatggacggtaacacccacggccccggcgggagtctgctggtagggtgcacggccgtccgccgtcgttcgggtcgccagcctacagcccgactctctctctacgtgtggctggtcttggctgttcggctagccgtgatttctttcgttcttcatctggtgttttatggtgccgctccgcacgcgtgtcgtggttcttttttggctgctcggcgatttggtcagccattactctctcacacattttgttgtgcagcagatttgatgtaggattcgccagtgaccgtacgagtacgctgcggagttgctgccactgccgccactacctggattcgctcgcttgcgtttggaaccgccccatggntttgtctcgctggggcttggagtctccgccgccg

SEQ ID NO: 57477 - DNA, 501 bp, Triticum aestivum
  Clone ID: PAT_TA_57477
aagaaaaggacaaggagatcattctaaggccattaaacatggcagatttgaaagaagcaaagaaccaggtggcggcgagctttgctgctgaaggttcataatgggtgagttgaagcaatggaatgatttgtatggtgaaggcgggtcgaggaagaaggagcagttgacatacttcctgtgaacacaagtgtatgaacataattcggaaagtagaatagatggcgaacagctacatgaaaggacagtctatcgccacgtaaactgtagtttgcctgtgttcggttgttgtactactacactaataatgaatctgcagggcagatccttttgatttttgttctttcttttagttttgctcctttgtgtgcatctctcgatcccccatgtcttgtgtataggtagttcatgctgcttggtaggttgtcgttggccacaaaacagtatcagcgtgccagtctgtgtgtcagtttgcttccctgctgaatctagtgaaactcctta

SEQ ID NO: 57478 - DNA, 124 bp, Triticum aestivum
  Clone ID: PAT_TA_57478
gcggacgtcaatagcttctttctattaggtggtcacctatatattcatattcacttggggccagtcgttttacatacggtcggtgacttggggaataacccgtgggcgttatcccaatccttat

SEQ ID NO: 57479 - DNA, 475 bp, Triticum aestivum
  Clone ID: PAT_TA_57479
gacattctgaaagttattacctctgatatatggattcagcattggtttgcgcggtgttgcgcctgtaataatggtttggccattcaaaagagtgaaatgaaaagaaaataatctctgtgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaacaaaaataaaaaaaaaaaaaaaaaaaaaagggggccccttttaaaggcccaactttaagtaccgggggggggcgaggtttaaatttttttaggggggaaaaaacttgaatttcccggcccgggtttcctcacggcgggtccgggtaaacccggggggggcccaatctaaaaggcctggaaaaaaacccctttttcccagtgggggtttttgttaaaaaggcggaacccgccccttttcccccctttt

SEQ ID NO: 57480 - DNA, 305 bp, Triticum aestivum
  unsure (1)..(305): unsure at all n locations
  Clone ID: PAT_TA_57480
cctgcttcttgtagcttgccgagccgtgtctgctgcactctctggccatggcggctgcgaggctgggtctgccgcggttgatgctggcgatgcttgtactggcggcattgctcggtgtcggcgtcgacgggaggaaccacatgcacaagaagcctcctcgtgctggcgtcggctctcggcacagggctggcgcgaaggtggcacggatgggcgtcgtnnccgnccgntccaccggacgacgacncggcgcctttggtggccccgccgccgggcggccttgtcccgtctgacccgtcgccgccgtt

SEQ ID NO: 57481 - DNA, 647 bp, Triticum aestivum
  Clone ID: PAT_TA_57481
cccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgttttaaagaatcaaattttactaccccgggcatgcaaagtaaaattttttttttagggcccccaaatttaatttactgggccggggtttaaaaacgggggaatgggaaaaacccgggggttcccaaattaaatcgctttgaaaaaaatccccttttgccaagtgggggtattagaaaaaaggcccgccccgatcccccttccaaaaatttgcccaccctaaatggaaaatggaaccccccctttaggggccctttaagcccggggggggggggggttacccccagggggaccgttaaatttgcaagggccctaacccccgcccttttggtttttttccctttttttttaaaaaatttggcgggttttccccgtaaagttttaaatggggggccccctttaaggtcccaattaagggttttaaggcccctggcccccaaaaaactggtttagggggatggtccacgtaaggggccacccccctgataaaaggtttttccccct

SEQ ID NO: 57482 - DNA, 163 bp, Triticum aestivum
  Clone ID: PAT_TA_57482
attgtactgttatgatagtagcagatgtttcgtcattttcttattgtatattcccttcgttcctgctatattcctgtgtaaggaaatgtattcctgagatgatttttttgtgttatgtaaacttgggagatgtgttatgtgatgtgatatgatggttgacttg

SEQ ID NO: 57483 - DNA, 322 bp, Triticum aestivum
  Clone ID: PAT_TA_57483
aaaaatttaaaaaaaaaaaaaaaaaaaaaaaaaaaggaaaaaaagaaaaaaaaaaaaaaaaaataaagaaaatagagaatgcaataaaaaaagatctaatataaagaaaaagggaggtcattttattgggtcgccgtttttactcgcccgtggctggggttgtcccggccgttttccttgcggaactcgccttgggggggggggggcctttcgctcttctggggttgcccccggttacccccgcgccgttccgccctttccgtccctttgctctgcctccctgcctttttgggccgcgccctgttggggtgcgtcctccgcg

SEQ ID NO: 57484 - DNA, 294 bp, Triticum aestivum
  Clone ID: PAT_TA_57484
gtctcattatgttgctgcatggagccctgatgaaccacctgcagcatgctgtcgtctattcagaagacgtactgtcatcagttggaggaggtcaaggagtggagagccaaagcagctgagatcatgttggtcgtggattacacagtccaagcattgttgtatcttgtatgtaggttttgtatgttttcttttcagaactaggcggctctgtatggctgatagcgtctgtgatgttccgtttgctaatgtgaatatgcatggcatgtttaagttccatgtcgttttcttgatgac

SEQ ID NO: 57485 - DNA, 254 bp, Triticum aestivum
  Clone ID: PAT_TA_57485
cgatggatgacagatatggacatggcacagcttgatgacagagatcaaacacatatgcaccgcagcatcgtgcggctcgaatcagaatggatgtgcgtttgtgttgcgggttgcatggccgactggccctggggcctttctttgacgccagatagggtggggtgatacgcaggaggaggcctcctccggggcgatgaggcgcggagccgcggcgaccgcggacggaaaggcggccagggaggctgaaaaaagac

SEQ ID NO: 57486 - DNA, 436 bp, Triticum aestivum
  Clone ID: PAT_TA_57486
ggggctcttcgtgtccgaccggacctcttcacgaacgccaccacccggcccatcgtggagcgcttcgcgcgcagccagcgtgacttcttcgaccagttcggcgtatccatggtcaagatgggccagatcaaggtgctcactggcgaccagggccaggttcgccgcaactgctccgctcgcaaccccgggactgctgacgggctccagtggtcgtccctggtgcagaccgtcgtcgacgccaccgcggagagcctcggtttgtaaatctatggtcgacaagtctatgtagtgtgtactgtacctggactagtagctgttagccatgcatgtggtaataaaaactgagcagggcaacccatggtcgacgaggctgtgtacgtacctgtgtaatgtaccttgtcgtgactcatacgtgtgctatgctgctagctagcag

SEQ ID NO: 57487 - DNA, 717 bp, Triticum aestivum
  unsure (1)..(717): unsure at all n locations
  Clone ID: PAT_TA_57487
cgatttatggatttatagcttccaggtccacgtacactctagtcgtgacaacgaaagagtggccaaatcaaggagacgacacaagcttggatctgcttctgcagagcagtatatcgggggacaagttcatcgtcccattcgaaaacgagactgagtgtgttgatctatttgaggaattaaaagagatggggaatgtggtgcatgaatcgacactgaaagctgttttttatgcacaagaagaggtgacacacgagatcatatcagccacgaagaaagttgatgcacttggattcggcaataggctggtgtgcctagatgcacatccaacagagacatggatcttaacatgcaagttttttggagatgttcacatgtgggatcttgtctctcaggaaaagaaggccctctgttcttttcatgtctacgagaatggaacaagaggggtatcagcgacagttaaattccttaaatttatcgcacggaagcaatggtttctggctggtgcagacgatggcttcatccatgtgtgcacctacagaacagagatagtacaacagatcacgagtttcagagccggttcttccagtgtcacagcattgaccatccatccaacccagccatatgttgctgtcctcgngcttatgatagcccgattaggctttgggactggggaagaggcctggcagtgcacacgaactttcgacgatgaacactctg

SEQ ID NO: 57488 - DNA, 637 bp, Triticum aestivum
  Clone ID: PAT_TA_57488
gtctcctctcctctccggtcaccgcgccgccgtgcttgagctgcggcgagcggcagaggtccgccgccggctggctcaagctccatccttgtccacaatcaagcacccccaccgccagcgcgccctcctggccgcctgcccacggcgccacaagtcaagtccgcaggatcccctccaaaagcgtcggattcggatgtgcagtttgatgagacgatcccatctccatctcatcttctcgtgtcaaggacgccatggaagagattcatgaatcaatttaatttttgtttgtgctgtaggcagcgtcatcccatctcatctgcttgtgtgaaggacaggggccctggaggagctgctcccctgcgggttcagtggctgctccgacactgacggcatggaaggtcctcgcttgcccttacctctccctgttcgggttccgttcatgagcagatttaatttcttggtagattcacgaatcaatttcccacaagttggagctttatgtggttgcgactagggattattgtaatgctattcgctctcactggatggccgtgtgaatgaaattacatgtgttagtcaaatgagcaaattagatgaccccccatgcctacaagccttcttgggttaaaattaaatg

SEQ ID NO: 57489 - DNA, 288 bp, Triticum aestivum
  unsure (1)..(288): unsure at all n locations
  Clone ID: PAT_TA_57489
actaaaatgatcatctgcattccaaatagtaaaaactgctgattggttgtacacctcacagatccaaaaatcatctgattcagttggatcatgacacagtaggatttgacagaacttactgaacatcttgcagaaattaacgcagtaacagtccgagattaacctctgaattattggagatcacacgtactggtttatttcaaatgccttggtcgtaggggaatggaggtggncggcgagccattcgtcgccgtngatgatcttgtncgcggggntctgggcggcctc

SEQ ID NO: 57490 - DNA, 387 bp, Triticum aestivum
  Clone ID: PAT_TA_57490
atcgaagaggggctcaagatattcaaatatgattggacatctgtttggaagtttgttgtgcctacagagatccttcgctgctccagcgtcagtggagagttgccaatggagtccagcgatcttacagtaaaagtgaggctttgaaagcaaagagaagaacatatgaagcgaagaggaggcaattaaaagcttccatggctgattcacaagtaggtcgtcagcaggagactgataatgatgcttttgaggatgttgaaaatgatgatgatgatgatgatgatggtgatggcagatgatccgtatgtcaatgaagcatttttagcggacacagagaataggagcatgattatgatgcatacgtgcgccagccctcaatgatgaatgggg

SEQ ID NO: 57491 - DNA, 482 bp, Triticum aestivum
  unsure (1)..(482): unsure at all n locations
  Clone ID: PAT_TA_57491
cccacgcgtccggaagtccccgacgctcaagtcccccatacgccgcatcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagatcgatgaggaccaggcctacaggaagatcagactccgtgctgaggatgtgcaagggatgaatgtcctcacaaacttctggggcatggacttcaccactgacaagctcaggtctcttgtgaggaagtggcngacactcnttgaggctcatgtggntgtggtgaccactggcnncttcttgctcc

SEQ ID NO: 57492 - DNA, 391 bp, Triticum aestivum
  Clone ID: PAT_TA_57492
gttctagatcgcgagcggccgcccgcgatctagaaaccctaacatttgcgttaaaaaaaaaaaaaaaaaaaaaaaaaaaaaaaaaaaaaaaaaaggaaagaaaggtttaaaaaaaacaaaaatttaaccaccctgcactgcgcaagccggccccctttttttgggggccccctggtttccctttctttggcccgcggtgtccctccgttgtgttgggggaaccccggggcgtcccccggcgtttcggtttgggtggcccttcccctttttccccctgggggtctcattcttatggccccccccggcccgcccttcctgcccctgggcccgccttgtgggcgttggggcccccccttgcccgcccctgtttatgccgcctggcggggggggt

SEQ ID NO: 57493 - DNA, 475 bp, Triticum aestivum
  Clone ID: PAT_TA_57493
gtttcgggcagtgcttcgccggcccgtctccggcggccccagatgcagatggagcacgccatgggatttccccatccaccacgctcgctgccgtcaagggcaggaaggaaccctagccagcagcacctcctcacctcggatgatgcctctgctgcaccaagatagggcaagcaatccccatctgctctctatctctcccattagcacaagtccatttttaaacaaaattctgctactgcgccaaatagtccatgaacagatatattttttatttgtgaactggtatccttcaaaacataaatagtgtatatatgtgctattttcatttttgttcccttctcatttttgtgcttttatttgcaagctcataaaatagttacagtaaaaatgccagtgtgtgcgaggtcactattgacaagtcattgtagtgctactactgcattaatcttagctgtgaagctatggtctgttcttt

SEQ ID NO: 57494 - DNA, 464 bp, Triticum aestivum
  Clone ID: PAT_TA_57494
cccacgcgtccggaaagaaccatgtgatgttagatggctagctatatatgagatggttgatggcttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgcccctttaaaaaaaccaaacctaacaaacccggcaatgaaaagaaaaacctttttaaaagggcccccaaaataaaattaacggcccgcgttttaaaaacggcgaaacggaaaaaacccgggcgtacccaaattaaatccccttgaaaaaaatccccttttcccaagttggggaaaaaaaaaaaagcccccaaccaatcccccttccaaaaatttgccaacccaaaaaggaaaaagaaaccccccctgaaacggcccataaacc

SEQ ID NO: 57495 - DNA, 287 bp, Triticum aestivum
  Clone ID: PAT_TA_57495
gttatgtttgtcattgacggagtcacgctacaaccgaattagaactcactgatggcacttcgcgttgctgattgtcgaggaggcaaccagatgtaatcggattgcaagtcaaaaacacctatcaggatgattggtggggatggcgaggagtcttccacatagttgtcatctattcgaaccttcccaagctttgtagcatgagtccctcctctggctgactctcctgtggaatgccacttgtgggtcctgttatgctattacagattactggccatgcgttaactcgt

SEQ ID NO: 57496 - DNA, 502 bp, Triticum aestivum
  unsure (1)..(502): unsure at all n locations
  Clone ID: PAT_TA_57496
gcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccatgatgccggccggcagatgcgagcacgatgatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtatttctgtntgcccctgtcgcgtgtgttcgaccag

SEQ ID NO: 57497 - DNA, 500 bp, Triticum aestivum
  unsure (1)..(500): unsure at all n locations
  Clone ID: PAT_TA_57497
cccacgcgtccggaagtccccgacgctcaagtcccccatacgccgcatcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtgggtgtgaagacccctggccnctacctgctccgcgtgttcgccgttggct

SEQ ID NO: 57498 - DNA, 751 bp, Triticum aestivum
  Clone ID: PAT_TA_57498
ctccgaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaagggtcccattttttcttcccggggttggcaaggtatttttttttttttggggccccctattttaatttccggggccgggttttaaaacggggggggggggaaaacccggggggtcccccattttattcgcttggaaaaaattccccttttccccggggggggttttgggaaaaagccccccccggttcccctttccaaaatttgggccccccttttggggaatgggaccccccccttttggggcctttttggccggggggggggggggtttccccccggggggcccgtttcttttgcagggcccttagcccccgcccttttggttttttccccttttttttcgcccgggttgggggtttttccccggggtgttttatttgggggcccccctttggggccccctttttgggtttttgggccctcttcccccaaaaatttttttgggggggggggcccccctgggggccccccccccctgtaaagaggtgtttcccccctttaagggggggggccccccttctttttttgggggcccttttttccctctgggggccccccccccccccttttttggggtttttttttttgtttttttggg

SEQ ID NO: 57499 - DNA, 178 bp, Triticum aestivum
  Clone ID: PAT_TA_57499
ttgtttaatgggacgcgctcttttgtggcgaattaagcccggtttccgcggcaattactacacaggtgaccgcttttattgccagcaccctatggtccactgcttttggtttcttaaatttctttctagccacattcgtcacctttccccgcaaagctctaaatggagggctcccttc

SEQ ID NO: 57500 - DNA, 611 bp, Triticum aestivum
  Clone ID: PAT_TA_57500
gaacgagagaatggtaaattaaaagcgagatcatcttcccttttttacactgtgtgtggcaatggtgcgatgtacgggtaatagtaacaaataacaaaatggcaactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcccctttaaaaaaaccaaatttaaataccccgggaatgaaaaaaaaaatttttttaaaagggcccccaaatttaatttaatggcccgggttttaaaaacgggggaatggaaaaaacccgggggtacccaaattaaatgcctttaaaaaaaatccccttttcccaagttgggttaaaaaaaaaaagccccaaacaaatcccctttccaaaaatttcccaacccaaaatggaaaaagaaacccccctttaatgggcctttaaacccggggggggggggtgtttcccccaatggaaaccgttaaattggcaaagccctaaaacccagcccttttagttttttccctttctttttttgcaattttggaggtttttcc

SEQ ID NO: 57501 - DNA, 688 bp, Triticum aestivum
  unsure (1)..(688): unsure at all n locations
  Clone ID: PAT_TA_57501
acgtcacgcagtatgtttcatatacgttttcatctacagttattcctttgtgcgtgtcatgcatgcttgcgttttcatgatatcttttgccatgctaattaaaatgttgttattgataatgccatgtcactactctactttgtgtgcatgtcatcattataaaatgttatgaggattgtaatgcaccgttgatatgctattacttggtattgtcatgtactttatgctatagttgtgcacttgagaagtttgatattttgccatgcatttgtatgatgcatgctcattgttgcattcaagttaaatatgctcatgatatgggagaagttattaaaatgacttaataataacaaacctcctccgtcattgatgggatcaaggcatagtgccgccaaatcgaactttttcagtgcagccacatttgcctttgcgggaaggccttaatgcgagctagtgccgtgcctctcccctgtgcctcccactagggaaggttataggcatgcttaccctgatcaggtaggcagacataaccttgtgtgccncgttgttaaatttttggtaccggtccccgtgaagggacgttttggccacgatggtgggtccggggagtcttttggtagacacagggccacccatgactagcccaattggaagtggttccggagtggccggggagagtgtcatggca

SEQ ID NO: 57502 - DNA, 442 bp, Triticum aestivum
  Clone ID: PAT_TA_57502
cccacgcgtccgcggacgcgtgggtctcttcaccaacgacgccacccggcccatcgtggagcggttcgcgcgcagccagcggtacttcttccaccagttcggcgtgtccatggtgaagatgggccagatcagggtgctcaccggcggccagggccaggtccgccgcatctgctccgcccgcaaccccggcaccaccgacgacggcctcgggtggtcgtccctggtgcagaccgtcgtggacgccgctgcggagagctactccactagttagattctaatgctagaacccgagagagtagctgttaatcatgtcgaaataaaatagtagtgagtagtgagcaaggcaaggcatgatgatgggggtgcgttctacccgatccagggttacgttcaccagcttgcgaagtcgttcgttgcttatggtgccacgctatctctcatg

SEQ ID NO: 57503 - DNA, 247 bp, Triticum aestivum
  Clone ID: PAT_TA_57503
cccctgattagtcccaagtttttgcaaggtctgcttcttatgcagaggtttcttttgatgggcagcctagccaattaattatgtttggatcactctgggcaattctctctggagttgagagtactctgagcactgcccatagcgtgccacgacgaccgtttgcactataggagcctcgcgacacagtcctcatatgagaagtggggattccaccagcattctcacaaataggtactattcattttgc

SEQ ID NO: 57504 - DNA, 474 bp, Triticum aestivum
  unsure (1)..(474): unsure at all n locations
  Clone ID: PAT_TA_57504
ccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaagttggttacaaccctgacaaggttccctttgttcccatctctgggttcgagggtgacaacatgattgagaggtccaccaaccttgactggtacaagggccccacccttctcgagggcctgggccagatcaatgagcccaagaggccctcagacaagcccctccgtcttccccttcatgacgtggacaagattggcggcattggaactgtgccagtgggcncgngctgagactggagtcatcaagccaggcctgggtgtcacctttggtgctactgtgctgacactgaggggaagcgccctgcggtgcgccatgagt

SEQ ID NO: 57505 - DNA, 160 bp, Triticum aestivum
  Clone ID: PAT_TA_57505
cttcaatgtccatcggcagctgcttgccaagtatccaaggcaaggaagtgatcgatgaatatggatcgaatcggcgtccctcatggcggcgaatgcggtgcattggccggtgatggtggtggtaggtgatcatggccgtcctggccgcgcgcgcgggggc

SEQ ID NO: 57506 - DNA, 246 bp, Triticum aestivum
  Clone ID: PAT_TA_57506
gtttgtctgagctgccattcattggctgtcactacattgccatatgtatcttcagagtttgtttgctcacagagttcttttcggacacatatctcgtgatttgaagctgttggagaagggcttcagagaagcatattggccgaaagccctgtacgtgcaattttagggctgagtgattgctccatctagtttgttctacttctataccaaaacagagttaccctgttttaaaagaaagagttgctc

SEQ ID NO: 57507 - DNA, 172 bp, Triticum aestivum
  Clone ID: PAT_TA_57507
gcgcagacgtcagaaaatccttggttgaaagctgcgcccaatgcccccggccgggcgcagacgtcagaaaatccttggttgaaagctgctttctttaggggaattttgccttgagggattttctcccttgctgtatctgtgtttgccatgaatattatgaagtagtactttt

SEQ ID NO: 57508 - DNA, 366 bp, Triticum aestivum
  unsure (1)..(366): unsure at all n locations
  Clone ID: PAT_TA_57508
cccgccgccaccgccgccgccgcccgtacgagcgagcatgcccagcgcgttccactccctccgcccctcgctcatcaagcggaagcacaagcacaaatccacgcgccgcggcgggaagcgccccaagaagaccagcgagtcgacgagcctcgccgccggaggcgaagacgcctcctttgacctgaagagccccgcctccgcgtcaccgcgcccgggcgcggngtatgaggcagnctcgtccagccgctcgggaacctcctcctcgccgtcgccgggcgcgccaacctccgggacgcgggcctcggtgggcttcgccagctccccgacgacctcctcctcgacgtgctcggnctcctgcccgcccgc

SEQ ID NO: 57509 - DNA, 305 bp, Triticum aestivum
  Clone ID: PAT_TA_57509
ggaggctctctatggtggcaatgggcggcggaggctctctcggtggaggcatgggaggcgggggctctctcggcggcatgggtggaggaggctctcttggaggcggcatgggaggcgggggctctctcggcggcatgggtgggaggaggccctcacgggggcctcgaccacctgatggggctctgagcgagcgagcgaaagaagctgagtctgcaggctgaggagagcctgaaccaacccccagcgatgcatgagtctgtctgtcagtctgttgtatatgtatgagggggaaagaaactccgagc

SEQ ID NO: 57510 - DNA, 110 bp, Triticum aestivum
  unsure (1)..(110): unsure at all n locations
  Clone ID: PAT_TA_57510
gggaatattgaattagcgacagnctgctgtgggtacatgtgtccacttactatccctcatatatggcattgcaatttctctttccatccagtttggcctgctatctgggc

SEQ ID NO: 57511 - DNA, 648 bp, Triticum aestivum
  Clone ID: PAT_TA_57511
cacaacttacttgtatatcctgtcggtgctcaacttgctgcaggtactatgcctcctgcctagtgagctgcaggtcttcttcccccatcacctgcaggcattgacgaccaccatggcctgctggagctcctgctcaggtgatgacgcacccgtgctcctccgaccatgttactgccgacgccatgtagcggcaacttgcagcaggatccccgaccccttcccaacgagctgcctgcaggattcaagcaggcatgtgaagatgagaagagcagcaagctggtgggcaaagtcttcttctgtagtgacaacaacctcatgagcaccgggctgcacgaccgcctgcagctgcaacagatgagcgggaatgagctgcaggcactatacgaccaggacctggctaagttgccttcaagtgacgaattgatggagcttaagctggccttcaacgccacggctgggcagaggttgggcagctggcctgctgacaccaatgcctaatcttttttggtacagagcctcctgcctatagagctgcaagtcctcttcccccaccacgatgtgcccgtgcttctccgaccctgttactgtcgacgccatggagcggcaacttgcaggagcatctccgaccccttcccaacgagctgcctg

SEQ ID NO: 57512 - DNA, 791 bp, Triticum aestivum
  unsure (1)..(791): unsure at all n locations
  Clone ID: PAT_TA_57512
cttcatgtcagcccccttctccttgaccaaaaatccagcccctttctatttctggaggcgtcggcgatgacattcaagcaggtcttctgcgccctgcgagaggtcttcccacaggttgatcttcgaatattgaaggctgtagccagtcagtattcctctgatgtcgatgcagctgttggatttgttctttccgatgtcattccagcagtaagcgaacctaccgaaacagttttcacactccaagatgttgattatgcagaacacggacctgctgattgcaggaagtctaacttacactctggagggatatcattggtggatctagtaggagctaaagaggatgccagtgccctattcgctacgtcagctgagagcagtggcactgttggtgaatgtgatccattttcagattatgatggaccattccagagtaacaacacagtagaaaaatgttcccagatcgaggataaggtggtgataaatgaaacaagaattcctacaacagtaatgaacagccttcttcaggagcattatgctctgcttggatcgtcatcgacatctgcaacggagccacatatgatagagtatgagcagtctgattcaggaggatgtaatgatcattgtgcagctgaaaagaatgaagtgactccagagactgaaataggcaaccacaagcatctatatgataattatgagctatcagatttgcttgcctcttctgggnatatgttgccattatttatggagagcccttcagattgtgcagtgaacatggaggggcagtgcctctg

SEQ ID NO: 57513 - DNA, 612 bp, Triticum aestivum
  Clone ID: PAT_TA_57513
gtcttaggggatcctcgatcctgcattttgtaagcctcggaaacccgtcaccgggtgctcatgcctcgagaaagcacgtctggtcgccaagccgatgcccgccaccttcaccgccatagctgacatcttgctgttgatcaaagatgtggagcaagccgtttcgggccggaggggtcgaagcggcacggtggcaggagatggtgccttccctaaagggaaggaaaaccttgcttctgtgctcaagcgatacaagcgtaggctctcgagcaacaagccacctgccggaccatagctgtcagtcagcctctcaccaagcctctgtagactgtagggttcttgttaccactgcttcttctcgtatattgggtttttctgctgcatgccgtacgcctggaggcttttcgatcttggttcagtaatggcaatcgactgtaactggttttgcccatataatggcaattcactctggtttttcccatataatggcaattgcatagtgttctacaagggcaaggtgtgaacggtcactgtagctgcttcgagcgagatgtacaaaaaatcgctggtagtttgttgaagcggctctgtaaatttgactgtaactcaaattcc

SEQ ID NO: 57514 - DNA, 676 bp, Triticum aestivum
  unsure (1)..(676): unsure at all n locations
  Clone ID: PAT_TA_57514
gtggagcacattattctgctcagagccaagccaaacatctcatatgctgaagaaaaggacatgcttgattacttgtatacatctcagtatcagatgagagggatactcactgtgtcattaggccgcatagagggccctaacagcgagagcttcacgcatgctgtcttcatgcgtttccaacagaaagaagacattgcaaagttccagagtagctcctactattccaaagttctcgacgagcacgtcaaacccgtttcctatattttgagtctgaggtggaagatgacattatccctctctttcggaggggcgaggatttcaactacggagtcgagtttatgttgctgatatctttcttggagactgcatccagagagtctgtggaggatgcattagcccatcttcaaaagctgatcatccactacagttctttcattgttcaagcaacgtcaggttgctgtctggatcatatggatagtctgtacagtcacgcttcagttatccgttttccatcaattgacgacttcaaattattcaaggagagcacggaatacaaggatatgtggacatccaaatttcatccggttactgagagatgtctggagctgcattttgtcgtcgacccggtcggcaaccagctgatgtagattctgagcccctgngctctgaaactgaa

SEQ ID NO: 57515 - DNA, 148 bp, Triticum aestivum
  Clone ID: PAT_TA_57515
caagcagtcaatcagaataaggaaaaggcagccttccacaccgggcgccatggtgttcgacgcggtcgccggcagcggcggcggctcgccggcggcggcgccgaagggtccgctccgccgtatcttcacgccgtgcttcgcccggcac

SEQ ID NO: 57516 - DNA, 302 bp, Triticum aestivum
  unsure (1)..(302): unsure at all n locations
  Clone ID: PAT_TA_57516
gagttcattcccctccatctctcgagttcgacagatcttggctcacttcaccgccggcggacgcatcgaatcgagggaggaccaatggcggaccgcgggggctacgtgcatgtgcatcacgggcagtacggcggcgggcaccacggcgggcatcatcagcacgggcgccagatgggcgatcagatgaagggcatgttccaggatatagcgccgttcggggtcgcatgcgctgacggtgggatcgctgttcccgctgggcggnctgctgctggtgctgtccgggctggcgctggcggcaccgt

SEQ ID NO: 57517 - DNA, 137 bp, Triticum aestivum
  Clone ID: PAT_TA_57517
ccccgcgtccggatgtcggtggatctcgcggcgctggacgcgcggcacccgtcggatccgctcgaccgcttcctcgccgacgccgatgatcggctccgcgccgcggccgacgacgccgtggtggccctcgttcgggt

SEQ ID NO: 57518 - DNA, 214 bp, Triticum aestivum
  Clone ID: PAT_TA_57518
gcacgatccacgccgaggcgacggataaggcctccggcaagtcggccaataccagctatggttatcatcatcggcggctgagtcaggaagagattgacgctatgatgcgtgaagcggacgatttcgccagggacgccaaagctaggctggaggcctacgtgcacagcatcaaggagacccttgccgctgctggtgacatggagctggaggagaa

SEQ ID NO: 57519 - DNA, 352 bp, Triticum aestivum
  Clone ID: PAT_TA_57519
ataaaaaaaaaaagggcagggccggtccacacgtatcacagatctcaccttaccgaccctgccatgcgatagtcttatctatatctgtacacgtaacctaatttcactgcactggccgttacattcacaacgactggaatagaccatgccctgcccaactcaatttacttgcactagatcccattctcctcttctgcagtgtagcaaagacgacaggcccgatccgcctgcccttaccatgcagctgccgatcgtgaatgggaacgcgcacctgccctgtagcttaacctcagcgcgtgtggtgtgtacggttacgcgcgaccgttacccttgcacttgccatagccctagc

SEQ ID NO: 57520 - DNA, 458 bp, Triticum aestivum
  Clone ID: PAT_TA_57520
aaaaaaaaaaaaaaataaagggaaaaagccagggggggggatggaaacagaaaaaaaacccataagcccccccacccatttggaacctgggggggcccaacggccaaccccaattggcccccgccgccgacccttttaggccccccctaatccagccccggggggggggccccccccccgggggggccccccgccgccgcctttggaagcccccccccctgggcccgaacctaagggccctggcccggccccgcaataacctccctaacgggggggggaatttcctttttccttttgggggccggcccccgtatgggggggccccccccctccctaaaaaagaaaggggttccggccgtggtccccggaaagaggggccccccaaccttggggcccccgggcccaaggtctcccagcccggggttcccccccgagggccccaaaaacccccccggggc

SEQ ID NO: 57521 - DNA, 388 bp, Triticum aestivum
  unsure (1)..(388): unsure at all n locations
  Clone ID: PAT_TA_57521
gccaggggaaaccctaggactcgtccgggtagcagcgtcgtcggcgtcgcattccttcttggaggtgctgcttggtacgcggcggttcggaacctcggtctgtggtggtttgtatccggtgggcgccgcggtggcgggtcatccgcgctttgccgagctgctgtggttggcatttgtttcttcttccttttcttttggtgtgttgtgctgctcgccacagcgatctttgtactcggtgttggttgctttggaatacaaagcgggggaaaccctttttcggtgaaaaaaaaaaaaaaaaaaaaaaaaaaaaaaaaaaaaaaaaaaaaaaaaaaaaaaaaaaaatnaaaagtataaaagaataaaaaaataaaaaaaccgtttttggggg

SEQ ID NO: 57522 - DNA, 597 bp, Triticum aestivum
  Clone ID: PAT_TA_57522
tccactgcgctccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggtcccaattttacgtcccggggctgggaaggtattattttttttttggggcccccaaatttaatttccggggccgggttttaaaaaggggggggggggaaaacccggggggttccccattttattcccttggaaaaaattccccttttccccggtggggttattagaaaaaagcccccccccgttcccctttccaaaatttggcccaccctaatgggaaaagggacccccccctgtaggggccttttaacccgggggggggggggggttccccccaggggacccgttacttttgcaaggcccttagccccgtttcttttggttttttccctttcttttttggcccgtttggcgggttttcccggtaaatttttaattgggggcccccttttggggtcccaattaagggttttagggcccctcccccccaaaa

SEQ ID NO: 57523 - DNA, 537 bp, Triticum aestivum
  Clone ID: PAT_TA_57523
aaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaaggtcccaatttaactacccggggctggcaaggtaaaattttttttttggggcccccaaatttaatttcctgggccggggtttaaaacgggggggcggggaaaaccccgggggttcccaatttaattcgcttggaaaaaaatccccttttccccggtgggggtattaccaaaaaggcccgcccaaatcccctttccaaaaggtggcccaccctgatggggaaagggacccccccctgttggggccctttaaccccgggggggggggggggttccccccagggggcccgttattttggccaggcccttatgccccgttcttttggtttttttcctttcttttttgccacttttggcggtttttcccgggaaggctttaaatggggggccc

SEQ ID NO: 57524 - DNA, 324 bp, Triticum aestivum
  Clone ID: PAT_TA_57524
aaaaaaaaaaaaaaaaaaaaaaaaaaaaaaaaaaaaaaaaaaaaaaaaaagaaaaaaagatggaaaggcgccttaattactaacacgctcatgaaacgagaatgctattttatagagtaatctaaaatgaaagggcgtgccctttatttgacccggtttttactgggaagacccgggagttacccttcttttttgggtggcactaaatttcatttacgggcgcgggttttaaaccggggaggccgggaaaaaccgcgcttccccccacttgttcagcctgggggccaattggttttcgccctgggggggcgctgtaaaaggggc

SEQ ID NO: 57525 - DNA, 656 bp, Triticum aestivum
  unsure (1)..(656): unsure at all n locations
  Clone ID: PAT_TA_57525
gcctcctctagtgcctctcccacatcaccacggcctgcccccttgccggcgacatgagagcggcccccgccaccgcctccggcgcggcggccttccccacctctgcctcgccgactccccgcccgcgccgctcctccccaccgtcagcgacgagctcccctcctactccggctcctcctcctcctactccgtcacctcggcgaggtcgtgcgtgtccgacgcggcgcgccgcatccgccccatcgaccccctacgcgtgctcgccgtcatcgcctccctccgccgcatcgaccccaaagtactggcgcaagcgaccagcaagctgttccagggcgagccggcgaataagcggaaaggagtgtggatcgaggtcctcaacggcgatgaggatgacggggaggatatcgagagggccatcgtggtggccatcgaggggagcaccatcacgggagccgcgtgctcccgctccacggncacgtcggggagatgccgccgacctccgctggcgatcggtggttgtgagagtctggtgcggatagcggactcgatcatgaagtggctctcgcggccgaaggcggcaccggccacggagacggtcatccgcgccgccgtgggcgacaacgctgtaaccagcaaagctctgcgctgggtgctga

SEQ ID NO: 57526 - DNA, 176 bp, Triticum aestivum
  Clone ID: PAT_TA_57526
gcagcagcgcagtggactacgtagcgaggttagataggtaggttgcagaggaggccaagttttaatggttgtgttgcttggcagaagctcgctctgcagtctgcatctgtaatgcgttgtttcgtatcgcagcagtgttcgacctaatttacatcgctttgttgttgaagtgtgat

SEQ ID NO: 57527 - DNA, 548 bp, Triticum aestivum
  Clone ID: PAT_TA_57527
gggctacgactccacgccgctccgaatagaaaaaaaaagaactaaaaaaaaaactaactaaaaaaaaacagaaaaaaaaaaaaaaaagataaaaaagaaaaaaatacttagaaaaagttagaatataaaatactctgaagaaaatggaaaatgacaccgatgaacgtgaactcatgacaataatgaatatggtggggcttattacatgtgcaactgtgtcttctagaaatatgcggatttttatcctttgctttctttaacgcttaaggcagattttggaggggcctcttgaaccagaaaaatctgtgaatcctagctggaccaaccataactggtatcttaattatagccttttttgctatgcgttgcaaattatagaatggcggtttccattccgtgatccccaacagagccgcctcggtatatggcactttccccccctttttgggcctttttaacgggggggggggggggtttccccccggggggcccctttttttttggcccagccccctacccccccgtttttggttttttccccctttttt

SEQ ID NO: 57528 - DNA, 460 bp, Triticum aestivum
  Clone ID: PAT_TA_57528
gttttggttgtgtattgtagtttatttgttggcacaagtacacaagctgaatttcatgatgcatacttgcaatcttgctcggttgttgtgaggaactttcgtctatttatgttttcactatagatttagaattttcatctacatcctattctttctaatggaaggtggattttcattacatttttacgtttgtggtttaggtaggacaggtgagctgaaaatagtttcacaagtacactatatgtgcctttacattttttccattctacttaaggggaattccagacagagttcatccattcagtgaaggcatatgttcaaaacatctgtggcttcagattcatttgaaactctattaggtgagtgttgacacttccgaataatgttcattctagctatgattgtttatgtcagtatacagtttgctctcaccttttccccaaagtgcatgggtaaggca

SEQ ID NO: 57529 - DNA, 503 bp, Triticum aestivum
  unsure (1)..(503): unsure at all n locations
  Clone ID: PAT_TA_57529
cacggacttgagaagaagaagattgaaaggatgcacaaagatcagttacaatctatagataggacgattatgtttgttgtgttcatgtactttgggttagtcgtaatcatgtttgatgtggttgacaagaagtaatgttgtcattgtccagtctagaaggtcatgtatgttgctgaaaatttgtattttgctgaataatctttggtgaattacaaagaatgtaccttttggtaaaaaaaaaaaaaaaaaaaaaaaaaaaaaaaaaaaaaaaaaaaaaaaaaaaaaaaaaaaaaaaaaaaagcttacttcaaaaaaaaaaaaaaaaaaaggggggccgttttgggggttcaaagtttacttccccgggccggcgacggtatagccttttctttggggncccctagcttcattcaactggccggcgtttcaccccttccccccttgggaaacccggggggttccccattttacccgcttttggggctttccccctttcccccttt

SEQ ID NO: 57530 - DNA, 584 bp, Triticum aestivum
  unsure (1)..(584): unsure at all n locations
  Clone ID: PAT_TA_57530
agacactcaacctcctcactcctcacgtaattctcttacctcttagcttccttccctgaacgcacccaccattgaataggaggatgtctggctgcgccggaactgctgggagcgccgccgcctgtgagtgcggcaacagatgctgcgggagcaagatgccccccgacgtgcaggccacctgcggatccgcacccctggccatgcccacagcctcccacaaggggagctccgcggggatacagacggccgggaataccgcaccttgaaactgcaccacctgcgagggcggtaccgcgggaggttgctcctgctgcagctgcatcagatccggcgcccaagacgaccgccaggataagcaagcccgacgatcaagatgactagccagcaagcaccatcaccaccatgtcaccaccacacacggcataatcaccagccgccgcatgcgctcgaggacgcacgcgctgagtaaaatataaccacctctcgatgcccctagctctggatgcccatgacgactgtgcttgaccaggactgcacttcctacggcctncactcgctctgactctgtggcgcctcaactttga

SEQ ID NO: 57531 - DNA, 516 bp, Triticum aestivum
  Clone ID: PAT_TA_57531
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggaccaaattttacttccccgggctggcaaggtaatattttttttttggggcccccaaatttaatttaatgggccggggtttaaaaacggggggatgggaaaaacccgggggttcccaattttattggcttggaaaaaattccccttttccccagtgggggtattaggaaaaaggcccgaacggttcgcctttccaaaaattggcccacccggatggggaatgggaaccccccctgtagggggcctttaagcggggggggggggggggttacccccagggggaccgttacattggcaagggccctaggccccgtccctttggtttttttcctttcctttttggcaaatttagcgggttttccccgtaaagctttaaatagggggccc

SEQ ID NO: 57532 - DNA, 120 bp, Triticum aestivum
  Clone ID: PAT_TA_57532
aggacgtccaattttatagctcgtgtatcttggcacctactcgctctgcactgtgcgtctgtataccgcggcttgacagcgaatacccggtcgacctactttatcattgctctggtgttg

SEQ ID NO: 57533 - DNA, 300 bp, Triticum aestivum
  unsure (1)..(300): unsure at all n locations
  Clone ID: PAT_TA_57533
cagagctagctagttcaaccatggcgaccagaggcagagcaaccatccctctcctcttnctcctgggcacaagtccttctcttcgccgcggctgtttcggcctcccatgacgaggaggaggacaggcgcggagggcgctcgccttcatcggagcgagcagcggagccagnaggaccgnccgaggtactctcatgcccggagcgtngaggatagccgggacgaccagnagnagcacggaagggatgatnaggaggagnagggncgcgggnatggncggnacggcgagggggagcgagagga

SEQ ID NO: 57534 - DNA, 521 bp, Triticum aestivum
  Clone ID: PAT_TA_57534
aaaaattttaaaaaaaaaaaaaaaaaaaaaaaaaaaaaaaaaaaaaaaaaaaaaaaagggagggccgttctataaaaacaaatcctaacggaccgccgcttgcggaggcaatacctttttccttgggggggccaaaataaattcacttgggcggtgggtccccaatcctttttgactggggaaaccccttgccttaccccaccgttatgtgggttttgcttggagtcccccctttctttagcgcgcggggaaaataacccaggccggccccgtggcgcccttcctaacaagtagcccaccctgcttgcgctgcttgaaaggcgccctgcctggtggcttaaattgcgccccccgggtgggttgcccccatcgggccggttgctttggctagccccctaccgaccgcccctttcgttagcttcctttccttcctggcctggtgggtgggctttcccctcctggcacaaattagggggctgccctccgggggccctatttagggggtgacggcccggggcccc

SEQ ID NO: 57535 - DNA, 262 bp, Triticum aestivum
  unsure (1)..(262): unsure at all n locations
  Clone ID: PAT_TA_57535
cccgggcacgactccactgcgtcacggccatctcgcacgtccatgccgtccgccgtcgtccccgaagggacgcgggcagcccggccgggaggtcttatttccttcccttgcagccctccgtatccttccgggacgctcggctcctcccccctnccgccctccggctcgtctctctgggcatcacggctgcttccgcgnaccccgcgcgcggcgcccccgctgcgcatgnggagccgcacggaggacgcggagcctncccctc

SEQ ID NO: 57536 - DNA, 456 bp, Triticum aestivum
  Clone ID: PAT_TA_57536
gacatgcggagggatgtccaggagattttcaagatgacacctcatgataagcaggtcatgatgttttcggcaactctcagcaaggagatccgtcccatttgcaagaaatttatgcaagatgtaatgcccctgcctaatgtcttatctcaattgcacagtgcatcatatttaagtcgtgtcctccactggttatcagttatcaataggtttgtccttgttttttgtaatcttacatgtatagagttctctcgtcaagtcgtgtttttcttctgttttccattactaccttgcatagggcaataccgtggaagccatttatgagtctttcaagtggtttgggtatctgtcagtagctgtggtcagtttctgttgggaaccagtctggaggttaactatctggactcttagtttgctgcacttattcacgcacatatggagttagctggtggatgtgga

SEQ ID NO: 57537 - DNA, 428 bp, Triticum aestivum
  Clone ID: PAT_TA_57537
cccacgttcgccaatgacgccccagatgcggggagcggcatcgctgcatccgttctttccattctccatcgctgccacgaccagtgagatccgcacgaggagggagatgcatcagggaggtttcacgctgctcaccggcgaagccctccgacgagcggccagacgagcggcagacccaggcgaggtggatttcgtcggtgaggccctgttcccttcctcctcttctgcgcgatggcgaggtggatttcgtcagtgaggtcctgttcccttcctcctcttctgcgtgatctggcccagtggtacggaacctccctgatttggctttctttttgcactccactattctccggcatgtcgtcgttcgtcctttggttccgtgacctctgcaccgaggggagactctggtcttcctacctataaacgttttg

SEQ ID NO: 57538 - DNA, 499 bp, Triticum aestivum
  unsure (1)..(499): unsure at all n locations
  Clone ID: PAT_TA_57538
ggaatacctaactgtactgatgagtatgatactagtagtacacaaaaaatggaaccaatattactcccttcgatccatattactccaaatcataatctaacactaaaacgtgtctgtatctagataaatctaagacaagtaatatggatcggagggagaatacttttgttacatttagtatttgcaattaattacgactgattcattattgttttgctcaattggttgtggtacaggtgaacaaagtccgtttggatgaagacttggagcaaacatgggaagtccttgcagagccaatacagactgtgatgcgaaggtatgggatccccgaaccctatgagaaactgaaggaaatgactatgaggccaggctgtgaccaaagacagcatacgcaagttcattgaaggtcttgacctgccggaggatgcgcagncaagtcttttgaagttaacaccacactcttacactggagaggcggagaatctggctgcaaatattt

SEQ ID NO: 57539 - DNA, 303 bp, Triticum aestivum
  Clone ID: PAT_TA_57539
aagacgctagatgaacaacttgaagaacaggcggatagcatgaatcatgcttatattcccgaggatgcgaagaaatagatcttctatagtgtgatctaagaaagtgaaggtgctcgtggtttatcaatgtaaggacagagaattccctggatagtgcccaataaatatggtggcttcaaatatgcctttacagcacttggctgctctttgaatcacggctgaatggatagaacgttcaatgaatatgtatcatgtctcagatgcgagtgagacgcaccctgtagatgtgcatttaaagggtgg

SEQ ID NO: 57540 - DNA, 435 bp, Triticum aestivum
  Clone ID: PAT_TA_57540
cccgggctacgactccactgcgctccgaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaagaacccaattttactaccccgggctggaaaggtaatattttttttttggggcccccaaatttaatttacggggccgggttttaaaaacggggggatgggaaaaccccgggggtccccaaattaattccctttgaaaaaaatccccttttccccagtgggggtattagaaaaaagcccccccccgatcccccttccaaaaattggcccaccctaatggggaaagggaaccccccctgtaggggccctttaaccccggggg

SEQ ID NO: 57541 - DNA, 622 bp, Triticum aestivum
  Clone ID: PAT_TA_57541
gtttgaatcctttcatttttcacttctctaatgggtggctgatggcctgatgctttgatggatcgatgcatgctagaactgtctgatatgtgcgtgcgtgtgcacattttttattttgatttttgtagagattggttcatgcttctcttcttatggatttcttctttcttttgtctgtgtttgtcactctgttgctgaatgatttggtgatttttttctttgtgggcttatctgatgaaatttactgctaattagatcgtgcactgacgttgccaccagaagatagatcatagatgcatgtgtttgctttcgaacatggtgcgtaatctttatgtttgccaaacgtcacctccggcaatttcagctcaacatgtccttggtgtctgcagatgatttgagagatttcttcttttctttgtgggcttatctgatgaaatttactgctaattagatcgtgcactgacgctgccaccagaagatagatcatagatgcatgtgtttgctttcaaacatggtgcgtaatccttaagtttgccaaatgtcatctccggcaatttcagctcaacatgtccttggcttctgcattctgagttttagagttctacatagtgggaatggttag

SEQ ID NO: 57542 - DNA, 145 bp, Triticum aestivum
  Clone ID: PAT_TA_57542
cccacgcgtccggtggtttccttttcgtgtttggttataagtcaggtctgtgtgctctggtttggccgatgcaagatgtgatattcggagtgttactgattaataattgtgtggtcacagactcacagctgatggccaattggtt

SEQ ID NO: 57543 - DNA, 568 bp, Triticum aestivum
  unsure (1)..(568): unsure at all n locations
  Clone ID: PAT_TA_57543
tgattgaatcatctctgaagtgtgaattgcaactgaccctatgttatgcctcttgattattaatccagtataatatgctactgttaaacccttgggcttataaaaccccaaaaggtagtgattgaatgatctatgaactgcaattgccagtgccatgtttcttgactgttgatgatcataatatggttctgttaggtttatagaacttgagaaagtattagttgaatgatctgtaaattgcaattgtccttttctttggttcacataaagattctaaaggctcatttacaactgtatttaatagttggtgggattatgtattctgaaatattgttgaaaatcatcattcatctactactggccacttataatgaggaacatggtgtaaaaggtctgtggtgaactgtctaagatttatttgtgacgagatgttgctttccttgtcttactgagtgccacttattgcttaacgataataactcttaatttgggtttgagctgttgtttcccctatggttgcttcncttttgttttggaagtgccgaccgctcactggggatgaattttt

SEQ ID NO: 57544 - DNA, 192 bp, Triticum aestivum
  Clone ID: PAT_TA_57544
tagtcatgtcgtgcacaatctctgccgctccaagcatttttgttgtgatcttctggagctgtgtttgtaccacgttgttttcgttagtctggctagatgctgtaattttgcatcatgaagcttacaggttgtgcagaacagatgcactactagaatattcatcatttgcggtaagatatttgcatgtgagtc

SEQ ID NO: 57545 - DNA, 638 bp, Triticum aestivum
  unsure (1)..(638): unsure at all n locations
  Clone ID: PAT_TA_57545
gttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgttttaaagaacccaagtttacttccccggcctggcaacgaaaaattttttttttggggcccccaaatttaatttcaggggccggggtttaaaaacggggggatgggaaaaccccgggggttcccaaattaattcgcttggaaaaaaatccccttttcccaagtggggttaataccaaaaaggccccccccgatcccccttccaaaaagtggcccaccctgaaggggaaagggaaccccccctgaaggggccctttaaccccgggggggggggggtttccccccagggggcccgttacctttgccggccccttaacccccgcccttttggtttttttcctttcctttttggccaggttcgcgggtttcccccggaaagctttaaatggggggctccttttggggtcccaattaagggcttaacggcccctnccccccaaaaacctggttgagggggagggcccacgaaggggcctctccccctaaaaaacggtttttcc

SEQ ID NO: 57546 - DNA, 737 bp, Triticum aestivum
  unsure (1)..(737): unsure at all n locations
  Clone ID: PAT_TA_57546
ctggaataagccttgaacaataaataacttggcaacggataccctgtggtctacaattatactgtaattatgtgtgcactttggatctattggatgtctgaatgtattgttaatcgacaactactgatgcaaaggtatgttctatttgtaatatgaaatgattcttatttgtacctccagcagtccttctcacattttctatttgtaatatgaaatgattcttatttgtacctccagcactcttctatcgctccttttagaactaatgacataaaaaatgtggtctggagtctggtcgtgtttgaacaaagttggtcagaatgatactagttgttttcttcaagttcattatattattttttccagtatatagattatttatttgttcacacaatacatggcaggagatatgtgttgagaggcacatgaatacgcacgtgggctgtttttcagcatggtagtctaaaaaactgtggtattctcagaaaatgctttgctatcaaacagggcaagtgcagatttccttgaatatagtttattttacaattgtgttgccaacgcgcttcctgttttatcaccataaaatagttctaggtgctcatataaaatttagtggcgtgtatggggtgattgtantgccaanttttggtggatctgcttgcattttcagcattatagnggctgatatactatctcaataaaacagtgaatacgtattatatgtacaagctccttca

SEQ ID NO: 57547 - DNA, 696 bp, Triticum aestivum
  Clone ID: PAT_TA_57547
atggagaagaccatactctcgcccttgccacgggccataagaggtttagcgcgtctctatctaagcttgttgagaactatgcagagctgttggccagtcaaggccttcttaaaactgcaatggagtacttgaagcttatgggagcagatgaaaattcagatgagctgactatactgagagatcgaattgcattttctacagaagagaatgatgctaccaggagttctgttccagagagtagtgccaacagctcctcctacctaccaaatcaacagagctacaccccagacccttcccagaatctttaccaggtgcctcaacaatataataatgtgcaaagctatccagaagtttacccgcaaccacctaatagtagagccaatgtgccaagcaatacatatccagaagtttacccgcaatcacacaatgcagcctactcgggatatgctggatatcaacctcaacatcaaacacaaatgtttgttcctcaaaacacaccagtggacacccaggtattttgttttgtgggaacctttattttaggtcaagtatcttgtgctacaattagtgacttgaattgtacattgccatgctgctgtccattctggcctagtatggaatatctaaataaatgtaaaattacgatgtggtgatttctgaacagataagtgatcctccatttactttttttgggtt

SEQ ID NO: 57548 - DNA, 223 bp, Triticum aestivum
  Clone ID: PAT_TA_57548
taaataatagggtcttttataggggtacctgaattttatttgtcctggccggggttttcaacggcccggctgttaaaaccctggggcttcccaaattaatggcctttcccaacttttcccttttgccggatggggccatttcggaaaggcccgcaccagatgggcttcccaaccagggcgcattctgaaaggcgtatggaacccgacctggtacggggactta

SEQ ID NO: 57549 - DNA, 493 bp, Triticum aestivum
  Clone ID: PAT_TA_57549
cggacgcgtgggcggacgcgtgggctgatgttgatcttatgaagatctcattctcacgtcgacatgattatgaagacattgatattgaaacggggggcagtggcagcgatgagatggaagggacagccttcgtttctagacatacagcgaatacagatggacaggttccggcagttaagagaagtggtatgacactagagccggggccgaagactctactatgacactagagtgagggccgaagaactgcgaaattgcatatctcattgttagacgtaacaacaagtgtgtcagctttaaaacacgcactgccatctcgtagagaagctctcagtagtcagtgtgtgatcagatagatgccgatgatagtttatgtggatagctaagctgatgagctgattaattcagaccaaatctggagaggcatgaacaatgcctttcatgcttcttgaactggactgcttccatcagtgatttccaccatttttgtgtc

SEQ ID NO: 57550 - DNA, 206 bp, Triticum aestivum
  Clone ID: PAT_TA_57550
gggccgggatttccgggctcgaccctcgcgtgcgagcatacctctgggtgtgggctacatgtggtccgattagattagcgtccatctaggcttcctgctcctgtaacgcgagaccagccatcggcggagtggatccagaccgagaaggcccgccagatgttagacagacgcggtgaccacaccggcgaggcctgatgtgggctggt

SEQ ID NO: 57551 - DNA, 135 bp, Triticum aestivum
  Clone ID: PAT_TA_57551
gtaacctatgatgagaagacctcgtatccctatgaaagagatggagatgctgtataataaagatatgagtgcaatggcgagggccattatgaccagagtggcagatcgtgaagagcggggggtaaccccacacac

SEQ ID NO: 57552 - DNA, 679 bp, Triticum aestivum
  unsure (1)..(679): unsure at all n locations
  Clone ID: PAT_TA_57552
gatttcagagccccatcagttcagtgatctctctcccgatggaagaaggagatccgtccaaagtgtgagttttgcgacgcacgtgcaagttctacaatttatccgtccagatgggagaaggagatcagtccaaccgacgcatctgaagcgacatatgcagagccatttgcccgaggaaccaccgctgtcggtacttgcttcctgcgccccgccgctgcccggggacccaacgcgctgccgctcctctgattctgctccccggctgttgggctgtatatgtgtgaatttggcccatgtggcccatgtaaaccagtatatgtattgtacagactagagaggaagagagttatccagaaatttcccttcccccgcaacacccttctccctccggcgacgccggccagcccgccccggtgaatccagggctagcaccctccccgagctactccaggcgcagatcctgccacgagtgctcccagcgcacggatctggccgggcttcggcgagcatagcctgctacaacctggactccggcgctactcctctccttgcaccccgatccnaccggtgttaccccaggcatgggagccatcccagggccgaaagaggctcgagcttcctgcatttctagtagataagcttgtccggcacattcagccaggtaagcacatccagtcgc

SEQ ID NO: 57553 - DNA, 465 bp, Triticum aestivum
  Clone ID: PAT_TA_57553
cggacgctagggcggacgcgtgggaaaaaaaaaaaaaaaaaaaaaaaaaaaaaaaaaaaaaaaaaaaaaaaaaaaaaaaaaaaaaaaaaaaaaaaaaaataaaaaaaaaaagggttctgtcgctttaaaggtccccgttttgcttccccttgcttgcaacttttttctttttttttgccgtctctttactggggttggccggcctttttttttcacctgcctatctggaaaacccctgtgttccccccccttttcccctttggcgctcttccccttttgcccatttggcgtgttctttaaaaccccctccccttccgcatttccaaagggttcggccctttaaatgcgcattgtgcccccccttttttcgggtttttcggagggggggccgtggcctttccccccccctttccccctttcttttccagggttttccccccgtgccttttatctttgttccctttt

SEQ ID NO: 57554 - DNA, 675 bp, Triticum aestivum
  unsure (1)..(675): unsure at all n locations
  Clone ID: PAT_TA_57554
cactggagttcttctgacaactttgattcatttaggacttcgaggtcactagctatgttatttgtactcgtgattactatatcagtaaaccgtgtgtctttatatatgtctattacatcaagtacatactcagtacatctctgtaatgttgatccaggcctgaccatcattccgttaaatgagcgaaagaagtctgttttgggagaaattaaccatcttgtagttgattggtgcttgaaagctcgactatattgtcctcaccattaatgggtttatttgtattatgtaactattattttaaataaaaatgatgctgtatcaccaaacttttgttgacaaacttaccattttggccatgttgatggacagtggcagaggatggtatgaaattttggtagggtgaaatcatgattgtagttntatacatactaataagagtatttgatgttagatttatgacaacaaatccgtgtagaagcatattgaaatgaaattagcacatgcaaaaatgcctcaccaagcttgtactacattnttgacatttcatcgattttttactatatgaaagcttcattgctgtttaagcgtanaggaatatcagcaaagcctagcctgattaactctcatgtgccttaaacatgtanagccccagctgctcaggccctgacacttcgc

SEQ ID NO: 57555 - DNA, 192 bp, Triticum aestivum
  Clone ID: PAT_TA_57555
gttctagatcgcgagcgccggcctttttttttttttctcacgtaagccacgccagagctctaccttagtgttacctaaaagagacacctggccgaccttctttccgtcgctggtgggtaaaacccactgggtaaacacctgagtcgccttgcttaatatccctctttggcatgctcccgtaaccggggggag

SEQ ID NO: 57556 - DNA, 481 bp, Triticum aestivum
  unsure (1)..(481): unsure at all n locations
  Clone ID: PAT_TA_57556
ctgtcgactactcgccaaatgctaccaatcgtccgaacaacaacgcgcctgcctctggcctgtctaagccaatcgtaggacgtctcaaagcacaacaaacatacgctgccacacaccacaaacactgaactctaggatgacaaacaggctttgcacagccaccgaacaacggtgacactccagaagggacacaagatatatcactatttgcgacgattacggaactaatacttcatgaacgtgtaacagagcatacagctagaagccgcatactatctacagatgantaaatgtcaagtgtcgacgcatcacatacattggatgatatgctctgtgaatattatacaaccttctgttatcactgaatctgaatcatcgagcacagtgcaaggatggaagcaaagacgatgaatatgatgataagcctagtgtgcctgcaatagtatcattatttgacaaaaaagatacagcccagaaaaac

SEQ ID NO: 57557 - DNA, 735 bp, Triticum aestivum
  unsure (1)..(735): unsure at all n locations
  Clone ID: PAT_TA_57557
gtttctccttcttcttaccacctccgaccgaatcagctgcgtccactcccacaaccagagctctagcttcgttcgccgcgtcgtcgccaagagcaccgcccgctcgccgagggaccagagccatggcgtcgcagaagttcccgccgcagcagcaggactgccagcccggcaaggagcacgccatggacccccgccccgagaccctcatcaagaactacaagtcggccaacaagctccagggcaaggtggcgctggtgaccggcggcgactcgggcatcgggcgcgcggtgtgcctgtgcttcgcgctggagggcgcgacggtgaacttcacgtacgtgaaggggcacgaggacaaggacgcggaggagaccctgcaggcgctccgcgacatcaagtcccgcaccggcgccggcgagcccaaggcgctggcgggcgacctcgggtacgaggagaactgccgcagggtggtggaggaaggtggcgagcgcgcacgccggccgcgtggacatcctggtgaacaacgcggcggagcagtacgtccggccctgcatcaccgagatcagcgagcaggacctgggagcgcgtgttccgcaccaacatcttctcctacttcctatggccagnntcgcgggngaagcacatggngcccgggntccagcatcatcaacaccacctccgtgaacgcgtacaggggcaacgcgacgctgctggactacacggncaccaagggcgcca

SEQ ID NO: 57558 - DNA, 606 bp, Triticum aestivum
  Clone ID: PAT_TA_57558
ccggagactttacaggctttttggcaaattgtgcagcacttgaggacctagagatgatcgagtgctccggtttaactaatttaatcataccacagcaacttgataaactccagcatttgctaattgatggaatggaagtggagatggtcgagttttatgctgcagatctttctcattttgagtacaaagggcaagtggtccccatagtgcatcatggttgctcaattaaagaaggcaacaataatgtttagtgggtaagaaaggactggccaaggcattcactgcagttccaagcattttgccagtgaagatattaaatgtgcgatctgttgctctatcaaaatattcacagttgcagaaactgccaacaagacctgacggaatgtttatgcatttgaggcacatgacttgtagaataattgtccattcaagaccacaagaagccaattacgaacattgaagttcttcaactggcctattgtttggatgctgcaccccagctggagacattgcaattgaatatgttctatgtgtcatccagtggtgtgtccagtgcagagggtggtgggcatgcgcccgcatgatcatctcaagacggtcttcatg

SEQ ID NO: 57559 - DNA, 529 bp, Triticum aestivum
  Clone ID: PAT_TA_57559
caaattgcaagattagttagctttcctccttattacattttctcttacattttcaatgctttgtctaccatgctttctcatgtccctggtgccttttttgtttgatatgaagtaaatttgcacactggatggggcgaccaggttgtggcaacttggcggcatggctaatgaataaagaaaatagcaataactgattgattttagatctcatgtgcctgcaaatcttctgttcttgccgtttatgtgctggatctgttgttgcattcgtcgatctgttgttggttcttaatttagtctggtaaagagtaagttgcactttgtcggtccatttgggttatggattttttttattatgatggcgagacacacctatggtgagattctatttcgatgatgatgtgcactcttcacacctcgctttgaattggcacgagaagatcgttctagattggaatccatataactttgagaaggtcaatgtctgttgtctttctctctctgactgcctcctcccattgacttggcatgc

SEQ ID NO: 57560 - DNA, 536 bp, Triticum aestivum
  unsure (1)..(536): unsure at all n locations
  Clone ID: PAT_TA_57560
ctcaccccaaccaagcctggcaccgggatgggcgttgctgtgaagaagcttattcaggaaagctatcagggccatagggaatggctggctgaagtgatttaccttggacaactatcgcacccgaatcttgtntagctcgttgggtactgtgttgaagacgaacagcggcttctcgtctacgagtgggtgcctcgtgggagtttggagaatcatctctttaggaggagtacacatttccagccgctctcctggaaccttcggctgaaaattgcccatggagcagctaaggggctcgcgtttctcctctgtgtcttggccctagtcatctaccgtgatttcaaancctcatttatcctcctatgatgctactacgacgcatagctctcagattttggcctggcgttggacggtccggccggtggcttgagccctgtgtcctcntgggtgatggggacatatgggtatgctgcaccagaataccttggctcagcttcggcgtggtcctcctggngatgctgtcggggccggccgcggtg

SEQ ID NO: 57561 - DNA, 443 bp, Triticum aestivum
  unsure (1)..(443): unsure at all n locations
  Clone ID: PAT_TA_57561
tggagggcttgctagatgtacgctgcagtgatgtatgggacaaatcatttcatgtaatttcattggcatttgacacgttaggaaaatcttcatctgatctattgccagaagcacttaagaacctggcagacatgcagaacatgtctgatgatgacttttctttccggaagcagctcaatgcatgtcttggttcagcaatttctgcaatggggccaaagaatgttcttgatattcttcatattcagtcaatatctgttgagaatgaatggattctccctattttataaaggcacattgttggtgctagtttacagtttttcttgagagatattctgggcatcgttagagctgttgagatgagtcttcccaagcttttgaaagacgatnagcttttctccgccntgagagcngagggctctgtgtnttcactttgggctttgctc

SEQ ID NO: 57562 - DNA, 382 bp, Triticum aestivum
  unsure (1)..(382): unsure at all n locations
  Clone ID: PAT_TA_57562
cggacgcgtggngaaaaaaaaaaaaaaaaaaaaaaaaaaaaaaaaaaaaaaaaaaaaaaaaaataaaaaataaaaaaaaaaaaaaaaaaaaaaaaaaaaaaaaaggggggccgtctttaaggttccgcgctttctttcccgggcctgggccgtcttttctctttctttgggggccccaaattccttttcgcgggccggggttttacctcggtgggcctgggaattcccggggggtccccattttaatggagtggcgaacaattcccctttccccagggggggttttcccgaatggggcccgcccaatcgccctttcccccctttgttccgcctggttggggattgggaccccccctgtggcggggcttttttcccggggggt

SEQ ID NO: 57563 - DNA, 392 bp, Triticum aestivum
  unsure (1)..(392): unsure at all n locations
  Clone ID: PAT_TA_57563
gtgcctgtcagcgtagttgttgttctgagaatttccatgataagcaagcagtgaatctgtcttggctgcagataaaaactgttgcagcggtatatggattcagaagtgacgagtgcccatgattatgttgcagtacatgcctttggaaaaccatggccagtgttgtttccaccggaccgggtcctctctccgctgttctgatctaatgtcgactgtgtgccgttggctttccatgcacaaggtcctaccggcggcattgggcaccacgtgggaagcggaaggaggagccgcatctctccatgcntgctcgggtcattgtcatcgcaagttccgtgcctcgcgttgctgctcgctgtcgcctgctctgntttcgcccgtcgtccgcccggtgc

SEQ ID NO: 57564 - DNA, 465 bp, Triticum aestivum
  unsure (1)..(465): unsure at all n locations
  Clone ID: PAT_TA_57564
gctggacttccgagagggcagacttacaggcgagcagcctcgctgctgaaaagacgcgcctactggtacaacagaggtccggtgacccttgtcaccgcctaccagtgcctccaccggctgaggctctagtggctgtgaccctggctaagcatgaccgcgctgctggatgacagccctgaagtccagatccacgtcgaccaggatctacgccgacgttgctgggagatggggctacttcgaaatggcgggtccggccgttttgaactccgggcgctctggccggagcgcgcgcgagcgcaagcgcgagggcggacgcgggcagggctcgatgatcaacgagcgcgagcctggacgagcgcggagcncgagcatcgacgagcgcggccaggagcagggcatggccgcggacgggcgcgggcacagtcggggggctgcaggatcgtgggggtccaggtcaaggagggg

SEQ ID NO: 57565 - DNA, 652 bp, Triticum aestivum
  Clone ID: PAT_TA_57565
aaacaccaacatttcatatatgttcattctaaagtaaaccttacacagatgttgtaaaactgtgtaaccttacatgcttaactctagtagatattctcgccaaaggagagaggtatatagatagcactctgattttctcgttacatataatgtgatactacaatgacatggatgacaaaggaacaaaagggcaaacaggaacttatttcttcttgcgagaaaagtggttgtcgttcggattccgtttcccgctgaacattgcgagcgccttccttctggaggtttagctccaccttttctcgccgtggcggaattgcctacgccaagaatctcccccacttgcttgactcttcatttagatgcagacctcggggaagttggtcttcacgtaaaatgggattcttaatgacggcatctcttccaccttggggcattggaagggaaaattttgtgcctcggagagtaacacgcgggcgccgtgaagccatagtgatcccattttcaccaactgttactgaaacctttcgcaaggtgccaccattgccacactttggacagaatatttttccaatctcttgtgtcaccttgtagcaagcatgacacctcagaacccacctgtgcaactgccgtatttgcatgccacctggtgcca

SEQ ID NO: 57566 - DNA, 605 bp, Triticum aestivum
  Clone ID: PAT_TA_57566
ctccggctctctcctaccactaacatcttcatcctatttgagccagaatagctttggtgccctctctcgctcatggtgaggccgtgcacgcttgccatggttgtggctacgaaatctcagactgagtcgcttcggtcgggcactattcaggtacaactcactttgctccaccattgttggttgctgtgcatcacatgcttgaggaaattcagagatggtgttgatcttgctcttgctagaccatccttgttgtaaatcgttattgggttctagctagggtcttaagaattgataatttctagattgtatcactgaaaatgcagctcttataagattctcattgtcaagttgttatggcagcctgagtgaaaatatgttccttttaaatgcttagattctatagaaacctctaatctatatcctaaattactgtattgtgcgctcttgtaaaataaactgtgtatattgattcaatttatatagtgtaggacaatgattttgctcacatcacaaatatctaacaacaagagtgggactgagttcacttgcgaccaagacatttaaattccagctcaacattgcatattcctatctaataaacggtc

SEQ ID NO: 57567 - DNA, 552 bp, Triticum aestivum
  Clone ID: PAT_TA_57567
gaggagcggctcacctgtttgactcgtgtggcggctcggtcgtcagatccaggggtcgacgtggaggagggcggattgcagcgaggcgtaaggctggagtggcggcaacggcgctggtcagggaggtgcagcgctggggcggcggcggcggcgcgaccgatctgcacgggggccgcgaccaagctgcacgtggtggggtggcacccgagtacctacgggtggcgcagatgatggtctcgccggagaccgccacgaggagagggctcgtcgtcgacttgatccagatcgaggacgaatggcggatccgggcgtggggaatgggtgatgccgggcaggggcggcgggagaccagcccgaggggcactaggaggtgcggccagctgcggcgccggcgggggaagaagccggatgaggtccgccctgactcgttggatgtcaccgtcggcgcacgatctatggaggagaggtccatgaggggctcaccggatctggggaggagagggccacggtgacctcgacgccccacggccgcagccatctgggaggccggat

SEQ ID NO: 57568 - DNA, 670 bp, Triticum aestivum
  unsure (1)..(670): unsure at all n locations
  Clone ID: PAT_TA_57568
agctcacctccttcgaggccggctgctccacctccacctccacccaatccccttcgcctcgcctccccgcccaccgccaccacccgtcgatggcggcggcggccaagcgaggcggcacaggctcccgcgggctgctcatggggcggtacgagctgggccgcgtcctgggcaagggcaccttcgccaaggtgtaccacgcgcggcacctgcagaccggcgagagcgtggccatcaaggtgctcgaccgggagaaggccgtgcggagcggcctcgtctcgcacatcaagcgcgagatcgccgtgctccgccgcgtgcgccaccccaacatcgtgcacnctcttcgaggtcatggccaccaagaccaagatctacttcgtcatggagctcgtccgcggcggcgagctcttctcccgcgtctccaagggccgcctcaaggaggacattgcgcgccgctacttccagcacctcatctccgccgtcggattctgccacacccgcggggtcttccaccgggacctcaagccggagaacctcctcgtcgacgaggcgggcaacctcaaggtctccgacttcggcctctccgccgtcgccgagccgttccagccagagggtctcctccacaccttctgcggcacgccggcctacgtcgcgccccgatgtcctcgcccgc

SEQ ID NO: 57569 - DNA, 572 bp, Triticum aestivum
  unsure (1)..(572): unsure at all n locations
  Clone ID: PAT_TA_57569
ttccttccctctgctctacgtctctctctccctcgcctctctcgcgccgccgtcgacatgaggagcgcaaagcgctgtcccgcctttgactaccaccctctcccacacgtcctcctccctgctcccattcctccctcgtgggaaccctagccgccgccctctcccactcgtcctcctccccgctccccttcctggtggcgctcccgaccgccgcgcgacgtcttctcctccccaccgtcgaactcaggccgccgcaccgtcccgcgtccccgtcgcacctccccttgagccgccgctccgctccgaatccccgtcgcaccttccctgctgcccgagcctgaacggcggtggatccctccattggggtggactacggcgctcgcatctcccgcgccggcgcttccccgtcgagctcgcgtgtcacgtcgtcaggggagggaagttggcgctgctcttctcggaggagtgcgtcgtcgcgccgtcgacgggaggaggccaagcggggcgacgggaggaggtcaagcanagcaccatcgccaccggttggcgcgtcgatgggaggaggcaaggcg

SEQ ID NO: 57570 - DNA, 655 bp, Triticum aestivum
  Clone ID: PAT_TA_57570
ggaaatgtttgaccagcttaatggacctttagtgttgatatgtgggcagaacatactcgaggcagcacccaaggataaagatccaaaggaactggtgtttcacaatctctctcgcctgtctccactgacatccttgaagaggctggtagggggactacaagggcggaagccttcaaagtccaatggcatagcgaaactcttcggaaataaattctatattccttttccaaaggatgatgagcaactgagagagttcaataaccagattgcggaggacaaaaaaataatcgtttcaaggcataaccttgtagaattgcacaaggtgcttgaagatcatgggctatcatgtgaaaatctgtcgcatgtgaagttagagggcattattctgacgaagcaaagagcggagaaggtcattggatgggctagaagtcactatttgtcgtcagcgattagtccttccataaagggtgacaagctagtcattccctgtgagagtctggacctatcactcgagaggctaagggagctggaggcttcaactaagtcactttctgaaacatgaagatgctggcaaaagatgaatttgagcgcaatttctatcagcagttgtacctccccatgaatttggagttaaaatttgaagatattggcgctc

SEQ ID NO: 57571 - DNA, 519 bp, Triticum aestivum
  Clone ID: PAT_TA_57571
ctcccgcactcccgcactcgcgcatcccagctcctcccctacgccgcctcctcccattccctaaccctagctgctgcccacgccgccgccgtctccgtcgcctatccggccaccgcgcacgctccctgccacgccgccgcctctgctcgccttcgcaaccccgcagcatctcctccccaccccctcggcactcagcaggaggagcgcgggcgcggctcgcgacggccctcacgagagaggtctctgctctcggtcaactctacccgcctccatcaccacccatcggcaggaggcccccgccactcctccttctgctccatcgcgtggccatcaccgaggcctgtccgcggtcttgaggctgcgatcccgtatggggcaggacgacaccacgccttggcggtgtgagatggctgcaaatgcagagcacttcccatctcataaggatcttgggtcccaactgcaggaaatgattccagagaaatagactgcgcaggcacgaggagaaagtagacagggaga

SEQ ID NO: 57572 - DNA, 313 bp, Triticum aestivum
  Clone ID: PAT_TA_57572
aaaaaaatataaaaaaaaaaaaaaaaaaaaaggaaaaaaaaaaaaaaaaaaaaaaaaaaaaaagggaaggaagatataaaggaatccaagcttaaaaacgcgaagcctgctatgtggtagccttttttttagggcgcccttttttcggtgtcctggccttctttttgcggcgccccgtttgtggtccccggggggggggcccaccttattggcctggcggcccttccccttttcgcccgttggcgtttttgcgacggggcccgttccgttcggctttcccatctttggctctccctgcttggcgtgtggttcc

SEQ ID NO: 57573 - DNA, 590 bp, Triticum aestivum
  unsure (1)..(590): unsure at all n locations
  Clone ID: PAT_TA_57573
gtcaagcctctcgagatccgagagcctcctccaacttgccctccccaccaaggatgacgtagtaaccgcacgcagaattacctacaacttgagtagatgcacattattcacttcatattccaatggttttacttccacatcacatatttgtttatattaaatcacaaaaaattcatgagcttgcttggttactgtggagaagggcattctttcaaggagctgtaggttttttgaatatgctccctattggacacttttttttggtatgtacaagatttgttgagaatgggtgtgagaaaattgaccatccggtggatttatacgcacggtatgtttagtttcaagataactgatggaactactttattccttgttgagtacttattttagaacattattccttttttgtactgattgaatgatctgctcacaccatgcaggtactcagacatggtgaaagcaaagaccgaaaggtttcgatttagatgatttgggaagtgccttggccatcttcttacctncaggtcaaaattaancagatgttttattgctaaaggatatgcctcttactatctgagatggttgatgat

SEQ ID NO: 57574 - DNA, 537 bp, Triticum aestivum
  Clone ID: PAT_TA_57574
gagcaaagtctgcgaggggggagagggaaccgcaaacaatcatctgtctatcactcccacatacataacccacacacaagatacagcagatcacttgtagagagagagggagagggagagaggccgaggaggagatcgacgcggcgggaggcggcgggagcggcgcgtgagatcggcggaggcggaggcggagtcggggccatggacgtcgacggccaccttccccgcagccagggcgacgtcgacgacgacggcagggagaggcggacaggaacggttgggaccggcggcggcgcacatcatatcggcggtgatcgggtccggcgtgctgtcgctggcctgggccatggcgcatctgggctgggtggccgggccgctcaccctggtgctcttcgccgtcatcaccttctacacctgcggcctcctcgccgactgctaccgcgtgggcgaccccgtcaccggcaagcgcaactacacctacacggaggccgtccggtcctacctatgcggatggtacgtctggctctgcggcttctg

SEQ ID NO: 57575 - DNA, 614 bp, Triticum aestivum
  Clone ID: PAT_TA_57575
atccatataggcccctacccctgccttgcttcatcctcgtgttctcttcccggcgcgcccttcccctgtctcctcttcgccggggttatcagcgacggcttttggggacgcacacggaagccgcggcggatcaagaaggagctcgcccccatgcggacggcggggcgccgacggcctgatgatgggcaggccgagtgtgaatgcgtccggtggccggctgtgggggttgtgactgcacttggccgtaggagatcaggtgtccaaccattaatttttcgtgaggagacgtacctaatttcaggactacatgtcagttattcaggtatataactatctaaagggagaggggcttggctgctggcctcccatcaggttatggccctccaccgtatccatcttattttgctactgattaacattttaaagttgcatcccactgcaatgtgttcatttctacaaaagtttgtggcaggagcataaaaggggataagatcacctcagagtgccctctaacacgaagatcccaacgtataggatggcctatccaaccaggaggaggtgggcgcatgatcagcaccggcgacatcatggtgaatgtgatgtgcttggcgtgg

SEQ ID NO: 57576 - DNA, 620 bp, Triticum aestivum
  Clone ID: PAT_TA_57576
attatttttgctaaatgaccccttctctggtccttattatttgcagcatctacagccggacctgaacccggatctggaccggagatccatccggacccggatctcttctcccgccggggccgaaccctcggaccagtccggctgcgagaggccaccggccaggctcccgagcggcggacgcgccgggccgccgctcatcggggccagcccctcccgccgcgccggctcgcgcatcggctcggaggcccctcggggctgccgccggtgcgggaggcgtccgcggccgtgcaggctgctggtgcccgtggtgcgctccggtcgagggcttggtcgggccggcgcgggatctgagctgccgtccatggatttctcgcagcttggctgcgtttcgctttggatccggtacggtcccccgatctctctctctctctctctctcagactctcacacgacacgcgcgcgtagagttcacaccagtaaatcctaaaccgaatcagccgggctctcggtgccgcctcagttccccagcgctgcttcggtgccgccagccaccggcattccatttcccttggcttggattcggctgtggcgtcggctggggaccgttcgatgatgtctga

SEQ ID NO: 57577 - DNA, 214 bp, Triticum aestivum
  Clone ID: PAT_TA_57577
gttctgactgccgagggagtaatcattacagttacatgtactgggccagccattgcttgcacatatcaagaaccggcaaatgcatttgcatgtaactgtaatgttctgactgccgagggagaatttaaattagtacagaaaaaagggggtttgcaccaatgagcagaaagcgggttaatgcagagatcaagtacgaacaaagaccccccccccc

SEQ ID NO: 57578 - DNA, 624 bp, Triticum aestivum
  Clone ID: PAT_TA_57578
tcccagggtacgactccacgcgtcccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttaaagagatccaacttttattacccgggggggggaaagtaaaatcttttttttggggcccctaaatttattttcgggggcggggtttttaaacggggggggggggaaaacccggggggtccccaattttatttccttggagaaaaaccccctttttcccgggggggaaataccaaaaagggcccccccaaaccccctttccaaaagggggccccccctaaagggaaatgggacccccccctttaggggccctttaaccgggggggggggggggttttcccccagggggcccgttttttttgccaggcccttaagccccggttttttggttttttccctttcttttttcgccagttggggggttttcccccgaaaagttttaaagggggggcccccttggggggcccaattaaggttttaaggggcccttccc

SEQ ID NO: 57579 - DNA, 440 bp, Triticum aestivum
  Clone ID: PAT_TA_57579
atcagaggaacaccgtgccgcgcgagtccgcaccaagaatgagtggacgaacgaagcgaccttaagtatccctggccagaacactgatagaccgcacaccttaatcacaaccggagcgaatactgcagcaacagcacactggagacttgcgccgaatcgtccggcgagattcgttgacagaataccggacctcgagaagctacagctacctgacgacgccacccattattatgagccaccatcagatgctgctccggcttcggagccccaagccgcccctgctgctgctgcaattcgtgaggcacaaccgcctttggacactggcccttgaggaggaacgtcttcgaacagtcgataatctatgcctaccctccatacgaagtacattctattgaaggatcacaggaccatgctgacaacataccggagcaaccttcctt

SEQ ID NO: 57580 - DNA, 371 bp, Triticum aestivum
  unsure (1)..(371): unsure at all n locations
  Clone ID: PAT_TA_57580
tccgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccggttttaaaaaaatccaagtttaacgaaccgcgggcatggcaacgtaaaagctttttttatagggcccccaaaattaaattaacgggccggggtttaaaaacgtgggaacgggaaaaacccgggggttaccaaattaaatcgctttgaaaaaaatccccttttccccagtgggggaaaaagcaaaaaggcccgaaccaatcgcctttccaaaaatttgcccaccctaaaggggaaagggaacccc

SEQ ID NO: 57581 - DNA, 100 bp, Triticum aestivum
  Clone ID: PAT_TA_57581
ttttactgtatttgcatacatcaacaagattaacaatcaactgtacacaattctgtaattcgcgacggcaattgcagtttggaaagcagcatatttcaag

SEQ ID NO: 57582 - DNA, 336 bp, Triticum aestivum
  unsure (1)..(336): unsure at all n locations
  Clone ID: PAT_TA_57582
agggagaccaaggggacggggggacacaggaagcancncgacagcaggggcgagggcaacgggaagccggacgccggacnagaaaacgggcccccaagcgacgaggcngcgagaagcccnggccaaccacnagncgacganngggaaagcccgaaaaggacggnccggggggggggggccanngnggancacnnacccagnanggcangaaacacaagagggcgcnngcaaacaagngcaacaanggcaccnccgaggccgaaacgagggaagcaagcancagcgcnngnggcgggcacggcncggccaagnggagcccacnggcnggagggcaca

SEQ ID NO: 57583 - DNA, 466 bp, Triticum aestivum
  unsure (1)..(466): unsure at all n locations
  Clone ID: PAT_TA_57583
gacccagcggccgggacttctgggagcccccgccggccgagggcggcgacgagncggccaagggcgcgcngggggggcgagggngcgccgactccgcgacaccacacgcacccagaccgcagagacgccaaccaacgcccgagcccacgcacgacccaancccgaggtgaagcagggggaaactcagnactccaagagccggctctatgngggaggngngaaggcatgggcaaataaaggtctagtaaggtgcatccagaagaaaatatgtagtagatattgataagagcatcgattcacaaaaatcacaccttcaacaagagttgctcttcggaatgatagctatatgcttatttggtccttcaagcaaattgatccactgtcaatctatgaaagtgagaagtcccagatctacatatgatagattggaggtcttgtcagcaaacaaggagacaaagagtcattg

SEQ ID NO: 57584 - DNA, 109 bp, Triticum aestivum
  Clone ID: PAT_TA_57584
gtcgatgttcgagaattgaatacgactagtatagggggagcgaccgctctacatgataacaagcttaccgacacccacatgcaacgccttggagtctattatagcgtta

SEQ ID NO: 57585 - DNA, 752 bp, Triticum aestivum
  Clone ID: PAT_TA_57585
cccacgcgttcgaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggcttcttccagtcatctcagcaaacccacaggcccagggctctgtccagcctcaacaact

SEQ ID NO: 57586 - DNA, 611 bp, Triticum aestivum
  Clone ID: PAT_TA_57586
ccacgcgtccgcccacgcgtccgggcggaggcagccgcgcccgagccggtgttcatctggggcgtgccgctggtgggcgacgacgagcgcacggacgcggtgctgctcaagttcctgcgcgcgcgggagttcaaggtgaaggaggcgatggcgatgctccggtccgccgtgctgtggcggaagcgcttcggcatcgagtcgctcctggaggcggacctggcgttcccggagctggagaaggtggtgttctaccgcggcgcggaccgggagggccacccggtgtgctacaacgtgtacggcgagttccaggacaaggaggtgtacgagaaggcgttcggcgacgaggagaagcgggagcggttcctcaagtggcgcatccagctgctggagcgcggcatcctgtcgcagctggacttcgcgcccagcggcatctgctccatggtgcaggtcaccgacctcaagaactcgccgcccatgctcggcaagcaccgcgccgtcacccgccaggccgtcgccctgctccaggacaactaccccgagttcatcgccaagaaagtgttcatcaacgtgccatggtgggtatctggctgccaacaaaatgatgagccctt

SEQ ID NO: 57587 - DNA, 484 bp, Triticum aestivum
  unsure (1)..(484): unsure at all n locations
  Clone ID: PAT_TA_57587
gaagcaaccggcggcacaanngcagnnagagnaccagngccacaagggcagccacaaaaaccagcacagcaacaaccacaaaagcaagggccagggggacaacaacaacaaangccagggcagcaacaaccaggggggggggggcanccanatttttagttnggaccagttgcatgacaacaaccaaataagcaggtgcaacccatttgggaggcggaacaaccaaatgcggaggcggaacaaccatatgggggaggcgcaaccatggggagcacaacaatgataaggaaaagggggaccacaggagggggaaggacgacaaccaaatggggagagggaagggggggggggggggaaagggcaggaacaagcagggagaggtggggggggacggggggagaaacgactggagggcatggcaggggggagagtggagggaaggacgaggggggggggggggggggggagcgggcaaggggagggg

SEQ ID NO: 57588 - DNA, 510 bp, Triticum aestivum
  unsure (1)..(510): unsure at all n locations
  Clone ID: PAT_TA_57588
cggacgcgtgggctgctcagggcttggactctttgcgggtggctggatagtaggttcgctggtagtcccagtgatccttccggcatttattttcccgcgtacttggtgtctggagctccttacttcgctggtcgcttatgtatttctattcttgggttgcactctcgtcaagtgaaatctgcgacacttgaaaccgttgttgtttctgcgagattttctgttgctgacgtcgcaactccctcagttcacccttttgacccgtgggtatagaagatgaccttttgacaaaccgaaacttggcccactgttgttcagatcccatgaggtggtgttgttatctctagtctaagcgagcttatattgattagtattgtattgtattgttttgtgggcagtttctgcaagctgctgctagttctagagtgcttgggcatgctaccgttgtaataactataataaacagttgcagatgtgcttaanaaaaaaaaaaannnannaaaaananncccc

SEQ ID NO: 57589 - DNA, 625 bp, Triticum aestivum
  Clone ID: PAT_TA_57589
caacaacaacaacaaccaattctaccacaacaaccatcattttcgcaacaacaacaacaactagttctaccgcaacaacaaataccatttgttcatccatctatcttgcagcagctgaacccatgcaaggtattcctccagcagcaatgcagccctgtggcaatgccacaaagtcttgctaggtcgcaaatgttgcagcagagtagttgccatgtgatgcaacaacaatgttgccagcagttgccgcaaatcccccagcaatcccgctatgaggcaatccgtgctatcatctactccatcgtcctgcaagaacaacaacaggttcggggttccatccaaactcagcagcagcaaccgcaacagttgggccaatgtgtttcccaaccccaacagcagtcacagcagcaactcgggcaacaacctcaacaacaacaattggcacagggtacctttttgcagccacaccagatagctcagcttgaggtgatgacttccattgcgctccgtaccctaccaatgatgtgccgtgtcaatgtgccgttgtatagaaccaccactagtgtgccattcggcgttggcactggagttggtgcctactgataaggaaaggtctctagtaatatat

SEQ ID NO: 57590 - DNA, 657 bp, Triticum aestivum
  unsure (1)..(657): unsure at all n locations
  Clone ID: PAT_TA_57590
gcaatggcggatgtcagatgctcatgcaaatcctccgcgtcaagggaaacagcaatggtggctgccagatgatcatcatagttcaaaggctatgcaccaagggagccagcagcaatgggtacagccagagcagcaacacccaacgtcggcaaacgtcgacgcatcccacttctcgaaccccggttacccagttgagcagcagtacaacagcagagtcttccaggaccagaggcgggcaccattgtcaggcggggcgtgctcagcggatcagcaccagcagcgctactacccccaaagcagacaggatacaccaggagggtccagcgagagataccctacgaccccaagcatgggcgcaggcagctatggccagtggcaccagactccgactcctcccccgcagcagcacgacggcaggacgtaccggtggggtttccaggatttcggcaggcaggcgcagatcaacaacctgcctccaatgcaggccgggaggagcgtgctgctgtcggngctgcacccaactggaagcccgcagacgacctctccgaccaccggctccgatggcagcgtcacaagcacgttcctggtccctcccagcagctaccaccagtgcccgccgccgccgccgcatgggatatgctgaagggcgatgttatc

SEQ ID NO: 57591 - DNA, 694 bp, Triticum aestivum
  Clone ID: PAT_TA_57591
ggccggggcgcgcggcaaggtctgggctgttggcgcgcggaatgtgggcaaatcgacgctgctgaatgccattgctcggtgctctggggcagagagcgggcaaaccttgacagaggcgcctgttccgggaacaaccctcggggtgatccgggtggatggcgttcttggtgctcaggccaagctgtttgatactccgggcctgcttcatggacaccagctgacgtccagacttacacccgaggagcagaagcttgttcaagtgaggaaggagatgcgacccagaacatacagaataaaggcagggcagtccatacatataggagggctagtgcgcctggatgtggaagacttgactgtaggatcaatctatgttacagtttgggcatcaccacttgtgccacttcacatggggaagaccgaaaatgcagagtctatgatgaaagatcactttggcttacaactgcagccccctataggccagaaacgagtgaaagagcttgggaaatgggtgaggaaacaattcaaagtttctggaaatagttgggatgcaaatactatggatatagccatttcaagtcttggctggtacggaattgggctgaaaggagaggcagtattagggttatggacatatgatggtgttgatgttgtcccccaggagctcccttgtccatgagagggcatcgatttttga

SEQ ID NO: 57592 - DNA, 374 bp, Triticum aestivum
  unsure (1)..(374): unsure at all n locations
  Clone ID: PAT_TA_57592
catacccttgggnttttcatttgaagttagttaacattttgcgttactgtaatttggtatcaaccaccctgtgcgtgtgtgtgtgtgtgcgtgcgagtgtcaagcaatgcagcagcttgattgtacttgaggagatgggggagacgagctgttcttcattgtacctctgtagctattgttgtatctaanaaaaaaaaaaanaaaaaaacacacaaaaaaaaaaaaaaaaaaaaaagggagggggggtctcgatgttccaggcccacgttcgcgtgcgtgcgactgcaaagctcttcttttgggttaccgtaacccaatttaatggcacgggccttacatcgacaagggctgggaaagccctggccgctgcccaa

SEQ ID NO: 57593 - DNA, 532 bp, Triticum aestivum
  Clone ID: PAT_TA_57593
gacgacgtgtatgtttttaattaccgaggggcaccatgacacatgactgctgcaaagggccagcatcgagccatgaaaattctgctgtagcatggtgctgatcccaacagagtcaccaatcatatcttctgaccactaatgatggcatgctgtgggaactccttgaactgcatgaaactactgactgaggctggtgctgaagtgaatggtaatatgtaactctggaccaactcctttaacggcggcagctgatgatggctcatctgaattcacacaagctcttgctggagggttgaggctaccctcacattcctaaacaacacggaggtattgctatcaagagaggagaacaccgggggccacgggtacttgatgagcttgtgtttactaacacaaacgccattccctctgttcctgattggactgttgattggatcattacaaacatgatatctgcacataccattggttatgatagaacttctgcggaatgacgcgaagctgatttgaagtcacaaaggaaggaagcatt

SEQ ID NO: 57594 - DNA, 576 bp, Triticum aestivum
  Clone ID: PAT_TA_57594
cggacgcttgggcggcgggctcatcgaggggatcgccgactacgtgcggctcaaggccgggttcgcgccggggcactgggtgaagccggggcagggcgaccggtgggatcaggggtacgacgtcacggcgaggttccttgactactgcgactcgctcaagcccgggttcgtcgcgcagctcaacgccgagatgaagagtgggtacaccgacgacttcttcgcgcggattctcgggaagaacgtgcagcagctgtggaaggactacaaagccaagtttagaggctgaacgcaccataagttgatgggtccttcacggtgtgatggcataacgcactacttcgaataagacatgtgtgatggcataacacaccatatactgaaatgatcaacagaacatgtcccttacgctctgtagtgaaagataaataaacgatttcactaattcgaaatcgactttgagttacatgctactagtagtcttaagttggcgatacgtgagtgcgtttgtgtggtggtgtgagtgtgtgcgtgttgtaatcggttttctagaaaaaacaaaaagttgtttggacttgg

SEQ ID NO: 57595 - DNA, 462 bp, Triticum aestivum
  Clone ID: PAT_TA_57595
cccacgcgttgggctcttagtgtgtggaggggtggcccggcggacaggaaagcgccctcatcgttgtggtgagacacatctaacatgataggacatccggggattccgaccaggccgattcgtcattacgctgccggttgccagcgattccaacagatacaggtggtcaatagggaaaagagagctatgcgagacggctacggacattagttgcaaacctgatgcgccttaccatggaaaccttactaagacttgcggtattgcgcgctattactatgacatcagcctcagctactagacgcgaaggaatggaagaccattataggtctggtgacgatgttcgatactactcctccgggctacttggttacaagtttgcactagaccattgtgtactatatgatggtggaaatcgcttgtggtctctttgtgtaccctaaattaaattaactggccgccgtt

SEQ ID NO: 57596 - DNA, 307 bp, Triticum aestivum
  Clone ID: PAT_TA_57596
ccgccctggtgtgcctttcggagatggctccggagtcgtttcctactaatgagggaaggtcgatagtgtgtctctgctggctacgcggtgcttgggtcgatggactatgaccatgcaggccgtgacagactctagtgtctcacaggtgactcggtgtgaccactcccatactactgtgttcaagatcctgaatgaagaccagagaaaggctcatccacaccaggcttcatgctcaggccctcaccctggctggcttggcgttctataggactcaaggattcgtatgaccagcatgcaacgctcatag

SEQ ID NO: 57597 - DNA, 514 bp, Triticum aestivum
  Clone ID: PAT_TA_57597
gtggatgggcttactatttattaaagggcgagcaggagggcgagaggccaatccgggtagcggcaggcgccccccccccacaacccagggaaaaccccagcaccaaaaaaaaaaaaacggcaacacaggggggagaggggaagcccaattccgggggccggccacccgaaagccaaggtacagggcccccaaagggaaacccaaggcccggcaaatggcacccgggccaaagggaaaacccgggcaaaacccaacctaatccccgggaaaaaccttccccttcccccccccgggggacaagcgaaaaaacccccaacaagcccccctgccaaaacggccccaacccgaacgggaaccggaacccccccggggccggccccaaaaccccagaagaaccgcgcgggtacccggagcttaacccccacacttcccagggccccaaccccccccccatgcccctttttccccccctttacgcccacgtttttcgggttttcccccttaatccccaaaa

SEQ ID NO: 57598 - DNA, 552 bp, Triticum aestivum
  Clone ID: PAT_TA_57598
acaatccaccattctttgcaacaaacatacaacgcaatgtctacacgcaccacccaccattttcgcagcaacaacaacaactagaatctaccgcatcaacaaataccatatgctcatccagtctatcttgcagcagctaaacccatgcaaggtattcctccagcagcaatgcagccctgtggcaatgccgcagaagtcttgctaggacgcaaatgttgaagcacagcacctgccatgtgatgcaacaacaatgtagtcagcagttgccgaacatgccccagcaatcccgctatgaggcaatacgtgctatcatctactgcatcatcctgcaagaacaacaacagggtcagggttacatccaaactcctcaatagcaaccccaacagttgggccaatgcgtttgccaaccgcaacagcagttacaacaactactggggctacaacctcaacaacaacaattggcacaaggtaccctttttgcatccacaccagatagctcagcttgaggtgatgacttccattgcgctccgtaccctgccaacgatgtgccgc

SEQ ID NO: 57599 - DNA, 572 bp, Triticum aestivum
  Clone ID: PAT_TA_57599
cagacatgaaaaaggatgtagcggagttcgacatggtatttactgagtcaattacttgctgctagttgctgttaatatcctgcttagttcactgctaccattttgtttctttacctttatattctggtgtttttttaaccacttttttcttatattgatcattatcgagaccaggaaatggttgtagtgctgaagatcgaattgcactgtgaagattgcagtgaggagatgaagaagaggatactcaagataaaaggagtggaggaggccgtgccgcacatcaaatcatcacagctgatggtgaaagggatggtcgagccagcaaccctagtaggattcatccacaagtgcacggggaggaaggctgccattatcagagctgagccactgaatgaggatacgccagcagcagccatggctgaggagacgcctgcagcggatgccaatgccgagaagcaagaaccatctgataatctggaaaacaaagatgaactaggggtagaagaagagaccaaacaagccgtgaacagggaagaagagactgaaacggagaagccaagcaaaggggacgt

SEQ ID NO: 57600 - DNA, 276 bp, Triticum aestivum
  unsure (1)..(276): unsure at all n locations
  Clone ID: PAT_TA_57600
gcaaaactcagngcnnnagnnncagcaggggcgccagggcagnggccgagncggccgangaaggcaagggngaccgacaggacangancaaggagngcggccagnanacgaanaggccagcagagccaaagcnagacccancgaaggcgngnngngcngngnggcagaaggcgaacancccagggggggggggcggncncaccaaggagaaagaaaagaaanggngnanggagaagggcggcnangnngccaannncngcaagaaaccanncccac

SEQ ID NO: 57601 - DNA, 651 bp, Triticum aestivum
  unsure (1)..(651): unsure at all n locations
  Clone ID: PAT_TA_57601
gtgtggttctgtctacatgcattgcgacaacaatgtcctcgtgatcctacgcccctcgaaggggacttatgatatggtccaacttcccggggaacccagcagtgcaagaagcgggttgtcgctgccccaaaaatcggtcatagcaagctatgagagaggggtacattatgtggcgactaatatttcgcagcttcgagtttggatgcttaccgaattgaccgatgggcagctaggttggacactgtcgcacgacaccaatctcaatctgcatggcgatatgattcgcactcttaaaatacaactgaagttgacatggaggattgttggaagcagaggtggaccagtcagtttgaccgacgaagatgctgaggatgactgggccatatcatatgactctgaacattcctggaactcggatgaggacaacttcatcaacatggttggaggcgccaaccacgaccagtcggtagaacggggtgcctactgcagtatcatgggattccatccgcataacaatgcactcgtcctcattcttaacagcgcggtggtagtgtaccatctcgacacgtcgaggatgcagtatctaggagacacggatgagcttgataaagaccatacgctagcaacttggntgtgtcgatgatttcgttc

SEQ ID NO: 57602 - DNA, 449 bp, Triticum aestivum
  unsure (1)..(449): unsure at all n locations
  Clone ID: PAT_TA_57602
ctcaacgtatttaaggtcctactgaaccagattgagaagtggaacaagcagagggagaaggagacgtttgcaaggtccctcgaaatcgtctgtttgagagtctcctcggttgcttttgtgtctgcgctactgctgacttgtagttggaatttatgctcctgtcatgtactctcttccaacaatcgttgcggagcatcaagtgatgcttttctctatgttgcataaatagatcagcatgcttatgtattctcagcatgcttgaatgtacgcatgtcttgcctgggacttgtgaatgccgagaacctatgagacatttttggttctaagtcatgctgatgtgagagaatatgctgctgttatgtgtatgtgatgatatattgattccaagtcaatagaattatgttgttcatgtganananannnnnnnnnnnnnnnnnnnnnanaaaaag

SEQ ID NO: 57603 - DNA, 451 bp, Triticum aestivum
  Clone ID: PAT_TA_57603
aaaaaaaaaaaaaaaaaaaaaaaaagggaaggacgatataaaagaaaacaaaataaaaaaaaaaaaaaatgcaaaaaaaataaatataatataaaaaaaaactaaaaaaaaggggctggcctttgatgtaccacgtcttgactgcggaaaaccctgcgttacccatcttaattgggtggcaccaaattcgggtttcgggacctggctttttaaacgaagaggccgggaaaaatcgtgctttcccccagtttaacagcctggatggccattggcactcgccctgttggcggaaatcaaaaggggcccggtgcggtggttccttcccaacgtgtccgctacccttgccggggacgtgaaccccccttgtttcggtttcttaccttcctttgtggggggggtctccggctttgcccctcaatctctttatcgggggctacctccaggggtttga

SEQ ID NO: 57604 - DNA, 338 bp, Triticum aestivum
  unsure (1)..(338): unsure at all n locations
  Clone ID: PAT_TA_57604
gtcgatgtattgtcgatgcagcggtgacaaataaagtgtcacacaacgtcgtgtgtgacccgcccaaactagttgtttaaattctgaaataaaatacaaataaagttgtatcanaaaaaaaaaaaaaaaaaaaaaaaaagaaaaaaaaaaataaaaaaaaaaatattaaaatacaaataaaaaaaagtggggtggggggggaataagggggccctttttaaaaaatcaaagtttaagtattgcaggcttgcggacggccgaaacttttttttggtgccccccaaattaaattcgttggccgtgtttttaaaacccgnctgactggaaaaacccttggg

SEQ ID NO: 57605 - DNA, 505 bp, Triticum aestivum
  Clone ID: PAT_TA_57605
ggagaagagaagggcgcgaaccagggagcggaggcgcggtgcgcgaaccagcggagaaggcggcacacctcgtcctcaacctgccggcgacatccgactgcagctcttgctgcaagcggagatacatgtgttgaaaagtaaggtgacagagcaaaaagtaagatgatgacatcacacagagtagctcacattggatgattgtggcacacaccaacagcttcattcaaaaatatctatgtggatggctgggtgctgtctccattctacatgccctcattaccaccaataattcgggtggcattgcttcagttcttcagacgccgagtggcttcttattatatcaacaggcaaaggataagttatcgggatgaatgaagtctatgaggcgtgaaaagtgacgtctttggtactaccaacaaagcatcgatctatccaatgtatgctgccgcccaaaggcccaacaaggatagagaaaagaaagggtgatgcacgctcggattatgac

SEQ ID NO: 57606 - DNA, 151 bp, Triticum aestivum
  Clone ID: PAT_TA_57606
ttgcctgtgccgtgaactgaaataacagtggacgtttggtctttttcttgtggctgtatatcgacttctgtattttggtgggatggctgtacattgattgacttttgactgtaaacatgcgggaagaaaagttgagttgtatgtttgtatt

SEQ ID NO: 57607 - DNA, 485 bp, Triticum aestivum
  Clone ID: PAT_TA_57607
caggtttatgggttaggtccagactcatcagcagcagccccaacagcagcaccaatgtgaaggcgaaccccaacagcagcaacaacagcagctggtgcaacagcgttatcaacaacaatcggcacaaggtcccttggtgcagtggcaccaaatacatcaggttgaggagatgactttgattgagctgcgggggtgccaagatttggtggtgactgtgatcgcagcttagaaccatgcctagggtgcgcttcggagacggcccggagctgttcctactatatagggaaggtctgtagtggtatataagtggatgaccactgattagaaaatggatatggtgatgcataggtgacaaataaagggttacacaatggatatggtgacccgcccgtgctaaatgatgtgattctcaagtaaagtagatccggcgaatctagacaagttcttgattggcattgagaggatgttgtatctgattcgccgtt

SEQ ID NO: 57608 - DNA, 571 bp, Triticum aestivum
  unsure (1)..(571): unsure at all n locations
  Clone ID: PAT_TA_57608
gacccacgcgnccgancagaatttgatggcacggcaaaagaggagggtggtgngatctttggtcaaacctgtagataggcaacttgcacctactatagtactcctactgttgagttaatgcattaggctttgcgaagcttcagatcaaccttatcatatcatagtataagtagtttattggtcagttgtatcgtttcgtgtagatggtggtttacttgtgtcacttttttcatgtgatcctgttgtgagctgcaaactcgagatcttctgcagatgtgagatgcaaactcgagatcagggtgctccccaagctcaaaatcatctcaacaagactcgagatccttggcagatgctgctactgatgacaccgtctccgagggccgtcactagccccaaactcctagagtagaaatcagctgcaagaaaactgggtgtcagttatgtgcaagtaaaagagatgactattgccacttgatgcttctactgaccccgggcgaagagatgactcaccacctgcaagcattcacataaaaatagtaatgaaatttgggactgacaaattgaccaaagc

SEQ ID NO: 57609 - DNA, 646 bp, Triticum aestivum
  Clone ID: PAT_TA_57609
ggcagggcgccaccatcatcacgtggcgagctcggcgcctgtcagggtgcccgagtggccggcggccaggttcccgcctgggtctggcgagcacggctacggcgtgagctgccgtgaggaggacggggagtggatggcgccgcacgagtacctgcaggcccaggcacggagcagcgggcgcggcacggctgcgccgtcggtgttcgagggcgtggggaggacgctgaaaggtcgcgacctcagccgggtgcgcgacgccgtctggagcaacaccgggttcttcggctaagcaaagcaagcagtgtaccccatcatcgtctcgtgtcagccagctagctactcataagctcggagggcactttcctgttggatcattcgttataagatgcatgtactgttcttaatcagtatgaattaggatagggggtgtgggaaaatatgaagaagaaaaaattaggtgattgattaattattagttaatctcctgcagtatggagcatgtagctgctgcaggtagagttttgggtctgtttcgattgtattgggttgtgtgctatccctagctagctagctacctgccgatatcgtcagtttgtcacaaaacttctccggaaaataataatccaatttgattattattagctcc

SEQ ID NO: 57610 - DNA, 554 bp, Triticum aestivum
  unsure (1)..(554): unsure at all n locations
  Clone ID: PAT_TA_57610
cccacgcgtccgcaaaagcatggaggggagtctaccagccaaatgatgataagctccagttcttttatgatgggcaagggttcatgtccctccagctaaaccaggaccaagctgacttcatcttttatgatgtttctgggaaagtcttgtacaagtggagctcgcgcaaaacaaactacttccagccctccatctatgtcactgcagaatgagggagatgcagatcatggcaggagaattagtttggtagcgctatttgtgaaagaaattgaatgtgccactgtggtaacagtggtaaaggtaatagattggtatttagtatggtgtgtggttcagcgctgaagaaatattgaactggctgtgaattgtctacaataaaggagcagagatgctcagtatggtgtccattggttctgatgcatacataagtcgcagggatctattgatgcgatgtgcatttagagaaatatatgcataaactctaatattgtaccctgcactcgaaaaattaaatgaactgtagtatctggcggtgaccaaaananaaaannnaa

SEQ ID NO: 57611 - DNA, 556 bp, Triticum aestivum
  unsure (1)..(556): unsure at all n locations
  Clone ID: PAT_TA_57611
ggggcacacctcatggtgtaggatgcttcacagtcgtccaggaaggctatgggacttcagcttccaatcgaggcacttttcaaggagggagggttttcatcaccaatgtcgttgtcgtcatcgtgcaaggctccatccaccacaagtactatctcaacttcgatcaagactatgttggcaacgaccacttctgcggtgcctcttgggatggagtcaccatcggccatggctactccaaccttgtcgttcaagtcaacccggacttcgactaccatcaagacttcaagctagttaaggaatgccgcatgcaatgggatcctggcggctctcggtggtgtcggcttggggtcaagccgcatttcaaggaggggggatgttaggagccctcctaccatcacatgcttgggttggccccttgggccagctaaacgggcctggcccattctggaacgaccaangtgataagagcctgggaggaggcgacgtccagggcatccagtggatcaacgaaccggcggcggntacctctctcccctatctacttactttccctttc

SEQ ID NO: 57612 - DNA, 436 bp, Triticum aestivum
  Clone ID: PAT_TA_57612
aaaaaaataaaaaaaaaaaaaaaaaaaaaaaaaagggaaaaaaaaaaaaaaaaaaaaaaaaataaaaaaaaaaaaaaatacaaaaaaaaaaggtcttctatagtgagagcctaccatgcttcccctggcttgcgtgcaacaacgtcgctcttgggtaggggccctcctaaattcccttcttttgtcccttgctgggcgggggggttttctggggaattccttgggaacacccaggttaaccccctttcggcctttttccccttttcccaccttgaaaaaccaatgggaatccccctttggtcgccctttaaaccctttccctttctttgtttgcccaacagggcgccccgtgacttgccccattcctcccccccggttgtgtggattttttcagtttatttgttacacttttctacgccttttcccccccctcttt

SEQ ID NO: 57613 - DNA, 598 bp, Triticum aestivum
  unsure (1)..(598): unsure at all n locations
  Clone ID: PAT_TA_57613
cgagctcttcagtcgactcgcaccgtccatccacttccacccacccacacacagcgagtaaccaacccgaggaaggaagaagccatggccgagctgctgttcgcccccgccgtggccggcctcgtccacctgccggaggtgctcgagcgcctcgccgccgcggacgccgaccaccgngaccacgcccaccaccacaccgcccacgggcacgggcacggccacccccgcgcgcagatcgggggcgtgggcggcggcgcgcccgtggacatcgtggagacccccgccgagtacgccttcctgctcgacgtccccggcctctccaagtccgacatccaggtacgtgcgtgcgccgctccgccccgttccccgcatctcttggaccgaactcgtcggctcggcagggggtggcgcgattgactaacgtttgcgcgcgctctgaatgaatgagcaggtgactctggaggaggacaacgtgctggtgatgaagagcgccagcaacggcggcggcggcgccaacgggaaacggaagcgggaggaggaggaggcggactgccgctacatccggctggagcgccgcgcgtcgccgcggtcgttcgtg

SEQ ID NO: 57614 - DNA, 563 bp, Triticum aestivum
  Clone ID: PAT_TA_57614
ggaagaaatttcagttcaatcaagatcctgatgtgttgcataccagggtctcatgtggtctattccacattaacaggacttggttggccagatgataccaggtgatcttaccgacatttctaccctgcctcacatactcgaaactggactcgatattctgtttttatgggtaacccggatggctatgatgcgaacgcaactatgcggagatgtgccgacaagagaacaggtaatggcacacacgccctgcccataacacgtagtacataagggtacgaactccctcttgacacggagaaactgcgctgtacgtaaacctatacctaggatgccaccactgaattctactttaatctagcgcactgtgtgatactatactgtacaaacgtacgaatcttcacgaggggctactatggatgcgtacatttcatatcataataacacactagcacgctgcggacagcctaaaggtggcaaaggcgcatagggtcgccgatcatagtaggcatcaatgtgcacggacgcagggctgcgacgcattgtctgccctacagtgatagaaa

SEQ ID NO: 57615 - DNA, 462 bp, Triticum aestivum
  Clone ID: PAT_TA_57615
aaaaaaaattataaaaaaaaaaaaaaaaaaaaaaaaaaaaaaaaaaaaaaaaaaaaaaaaaaaaaaaaaaaaaaacaaaatggggaggtctttttaaagaatccaatgttatgtaaactgaggaccatcgtttaattgtctttaaagagccaccctaagtcaattatttgcaccttgtttcccaggatacagagtggggaaaaccctgcatttgcccaattaaatcccctagaaagccaagcggttttattgaattactgcgttcactaagatggctcttcgcatggcccttacaccatttcccctaccggaatggctaatgttacgcgccttcttaaagctattctaagagggacatcaggagcttacacatactgtagacagatgcactagcaggggcccttatgcacggtcccatcgatttttccgagactttgtccgccaatgccgatggctttcctt

SEQ ID NO: 57616 - DNA, 334 bp, Triticum aestivum
  Clone ID: PAT_TA_57616
gggatgcttggggtctggatgcagtgctggggcagtgcagcatttgcttgatgagcaccctaggtggaaactgctacaatcgttaggcgagccagtggtgatcagatgttgtgcgcatacgtttgcaggtgtaaactcacagagtgggctaggctgccctagggactttactaaattggttcttgagtgcgggggggttgagccatacatcctgagagactggaacttggggtgtaggtgtaccctatgtgactacatggactacgaaggctgttgaccaatgatgaggatggatctctttggtggaacagctgtggagattgcttgagtcaat

SEQ ID NO: 57617 - DNA, 317 bp, Triticum aestivum
  unsure (1)..(317): unsure at all n locations
  Clone ID: PAT_TA_57617
gcaatatggtagggacgagcaccggggggggggggggggggaagccaaacgctgctcattgggcagctccaccgtggaatgaatctcaagctcatgtgcatgtgcatgtccctgaacctgatgcaaacattttatacactgaagcctcagatgcaaacattgtagaagatctaactccttagcgggaggggggggatnannnctctcattataacactttncaaacctttattctaanatttaatacaactcaccttnaacctaatcctacactccnaaaacaaattctaaattatcctacccccacaaatcaaaaa

SEQ ID NO: 57618 - DNA, 616 bp, Triticum aestivum
  Clone ID: PAT_TA_57618
tttacagtagcagcagcagcagcagcagcagcaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgtggtcaacacctatggcatattcctgagcagtcgcagtgccaggccatccacaatgttgatcatgctattattctgcatcaacaacaaaaacaacaactacaaccatcgagcgcaggtcttcttccaacaagctctgcaacaatatacattaggacagggctccttgcggccattttagcaaaacacacagggccatgggtttgtccagcctcaacaactgccccagttcgaggaaataaagaacctagcgctacagacgctacctgcaatgtgcaatgtctacatccctccatattgcaccatcgcgccatttggcatcttccgtactaactgaaaagaaaaaagctctagtactagatatatgaaacaccgctttctcagtccatggattggtcgttgtagcagtgaaaaaatatgtgacatgcgcta

SEQ ID NO: 57619 - DNA, 649 bp, Triticum aestivum
  unsure (1)..(649): unsure at all n locations
  Clone ID: PAT_TA_57619
tgaactaagatcaaacgctggcctaaaatcgatgcgcgatcagcctagtcctacttcagttccggatgcatcacttgaagatagcaacactaatgaacctgaatcatcaagaagtaccagtgcctgcaatgagagagttgccttacgatctcgtgcaattgagtctgttccccgctcgttatcatgggaggaaacatactcacattcgccattacacacgcatcatctgaattcctcaaatgcagaggataatgaatcagaatgttatgcccttgtaaagaagatactatcatctgctggattaggcaacctacaagtgagtatggttttcacaggttggcattcggctgattgccctcttgatcccgcactgtgtgacaagttcttggaccgcaaagaggaggctgctaaatctagggagcgtaggtcgaaccaaaagcttctctttgattgtgtaaacatggcattggttgagactggccaggaagccttgataagaacctacccatggagtaaagcatgcctcggagcacggagcgaggcattgtcacaagatataggggaaagaagtatggagccatgtaagggattggctctacngggcggagaggctcgtggctaacgagtatggtgatgctgcaacgatgtt

SEQ ID NO: 57620 - DNA, 581 bp, Triticum aestivum
  Clone ID: PAT_TA_57620
gtttttttgtttgcaagaaggcgaagcaaattttcagagattcaagcatgctactatacatgcgatgcttggtttgaggagcttcacaagcagagaattgctgaactgaaaaggcaggcggctcggcaccgccgactccccaccggccatcgggcatgggcaccatcctgatgcttctgttctgcggctattctttgggggaacacaaccttcaaaagtttgccgggcgccctcgccctggccatccggcaccaccacgagctcttcctcgagagcatccgtgcacttcgcctgcaactcctgggtgcagaccaccggggagctgcccggcaactccaagagcatcttctatagctacaaggcaggtctacttttttacttcaggttcatggagacatgtacttgtgaaaaattgttagcattgcaggttatggtcttgactttgtgccctactgcaggacatgttgccattcgttttaacatactatattatgattcaaataatgttacattttgtggtacctgtgaattgaggaattgaattacacagaagagaaaacactttctcatacattcacttg

SEQ ID NO: 57621 - DNA, 361 bp, Triticum aestivum
  Clone ID: PAT_TA_57621
ccatcattatggatgccatgttgctgccctgatgtactaccatgactgacatataatggtatatgttgtatcatttgcctgtggctgctgcccaaaaggcatctgaggctcagccacaagagcaagttccgctggtgcaacaacaacaatttttagggcagcaaccaccatttccacccatcgggagtgggcagcctttttttttccatcacaacaaccatatctgcaactgcaaccatttccgcagccgcatctctcccactcgcagccacaaccattttgaccacaacaaccctatccacaaccgcggccacagaattcgcaaccacaacaaccaatttctcagcagcagcaggagcat

SEQ ID NO: 57622 - DNA, 319 bp, Triticum aestivum
  Clone ID: PAT_TA_57622
cggacgcgtgggctcgaacgaggaaaaggatcccttcgaaagaattgaccgaggagccgtatgaggtgaaaatctcatgtacggttctgtaaagggacagtaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccct

SEQ ID NO: 57623 - DNA, 377 bp, Triticum aestivum
  unsure (1)..(377): unsure at all n locations
  Clone ID: PAT_TA_57623
gggagacgcgaggcaccaaccgcacgggggcaggcacgcgggccaaggggcgcgagggccaaaggaagagacngagccagacaaagagcggccaaagcctgcaatcacctgccgcaggcacgcggaacaccagccccccacacgcaaggggtagacagggcccanaccggatacgacccaactaacacgttcgcatgtacaacacacgaagcggcaccactaacaagttgcctgagcggagaatcgccacaagaaccggacacctgcagacggatgccggatcggaatacatgccgaaccacttagtgcaagcgcggaacacacgcctgcgaagggcaccggaagcctggaacaactgtacacgcagcacaaggaca

SEQ ID NO: 57624 - DNA, 256 bp, Triticum aestivum
  unsure (1)..(256): unsure at all n locations
  Clone ID: PAT_TA_57624
gaggacgactactctgtggacatgtggagtcttggctgcatgtttgctggaatgatattccgcaaggaaccatttttctatggccatgacaaccatgaccaacttgttaaaattgcaaaggtacttggaacagatgggctaaatgcttatttgaacaagtacagaattgagcttgagctgangttgaagcccttttttttaggcacagcagaaaaccctggtncaaagtttatttcaatgcagacaaccagcatct

SEQ ID NO: 57625 - DNA, 318 bp, Triticum aestivum
  Clone ID: PAT_TA_57625
gccagcgggcggtctaaaagaaccaagcttatctacccgtggctgccacgtcattgctgttctatagtgtgacctaaatttaaatcactggccggccgtttacaacctccatactggggaaacccttgggcgtcccaacctaattcgcttggggcccattccccttttgcagcttgcgtataggggagagggccctccccgattgcctttccaaccaattggccaaccggaagggcaaaggggacccgccctgtactgggccataaacgccgggggtggggggggttcccgcaaaaaggaccgttcaatttgccgggt

SEQ ID NO: 57626 - DNA, 656 bp, Triticum aestivum
  unsure (1)..(656): unsure at all n locations
  Clone ID: PAT_TA_57626
cctgctttgaagggagattttgttcggtacgggaagcgaagtgcccggggaattttaaatgatctccagtattcacttgctagatactacttgaacaacttcgcagatgggacgaagcaggatgccatggatcttcttcaaggacgttacatcacatctgttagtcgagacatggcacctccaacaaaagcaggatttgtagagagctatgcgtccgcccgccttgcttttgcattggtttccggagcttttatgttcatgatgatgtcactgagacatgctcggcatgatgctcgtcatttattgctgtcacttctctgggctggtctttgcatcgggatcacacactttgtgagaagcaatggccgggtattcacgaaccggccccgtgcccacaagtcgtcacacccttgatggaaagcaggcggggtgatagattatcattcgttcatcaaacaatggcagtactccacttttttctatgtagagatgtaatttgtgtccatccctttctcctgaagattgggntctattatctatctatattctttggtcttcaagnccgtatgcataatcgatctttgaccagtaaataaacagctgttgctagttgcaacaatcacattttncagtaccaggacatagttacagcttcc

SEQ ID NO: 57627 - DNA, 398 bp, Triticum aestivum
  unsure (1)..(398): unsure at all n locations
  Clone ID: PAT_TA_57627
attcaataggtacgcgccctgcaccggtcaattaagcgctgtttgcgtggcggctactctcaatacgaccgcttcacttggcagcgcccataacgcccatatcctttaactgtattcccttactatttggacaacggtctcggatatgcccgattagctgttaataaaaggacttccttctaagttccaatatagagcggtaccgcatctcaaaacagaaaccttttacaagaggctttttagcgggcctatcccctgatagaacgtgnttcgcatctttgacgaactgttgacccttattcatactggagctcttgtactactgcaacgccaatcaaccctatgtaggcctattgttgtgctttataagagaccttgccgagatgagcctatcgctt

SEQ ID NO: 57628 - DNA, 564 bp, Triticum aestivum
  Clone ID: PAT_TA_57628
cggggaatgaagtacaagaccatcagttctctactatctacatgatcggtgataatcctaaagttgatatcaatggagttttgaaggctggccccccttggtcgtccgtccttactaggactggtgtttttaggggaaatgataatgatccaaagtttcctgctgatttggttgttgatactgttgacgatgccatcagctgtattttggaaaaggaatgtatacggtgacatttttgcgatggagcctgcgcatatattctcacagcgttattatttggcacgcttggcaacacattttgccattttttgtctagcaaagttggaacaagtgctggctggagtcccgtctctaagtcattgtaccatacagatatgctccggagaggaaaaggcaccaatcatttagttagtgcacccgtcggttaaaaaattaaagaatctgtctttaaaacatccaccaaattgtcatagtcttgcaacatactataaatctttttagatcttgtgcaaaaacattactgttatattatactacactataaaggacacgcatgataacatc

SEQ ID NO: 57629 - DNA, 309 bp, Triticum aestivum
  unsure (1)..(309): unsure at all n locations
  Clone ID: PAT_TA_57629
cgcacgctttttggccgcccaagacaggcggacggaggccgccgagccgcgggcgcgggcagcggcgctgggaaccaaaccggcaccacacncgggacaggcaaggacgagggacgccacgcgcncgccgagcagggggcccaganggggcgcgccgacgcgngcggcaatggcgggccgcangaaggcgtgggcgagggcggcacaccggacgcgaagcggggccncaagccanacgaccaagagaagggagagngcaaggacaaggccgagacccaanccgaggacagacagacaaaggccgcagaa

SEQ ID NO: 57630 - DNA, 697 bp, Triticum aestivum
  unsure (1)..(697): unsure at all n locations
  Clone ID: PAT_TA_57630
gaagacctttatcattcttgccctccttgctattgtagcaaccaccgccacaattgcaggttgagttacagtgtgacaattgcagccacaaaatgcatctaaggaacaaccacaaaagcaagtttgcttgatacaagcaagcaacaaatttcagggcagcaacatccatttccaccacaacagcacactatgacgaagcgtgcaaccatttccatcacagacataccatttatgcagctgcaaccatttctcgagacgtaactatccatatacgcagacgcaactaccatatacgatgccggaaccatttggaccacaacaattatatccacaaccgcaacgcacagtattcgcaaccacaacaaccaattttgcagcatcagcagcagcaggagcaacatcaacaacaacaacagatccttcaacaaattttgcaacaacaactgattccatgcagggatgttgtattgcaacaacagcatagcgcatggaagctcacaagttttgcaacaaagtacttaccagctggtgcaacaattngtgttgtcagcagctgtggcagatccccgagcagtcgcggtgccaagccatccacaatgttgctcatgctattattctgcatcaacaacaacagcaacaacatcaacaacaaccgttgagccaggtctgcttacgacagtctcaacaacaatatcca

SEQ ID NO: 57631 - DNA, 469 bp, Triticum aestivum
  Clone ID: PAT_TA_57631
cttggttgacgaggtcatcaacctggttgatcggcgaggccaaccgcatcctcaacggcatccacagcctgctgaaccaaaacgtggtagattttagacacggtcgacaacctgtggcataagcttaagggctggaattgcagcgttggggctaagaaagagaacctgtcctgcatgcacttgcatgaggtcattgacggattaaacaaagaacggtgcctcatggggttgggtcttattacgaatgagttctgccatgagcgcgacaagatgcagaccatgatgcaagtgtagcaatacatcgaggcctgtggtcctaagtactagcaacccgggcacaagcacatagacccgtgtgaaaccacccatgagggggtgtatttatgtttgaacgagcagacaaagttcaacatgtagattggctatccagcggctgtacaataagaagatgaatattgtgtacgaactc

SEQ ID NO: 57632 - DNA, 245 bp, Triticum aestivum
  Clone ID: PAT_TA_57632
ctcacgatatgtttgctgattcaacaaatccagaaagtgtactgttggatcaaaattttattgaagacatgcgtaccatgcctatctacattaaaggaaaaaccaaaacttcatggaacgtgctcttggaatgatacatcctttctatgtaacatgaatgtcatggattactccttgtttgttggagtggacaaacagaagaaggaacttgtattcgggataatagattacttgaggcaatatac

SEQ ID NO: 57633 - DNA, 594 bp, Triticum aestivum
  Clone ID: PAT_TA_57633
catgaaggtcttcatcctggctctcctcgccctcacagcaaccaccgccattgcccagttggaatccacctgtagccagggctttggacaatgccaacatcaacaaccggggcaacaacagctgctggagcagatgaagccgtgtgtggcattcctgcaacaacagtgtagcccagtgagaatgccattcctccaaatacaggtgcagcagcttagcagctgccagatcatgcaataccaatgctgccagcagctagcacagatcccggagcgaatccggtgccatgccatccacagcgtggtagaggctatcatgcaacaacaaccccaacaacaatggcaggagccccaacagcaagcacaacataagagcataaggatgttgcttgagaacctatcattgatgtgcagcatctccgtcccggtacaatgccagcaacaacaacaattgggccaacaacaacaacaataattgcaggagcagttgacaccgtgtgcgacattcctgcagcagcagtgcagcccaatgacagtgccattcccccagacactggtggatcagcctaccagctgccagaatgtgcaacaccaatg

SEQ ID NO: 57634 - DNA, 466 bp, Triticum aestivum
  unsure (1)..(466): unsure at all n locations
  Clone ID: PAT_TA_57634
ttacaccaanccaccatgaagacctgcctcagcnnngctctcctcgccattgtggcgacaagtgccattgcacaaatggagaatagccacatccctggtttggagagaccatcgcagcaacaaccattaccaccacaacaaacattatcgcaccaccaacaacaacaacccatccaacagcggcgccaaccatttttttattttctaccatgttcacagcaacaacaacaaccattatcgcagcaacaacaaccaccattttcacaacaacaaccaccattttcgcagcaacaacaaccattatcgcagcaacaacaaccaccattttcacagggcaaggtcgtgtctcacctttgcgttcaataaaattggatcccatcgagagtatccaaaccagtgtgtcaccctgttttatgtgtgtgtatgtccattccttgttcgaaataaaagccattatgatggatgc

SEQ ID NO: 57635 - DNA, 581 bp, Triticum aestivum
  Clone ID: PAT_TA_57635
cgaaaatcattaggaacaccctggtttcgggcggcgtgagggggacgctcccctggatggctccagagttgctcaacgggagtagcagcaaggtgtctgagaaggtggatgtgttctcgttcggtatcgtcctgtgggagatcctgaccggggaggaaccctacgccaacatgcactatggcgcaatagtaggtggcatcgtgaacaacacgctgcgtccgccggtgccggccaactgcgggccggagtggaggaggctgatggagcagtgctggtcgcctgacccggcacagcggccggccttcacggagattgcggcgcggctgcggtccatgtctgctgcagccaaccagcaggccaaggcggcggcggcggccaagtagaagtactacaaatcgccggctggggctgggttcaggttctggttctggtgattggtgggaggaatgtatgctctactagttgcggttgcggtggagtctgtggtgtatgtattggttgtctgcctgttatagagttgtgagtgtaaaaatattggtgagaatgatgaatgaatcgtgtcctcggtcgggtgtaaaaat

SEQ ID NO: 57636 - DNA, 534 bp, Triticum aestivum
  unsure (1)..(534): unsure at all n locations
  Clone ID: PAT_TA_57636
tgggtgttcgccgtgatgtgatcaggtgcctgtggaaaggcttgtagagcactgggtgaacaacgtcactcctgctcttcctcaaggggccacacaggcggagacggcaatgcctggaggctcgccggagctaccaggggaaggggagcttgctaaaacggcaacaccagaaggctcgctggagctaccaggcgaaggggaacttgctaaaaaggcaagtgttatttagctgcggtattgtcgttcgccgatttggcttgtgaggattactgctcaattctcttatcagtgtgttccacgcaattcttcatgtaaattaatcaacctctgaaagaggttcgtcgatctggctgtgacgatttgctgcttaatccacttattaacttgctgcctgaacctgctcatgtaaattaatctacctcgaaagaagtagcantacttctacttcgcttgtatggaatgttatgatgtaagggtgggaacttctagccaagatttgtcgtggcacaaatttgaattaaaccatgtgatgga

SEQ ID NO: 57637 - DNA, 647 bp, Triticum aestivum
  unsure (1)..(647): unsure at all n locations
  Clone ID: PAT_TA_57637
gccgcatccttggagcccaccatggtctaatttctacctatgccttggagacattagtgctatatatcttccatctcttccatgagtctttggatggtccattagctgtactctataggtttctggactattatagcaagtttgactgggataatagggctataagcttacatggtcctatttccttgtcttccctacctgagctagttaccgactcaccaggcattcatgatgattgttttcttgagcgggagaagtttctaagagaatgtgctcaaatgtttactgccccccctaggaacaatgagagaaatacacgcccgttccctcgaaaatttctcaacatagtggatccattgaagcagagtaacaatcttgggcgcagtgtcagcaaaggtaacttttacagaatacgcagtgcttttgatcttggtgcccggaagctcggaaagatccttcaagttcctgccaattctattgtggatgaagtcaatcagttcttcaggagcacactgaagagaaacctcggcagggcacgcccagatgtgcaaggcactgcagtgaacttgaacattgaaagagacacaagggttatncacctttacacagtaatccctgtgaggatctatcttatcagcttagtagta

SEQ ID NO: 57638 - DNA, 563 bp, Triticum aestivum
  Clone ID: PAT_TA_57638
gttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgatacaccgttttcttagtccatggtttggtcgttgtagcggtgaaaaaataaagtgacatgcactatcatgcaagaacccgaactatactagttcaaacatgggaataaaagacaaacacatgtcttgactacaaaaaaaaaaaaaaaaaaaaaaaaagggggggggg

SEQ ID NO: 57639 - DNA, 254 bp, Triticum aestivum
  unsure (1)..(254): unsure at all n locations
  Clone ID: PAT_TA_57639
ggtgtttcgagcagtgcggactctgaagatgatcctgactgggaaggttacagagccacgcggagtcgttctcgacaaaacagcttgacacggaatagcagcaatagcaaagagcctggagatggaaaaaataaacctagagatgtaacgaccaccggttcaggaaatgatgattccaatattccagatggaaacaatgatggagtgaaccaatgcagcgaagaacatgaaaatgtcgcagaacnncaacattc

SEQ ID NO: 57640 - DNA, 477 bp, Triticum aestivum
  unsure (1)..(477): unsure at all n locations
  Clone ID: PAT_TA_57640
caaccatcgttttacaacagccaccaatttcacagcagcagcagcagcaacaacaacaacaaaccatttacacagcaacaacaaccaccattttcacaacagccaccaatttcacagcagcaacaaccaccattttcgcagcaacaacaaccaccattttcacagcaacaacaaataccagttattcatgcgtctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcnngcacaacaacaacaacaacagggtcagagtatcatccaatatcagcaacaacaaccccaacag

SEQ ID NO: 57641 - DNA, 274 bp, Triticum aestivum
  unsure (1)..(274): unsure at all n locations
  Clone ID: PAT_TA_57641
gggccgacccagcgnccggaagcaggtttcnncaacagnagaggaggagggccacccggnngaaagggagnngaacangcaaaggggcngcnggagnangaacgagagagggaaaaannccaaccaangnncncngggngggnnnacccaanacacanaaagnngacgaggaggcacnaaggcgggcnanggcagcacaagggggggggggggggcancaaagnnnnnccagaaaggcagnangcnnnngnggagnnngcaaccanngaaggag

SEQ ID NO: 57642 - DNA, 279 bp, Triticum aestivum
  Clone ID: PAT_TA_57642
gccaagcaagcagtgctcaatacaaatccaccatgaagacctttctcatccttgccctccttgctattgtagcaaccaccgccacaattgcagttagagttcagtgccacaattgcagcccaaaatcattagaacaaccacaagagcagttccattggtcaacacagatttcagggagaacaccattccaccacacacatatcgagcgaactttcatacacacatttgagtgaccattcgagcgaactcatatcgagcgactccatatcgagcgaactt

SEQ ID NO: 57643 - DNA, 312 bp, Triticum aestivum
  unsure (1)..(312): unsure at all n locations
  Clone ID: PAT_TA_57643
cggnnttccccgggtcgccccgcgtccgggccttgtgcagggntgtngattttgctcatcggcggtagggtgtgaagtgccctcctcaggccctcaagatgtcctaccatgactgagatataatggtatatgttgttgctgcgaatttggtggttgttgtacagatttgccttccttctancggattatgatttcaacaaccagttctaccgcggcatccatcattttcacagcagcctctaccaccattttcacagcatcaatcaccgttttcgcaacctcgggagcccttttttttgtttcttctttttt

SEQ ID NO: 57644 - DNA, 485 bp, Triticum aestivum
  Clone ID: PAT_TA_57644
gtaagcatatcgatatacgttatcattttatcagggactgtgtggagaatggcaagatcggggtgaactatgttccaacgggagatcagctggcagacctacttaccaagccccttgggcgtttgaagttcctggagctcagacgaaggattggcatggtggttgtcaaatgaagacaacaaggtttaggaggaagattgttagttgtgtaaacctgttgtaatatggtcgtggtaaaacctggaaggtgcccatgtgttggtgcactgtgggtgagtggagtgatggtgaactgcatctgttgcaaccatcagttcacgtagtgggtgtactgagtgtgtacccaagtattgtagcagagtgtgggctgtgtgcgtgcactggtatggctacagtggtgttggtttctgtaactggacatcaaaagagtagagccggagtgtgtcgctggttttagaaaagggaaaagggcattcgttgcctgg

SEQ ID NO: 57645 - DNA, 465 bp, Triticum aestivum
  Clone ID: PAT_TA_57645
gagacttttatacgcctgccccgccctcgcggccagacgcacatgcggtgtctacctctccgccgccagggataagaggccgtgctgcgacgagctggccaaggtccccaacttctgccggagcgaggcgctgcacatcctcatggatggcagggtgactaacgagggagaggttaatgccagcctgctccatgaggacatgcacagaggcaaaaaggaaccagggagctcatcgcggacatcgtcaggcgggaggagtgcaacttagagactgtcttagggaccagtaccaactacggtgccgcgacgtgtaatatacctagaacgaggcttagcgtaaccctttataatagcagactcgagcagcgaataatactttggtgcctcctatcgatcaattcacatggaccgtacgtatttacaaacggtgcggcacgtgtctaaaacgcatcgcaagtcttacca

SEQ ID NO: 57646 - DNA, 546 bp, Triticum aestivum
  Clone ID: PAT_TA_57646
gatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgtctaa

SEQ ID NO: 57647 - DNA, 705 bp, Triticum aestivum
  Clone ID: PAT_TA_57647
cattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcg

SEQ ID NO: 57648 - DNA, 683 bp, Triticum aestivum
  unsure (1)..(683): unsure at all n locations
  Clone ID: PAT_TA_57648
caatgataagatgaagagctgctccagagtcattcctttctatgctaccccaatggcatgttcatttgttctgagggcatgcttggtaattgaatgcccatttggaagtatcggcactcaccaggaacgacatggaggaccaagagattgtgtagtccaactatgtgatgaattggatgtctactttgttagtgctgataccgagcaaaggcaatggttgaaatgatagtggtcatgtgcaccaagttcttcagcatgcccgctttgatcgactgcaccattgtgttctaacatcaactgggatcaagtaatatgcgaaaggagttaagataccagtagtgactaatgaggagtttcatatgattagttgtgtcactgtagtatcagatcaaactctgattagttgttttctttaagaattgagaatttttctatggcatgtgaccagaagaaatgttatctcatagccgatatagtactagcaagaactctgggtaaagaattcggctgcgctgatattttggtagcggtaagcaggaacaaagcagttacccgaccactaagatgtgttgctgttgctagtgtatgttaaatttgcgccgtatgtatatgtaaagggtcggcatatgactgaagaattgaaaatcctgtgaattntatgaggctgctgaattagaggttgc

SEQ ID NO: 57649 - DNA, 260 bp, Triticum aestivum
  Clone ID: PAT_TA_57649
gcggtcggttgggctgacatgtcggagacacaacacgaaattttgatagtggaccatcttattttgtgtacccagtggtgaaatttttgaactgatttttctgccttgtggtatggctgtgccctgccatactttgtaacagagctcgggatacacattcctggccaaggaaagaaaaacgaaatcacgtttagttgtgcgtttttttctgtcgaaataaagccctgcgcaaatcaggcagctctattttgctctttgtc

SEQ ID NO: 57650 - DNA, 489 bp, Triticum aestivum
  Clone ID: PAT_TA_57650
gaagggggtgacagacctggcagcgcaccgtgcacgtcgtcgaggagctggcgtacgctgatgatgcaagacagcagccttgtgcatgttatcttttgtggaggagcactgctgacagctgatgcgtaccagctctggtaactgatagtctaggggagcatgcctgcgatagttttggaggatattgttcccttagtgattgtaaatgcggatgctatatgctcaaactaagataaggaagctctctttattgttaacgaacatggcaaactgaaccggttttggtcatggggagatagccgcttgttgtagcgaagggcggccgatctatatgatacatacactcatacgcacttaagctacgttgtacctcttgtctattttacacacaaaaaagaagatatgggcgtgtgctttactatagtcgtgcattgactagaacccgtgttagaccgaggtatattgcactagacaaaagtatctgtttaa

SEQ ID NO: 57651 - DNA, 525 bp, Triticum aestivum
  Clone ID: PAT_TA_57651
gacgggaacgcggcgagggacagcaagaagacccgcatcgagccgcgcgccatccagctcgtcgtccgtaccgactaggagctctcccgcctgctcggcatggacactatggtcagtggcggtgtcctgcacaacatccacaagccttgtgttcccaacaggccggaggcacaggcgcgggctggcgacgactatagctagatgacggttactactgtgagggcgcgggagctcggtgtgtatccacttctgtgtaggagcgggatgagttgagcgttgcctacgagaatgagtcctactactacgtaggatgatagtactactattaaatcctgaaatggtgcctgtccgaggctaaactaggggtagacaacggatacatgctcgtgggttggttgctctgcactatagcacgctgaacacatggatgccttagagaaacagattggtggccaacttttgcttcaaacatacgggacagcggtcgatgagatgcatgctcacatgcaccgcttgacaattgac

SEQ ID NO: 57652 - DNA, 643 bp, Triticum aestivum
  unsure (1)..(643): unsure at all n locations
  Clone ID: PAT_TA_57652
cagaacggctgcaacagcaacgaaatcgcactcttacacatgattctgccacaccgacgagatatcctgcaaggatgctaccttgcatcatgctaacgtagcgcatgcgatgctcacaatgtgttgcatcatnagtaccagctgcctgcatgcttcttcgtccatcgattctgcctaggaccccgcatatcatcatggcgccgagcnactccatcagtgctcccatatgctactatgtctgccttagaacctacacatcaacgacaacaacaacctgagagccatctccgctaccagcagcctatgcagaggtatacattatgccagggctccgtccagccatcttacttgaacccataggcccaaggttctgtccaatctgaacagctgccccagttcctggaaataatgaacctcatgctctagacgctaccaggcctgggcacaggctacatacctccatcatcgctgaccaccattgcgccatttgctcctcctcggaatgacattgataagggaatatccctagtactatatatatgaaacaccgccatcttagaccatggttcgtacgttgtactggtgaaaaaataaagtgacatgcacaggtcatgtaagaaccccaacttactagtccaaactt

SEQ ID NO: 57653 - DNA, 697 bp, Triticum aestivum
  Clone ID: PAT_TA_57653
cacatttattcaaaggatcattgtgatgaatgataccaattctaggttgctggaacttgcatccaatccttctattcccaactggtgagtttataggttgcagtgtttgtggtggtctcctcctgatggagctcagtatatgcccttcttgtttacctaaaaatctcttctctcctaagatcttgtaggaatctttcttttttccttaagaagcatgctaccaatggacgtcagatgttccagcaccgaaaagttggtgaccatgcttgggtgtttcagacttcatataaaaagcatttattttttactttcagggattgctccatcttgcagtttataatacggctggacaattacgatttcacatatatctgaaaaaccacagcccatctgtgttctataaacgttggtgtggtcttatgtgcaccaagaattctgtcattaacataaggtattttacacccgcactgcaaactgttgataaatctgatgtgttgtttgcactgagaattcttacatttgcgtaaggtattttacacttggcgttgtgaactcattgacgattagcattcgtcagctaagcacaccttgatgtacgcagcttgtatattaacaggtcttcagaaaggagtatatccagtgtttcttctccttacctgtcacatgccacagctgtgcgaagatgtcgtcggccgtg

SEQ ID NO: 57654 - DNA, 760 bp, Triticum aestivum
  Clone ID: PAT_TA_57654
ctgacccatttggtgacttcagcacctctagtgcaccaccaccacctgtacacagctccactggaaatatcagcacgtcaagtcagaaccttgaggcagcatcggactttggtgcctttgaatcaaacaccgtggatacagctaaagaccccttcgacttttcttccactggcaattttggcaaagcagatgtagcacctttggctgctcccaaaactggtgcctctgattttggtgccttcattgcaaacactcaagaagcagctaaagacccctttgatctttcttcaagtattaatggaagggcagaccaaacacctttggcagctcccaagcccaacaccaagaaagaaaattttcaggtcaaatctggcatatgggctgactctttgagccgtggattgattgatctgaacataactggaccaaagaaggtgaacttagccgatgttggggttgttggcggccttagtgatgggttcgacgacaaggctcaatcctcatggaccggaggatctagccaaccctcatggaacatgggtgccggaggatctggccaaccctcatggaacatgggtgcagggggatctggcctaggaatgtctggaattcctccgtctacgcaaggcggtggcatcgagagcttggcaaactacaacaagtatcagtttggtggcttcaaatgagctccataggagaacatttctagcacctggtgtttgttgcttttgctggactgtgcctttgggcgcttattatc

SEQ ID NO: 57655 - DNA, 295 bp, Triticum aestivum
  Clone ID: PAT_TA_57655
cggacgcgtgggcgttgcgccacttggcatcttgaagacggggatcagacttgtggtcgacatggtgggcgcagtcgtatttggaggctcgggatgggtagaggggaggacaggcttggccttctgggtgccagcgagaggaaagaaatgatgaagggagaaggacgtggccagaagggtggaggcgctgaatgaaggagagatgttgctcatggtgaagaggagaagatggttgtgataccaagaacaattgtgacttgtgagtataatctcgaagatgtcttgtgttcactca

SEQ ID NO: 57656 - DNA, 338 bp, Triticum aestivum
  Clone ID: PAT_TA_57656
gatgaacgcttagcggcattctaggggtgagggtgaatggtgtgagggtgggctccatgagtttacaagcgtggtgattcagtctatgtaatctgaatgccggcgggatgcacctgcgtcagctagagtgatcttgaactaagcgtactcctctggttatgcagatatgcacaaggattgtggtccaaagtgatacaagaagccaagaacctgccgaccagagtggaacgcagcgctcctccagtgatccatgcttacgtactcttgcctattactggagatgtatcttatattgatgactaactaatatactgtgacctaccactgccagcgacata

SEQ ID NO: 57657 - DNA, 340 bp, Triticum aestivum
  Clone ID: PAT_TA_57657
aaaaaaaaaaaaaaaaaaaaaaaaaaaaaaaaaaaaaaaaaaaaaaaaaaaaaaaaaaaaaaaaaaaaaaaaaaaaaaaaaaaagaaaaaaggggcggccgttttaaaggttccaaccttgcgtccgcgtgcttgcgacgttttaatttcttctttcgggtcccctaaattcactcccctgtccgtcgtttgcgcctgggtaactcgtaaacccctgggtttcccccccttttcccccttgcccctttccccctttcgccctttggcgtaatggccatgaggcccgcccctttccccttttccttcatttttcccgcctttttgccgttcggttcccccc

SEQ ID NO: 57658 - DNA, 774 bp, Triticum aestivum
  Clone ID: PAT_TA_57658
cggacgcgtgggttttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcagggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgcttcgtaccctgccaacgatgtgccgtgtcaatgtgccgttgtatagaaccaccactagtgtgccattcggtgttggcaccggagttggttcctactaataagggaaa

SEQ ID NO: 57659 - DNA, 134 bp, Triticum aestivum
  Clone ID: PAT_TA_57659
gtatttcatgtttattgctttgctttctcatcacgtacctaggatgaccctgtggagctgtcacacggctgctttgttgatggatgaaaaccatggctggactgagcctgctccccatagaacgatgatacaga

SEQ ID NO: 57660 - DNA, 466 bp, Triticum aestivum
  Clone ID: PAT_TA_57660
ggccacgctgtgtcgagctgtcgacaaagtgcgccgccgtggcagggcgaggcgtctcctgaacatgatggcctgaacgagggatggtgcaggaccatcactggcgacgatgcgagcaatgaggatgcccacttagccgcagtcctgattcatagcgccaggtggcatgcctagttcattcctagcacgttatggcttcatgcgaatctataagctgaaagtgcttcatcggttacactactggagctggtgatgctcactatagttggttaactacgatatggtgcactagtgcaagctaccgtacgttccatgctgtatgcaaaggatacacatgcgtgtgctctcctaaaattgtaggaacaatctatatatttcactgcgcgtaatgcggaccagcgtgttaagcagagctgatacactacttgtgtagctgatatacaataaagactccggatagcgtgca

SEQ ID NO: 57661 - DNA, 507 bp, Triticum aestivum
  unsure (1)..(507): unsure at all n locations
  Clone ID: PAT_TA_57661
gaaccagcgggcgcagcagccggngccgcgacggacagaacanaccgcagcggnnaaagcganaacanggncaccccaccagcacagccnggnggcgncaggaggggggacggcnganaggngnancaagnnccggaacaccgcnaanggaaanangcgcgagggaggggacacaggcagccaggnnngnaaccnngccnggngcaagaangngaangagcncgcgagnacccangggnacccacagaaccaaanaanggngnggaagnanccancnangccaaagggggcgacncggacnggacacacacngcgngngcnnnaccnggcaacgccccccgnaggacagacaanagcaacaggagccggcgacgaaacgcgaagaaaccggaacagcgnccccncaaggaaagcgcaggcncccgcncgngacgcngggcnncccccnnnnccgagaagccacanccggngagaagnngcagagggaccgaccaaagcagaagaaga

SEQ ID NO: 57662 - DNA, 797 bp, Triticum aestivum
  unsure (1)..(797): unsure at all n locations
  Clone ID: PAT_TA_57662
ctggaactgggtgtcgaggggagcgagccgggggtcatcggcgaggagattgcgccgctcgccatggagaacgtcgccgctccctgaagagagaaagaaaaggaagttctggtgcatggagcgtccatccagtctgcagggttctcgtatggggagatagccgcttgttgtagcgaagaagggccgatatatataatatatagacttataagtacttaacttttgttgtgccgcttgcctcttttacaaacaaaaaagaagttaggggttgtgcttgttatccgcaaccacaacaaccaatttcgcagcaacaagcacaacaacaataaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggcttctgtccagcctcaacaactgccccagttccaggaaataaggaacttagcgctgcagacgctngccagcatgtgcaatgtctacatcccttcatattgctcgaccaccatttgcgcatttggcatctttcgtactaactg

SEQ ID NO: 57663 - DNA, 664 bp, Triticum aestivum
  Clone ID: PAT_TA_57663
gtgggttaccactccaggactcagggattgcttgcttgggactgtggcgataagcaggcacatggagtgtatgtaacaagctttgctataacatagactgacaacgttgtgctggttgaaccatggggcatgaaaccgtgaggatgcttcctgtatcacaggaggtatgatggctgagaagtgctcacactaatgctggtcctgcaactgctgagtctaccaagattatgtatggaggctctgtaaatggtgcatactgcaaagagcttgcagactaacctgatcttgacgtgttccttgctggcggcgcttgactcaagcctgagcttgtggtcgtcatactgatatgccaccgcgtaatctttttctgcttacatgtttttgacatgcatgcatgcgcttgtaggagtcggtatctgcttatctctataagaccgattgaccatcttgttctatttcgagtgcactgttatgccctatctatcatgttatctttatggtgatgcatgctcatgctcgcttgatgatggctggaacgatactgggtttacttatctgtaccaactatgcacaacatcgacaaatgatgaagcagcctgttgacaccatagcagctgaaaccaatgctctagctgcttgtgggttggcatcgatgctgtcacag

SEQ ID NO: 57664 - DNA, 749 bp, Triticum aestivum
  Clone ID: PAT_TA_57664
cgcagcaacaacaaccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgttcatgtgccgttgtattagaccaccactagtgtgccattcggtgtt

SEQ ID NO: 57665 - DNA, 650 bp, Triticum aestivum
  Clone ID: PAT_TA_57665
ggcgagcggccttttttttttttttttttttttttctctttttggcgtgacgcccaggcaggcgtgccctcggccgagtggcctcgggcgcaacttgcgttcaaagactcgatggttcgcgggattctgcaattcacaccaggtatcgcatttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaagggacctttttg

SEQ ID NO: 57666 - DNA, 455 bp, Triticum aestivum
  Clone ID: PAT_TA_57666
tcattaccagtctgattgatgcgtctatatagctacaaccgacacatcgccatccatggaattgctccttgaaaaatgcaatccctggggaaatgcgcacaaagttttgctaagcgcctaaaatgttgcaatgaagcagtttcgtgagatgcaacaacaatgttgccaacggttgccgcaaattccccagctgttccggtgtgatgcaatccgagctttcatctactacatcattctgcaataacaacaacaggtgcaggggtccattcaaactgctcagcggcaaccccaacaggtgggccaatgtggtttccgaccccaacggcggtctccacaacaactcgggcagcggcctcttctacaacccttggggcaaggttcctttttgtcgcccctcccgataactcaacttgaggtggtgacttttcttgcgctccgttccctgccccctctgt

SEQ ID NO: 57667 - DNA, 551 bp, Triticum aestivum
  Clone ID: PAT_TA_57667
gccggcgcggcgggagccgagtacagcgtgccacaccgagcacgagctccacaccgacctggcgtaatgggcagggggcaccgcacagctggtgatcaactgtctccactgctacctggagcgttgctggtgatagcatagaccccatctttgctgagtacggccaagaaccaccatagggacctcattctgacggaccaccatgaccatatgtaagacggcaatcgagcatacgacggtcaggcactgccaaacttcctcgttatcaaggatggcacccatagagcacactcgtggcctgggcgggaacgagcatatccataccaagacactgactgtcatgaccattgctttggacgaagaaagcaacaacgacgcccatattgtgtaagtcaaaacccacaactggggtgacattctgccggtccagcatgctctgacttatgctggactgaactttgaggagagtcggaccctagctcactacttcatacataaggaccgcatgctttaactgacactacctaatggtggggtacagtagctgccct

SEQ ID NO: 57668 - DNA, 531 bp, Triticum aestivum
  Clone ID: PAT_TA_57668
cggactattacctggagctcgtgtccaagggagtcggtaaaccgaaggaagagctcgcggagttcctgagaggcccgaggtacttccgcgcgcaggaggccattgactacgggctcgcggacacgatcctgcactcgctggacggctctttcaagccgaaggacctgacggcgcagctggccaaggcgcaggagatgcggcagtctgggaagcgcgcaccagctggagctgggcgatggtcgactccgaccgctcccaggtagactagaaggcaaagatacgctcaggcgactgtgctgccacaggttgtagacttagaagatatccgcctgttgtctgggatagattgaagctgatgaaaacgttgcactcgcactatacagcacccatattttgccaccatcttgtattgtctggcatatttcactagtggaaaccctgaatttttgtcaactttggctgtggcagatgtgatagtgaaccccgaatttcggaaaatcttttgaagttcgatattatcagtaagtctac

SEQ ID NO: 57669 - DNA, 620 bp, Triticum aestivum
  Clone ID: PAT_TA_57669
gcattgttccagcatcaaccaattctatgcgcagaaacgaccattttcacagtaacatcaaccagttctaccgtgacaatgaccattttcgcagcaacaacaactagatatacctacacaacaacaacaacaacagcttgcgcaacagcaatatccctattgcgcagccatccgttcagcagcagctaaacccatgcaaagtattcctccagcagcagcgcagccctgaagcaatgccacaacgtcttgctaggtcacagatgtggcagcagagcagctgccatgcgatgcaacaacgatgctgccagcaattgcggcaaatacccgaaaatatggatatgaggcgaatcgcgccatcatatactacatcatgctggatgaacaacaacaggagctttgtacaaacttgatgaggaacaaccccgagcaggcagacaaggtggctgacactcccaacagcaggcggagcagcagttcggacagtggtctttgcaacaaccttgacagaacatgggtcaacagcctccacaacaaccacaacaggtactagagggcacctttctgcagacacaccagatagctaacttgtagacggagacgctcattgcactcagtacatt

SEQ ID NO: 57670 - DNA, 790 bp, Triticum aestivum
  unsure (1)..(790): unsure at all n locations
  Clone ID: PAT_TA_57670
ctgcaacttaatnattaggtagtgagaagatgcgatagtttgaacctcctccacttcttctatacaagattggtcattttccaaagggatggaagtagctgtttagaggatccactcacatgaggtacacctcataattttaatgtgaacttaatattttgtatagctatccaaaatctgtggatgaactgggtcttgtgttgcttaaagagtttgagctcggactaatgttagtattctttgtcacattgaactcggtatatcaaatggttatatggtagattacacaacaacatcaacacaggcaacattgatntaggttggtgtgcataagatggtcctcaggnagngaagtccatgacagcctgctaatcctaggtgtcaaggcctgtcgaatccgatcacgacaatctcattgtgtgctagataagggcaagagtttcgcacttgttccactgccaccattgccactatttgccgccggcgncttgatgcagcggagtgtgtaaaagggagaatgtgaataanggaagtgtgccggnnnagtagtccgtacctttttatcacagcgaggggagttaacccacactagctccacgatctgctgaccagcggttgcctggttcgagccgatcaacaatttccattgagaggaaaggcggtgcagggcacctcgntggatgacccctgtgtatgcttcataaccanacatagtcttcttttggntatcctgattttcttccatatttgncccaataaatttggccccatggtaactcacaggcacata

SEQ ID NO: 57671 - DNA, 644 bp, Triticum aestivum
  Clone ID: PAT_TA_57671
caggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaatgtccccgcagcagacaggacaagcgcaacaactaggacaaggccaacaaataggacaagggcaacagccaggacaagggcaacagggaggacacggacaccaaccaggacaagggcaacaatgacgacaagagaaacaaggctaccacagcccataccgtgtcaccgcagaacaaggagcggacagaccacaggagaaacaggggcaccacaccgcaaaacatgtgaccacagagcgtcagacggacgggcgcgacgcattgacggctagccagcgatagaacactctgcagcttgcatggcgcttggacatgcatgcaccttatctatccaatcaacgagatgaactgtctacagcttgtctggtgcttgggcatgcatgcaccttatctatccaataaacgtgatgcgtgttcaca

SEQ ID NO: 57672 - DNA, 654 bp, Triticum aestivum
  unsure (1)..(654): unsure at all n locations
  Clone ID: PAT_TA_57672
cggacgcgtggggcagtcccagtgcgagggactgctccatcctggagacccatttgtgcttcttgcgagtgaacttttgaagcaagaggttcaaaaactgaaagaagaggtaactgttactacagtggtaaacacggcacccaaaagttcactcgcaagaggcacagcctctttccaggatgctaatgaacttttgaagcaagaggttcagaaactgaaagaagaggtaaaagaaatgtctgagaggcttcctccaggagaccctaacctgaagccaccacgagtcgggtttctcctgaattggggagagaaggcgagaagagatatgagtcagtatccattcattcattattttcagacactgacttgtgtcgtgtctgcttggtctaacggtctccctccccaagcactagataacagcggttccacacgaganacatgtttgagaacttaaacaagaagcagagatctcccggctgcgcagcagaggacgaacggtggggatgaccggcgggaacanggaaggntgcagataaaccggcaaggctggaacacgaggggctccagttcacttagtaccttgaatgggatgagccaaagctcctcaccttttggtttttctgaacccgatgtaatgtgagccagccctgcagc

SEQ ID NO: 57673 - DNA, 607 bp, Triticum aestivum
  Clone ID: PAT_TA_57673
gaaaagtcttagtaactatactaggatcagcgcagcttaaaccatggatatggcaacgcccagcatgactaataaagtgaaacacaacgaggtgtgcgacccgaccaaactacatgtgtaaattctgatatcttgacacatatagacgcatgcagagaatgtctatatcgacattgcgtgcctgtggaactgacagacatgcttgctaggtcataaatgtggctttactgcacatgccatgtgatgcaacaacggtggtgcgatctagagcgagccaagcctacagcaatcgccgctgtgaggcaatacgcgctattatagtagtccattatatctgcatgaacagcaccaggttcaacggctccatccaatgtgataaccatgaacccaaacagctgagccaatgtgcttcccatccccatctgcacagacgacaacaactcgaacaggaacctaaacaacagcacttggcacaaggtacctttctgcaggcacaccagatacgctccctggaggtgatgactaacattgcgcgtcgtaccgctgacacgaagtgccacggctatgctcgcgcagtatactaccaccagtagcgtgccattcggtg

SEQ ID NO: 57674 - DNA, 746 bp, Triticum aestivum
  unsure (1)..(746): unsure at all n locations
  Clone ID: PAT_TA_57674
ggtcaatactaatccaccatgaagacatttctcatccttggcctccttgctattgtggcgaccaccgccacagctgcaattgtggcactggaactctaactgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaagaacaacaaatccttcaacaaattttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaaccactatcgagccaggtctncttccaacagcctcagcaacaatatccattangcccaggctnctttccgccatctcagcaaactcacaggcccagggc

SEQ ID NO: 57675 - DNA, 753 bp, Triticum aestivum
  unsure (1)..(753): unsure at all n locations
  Clone ID: PAT_TA_57675
ggccggtttgggaacggagaagacattaaaatctggtgtgacccttggatcccgagaggtagtacaaggcgaataatatcaccaaagggaaacaacttgctctccaaggtgtttgaactaattaaccccataacaaatcagtgggatgaagatctgattcggcaaaccttctgggccgaggatgcaaaggttattcttcagattcctctccaagacgatacagagggggagatgtcagatttcaaatggaagaaactttgggcgctccctcttccaaataaagtactgcattttctatggaggctggccacaaatagtctcctagtgcgaacgaagcttaaaagaaaaggtaaaaaaaggcgagcaaccaccaagcaaaggaagcagaccaaaagtggaaggcgccaccagcaggaatcctgaaaataaatactgatggggccttcattgaagcaacaaaatcaggtggatggggcttcacacttaggaatgaccaaggcgtgttgctggcagcaggagcaggtaacctcgagtatgtttcagaaccattacatgctgaactcttagcttttaacaagctgtgcatgctgctattcaaatgggctgccaaaaagtgatgtttgaaatagactgcnttggtgttgatgcaaactntgcttagtgatgaatatgacctatcaactctgggcacattgtttaaagaggttaaattcctcctacatgtggncttaagtgatgtttccataatacatt

SEQ ID NO: 57676 - DNA, 265 bp, Triticum aestivum
  Clone ID: PAT_TA_57676
gcttgtgcgcaacccataaattaagaggcagatgtatcacagaacatattagctactcattcgcttgactaggcgtccggagatggagcgtatgtctgcaaggatgtggccgcatacccagacgcctagtcaagcaaatgagtagctactatgttgtgtcatgcacctacctcttaatttgtgggagtgcgcacaaactaaataaaatggtgtatgtgcctatgcgaaatgcattggtaatgaataaaagtgaagttccctgttt

SEQ ID NO: 57677 - DNA, 598 bp, Triticum aestivum
  Clone ID: PAT_TA_57677
ggcgatgtggcgacatctggcattgcagagatggagactagttgcttccttggctccggagagaccatggtatctacaaacattacaacttaaagagacatttccacaacaaccaccatgttcacaacagcagcaaccatgtcctcaacaaccaccattttggcagcaacaaccttcattttggcagtaacacactattttgcacagaatcaccgaccagttgtaccacaacaaccagatattctttgcattaccaacaaacagttctaccacaacaaccagcattttgagagcaacaacaccaacagctatatgtaacaacaaatccctattgtgcatgcatacattttgcatcagctaatcccgtgcagggtattactgcagcagcagcgctgccctgtggcaatgccacatcatcttgctaggtcgcagatgtgggagcagagcaggagcaatgtgatgcagcaacgatggtgcctacaattgccacgaatgcccgacaattccgctatgaggcaatccgtgctatcatcttctacatcatgctcaagacaacacaggtgcttgaccgacctcatcagcaacaaccccaacagac

SEQ ID NO: 57678 - DNA, 438 bp, Triticum aestivum
  Clone ID: PAT_TA_57678
gccgtgtcggccgatgaatgcaagggtgaccgacaggacatgatcaaggagtgcggccagtatacgaaatggccagcagagccaaagctagacccatcgaaggcgtgttgtgctgtgtggcagaaggcgaacatcccatgcctttgtgccggtctcaccaaggagaaagaaaagatatggtgtatggagaaggtcggctatgttgccaatttctgcaagaagccattcccacatggctacaagtgtggaagttacactttccctcctctggcgtagtgatgctattttagtcgcgggaggagaaccgttggtttttactttcatgtgtctagcctcacaacaacttctctttcagatatgtaattgatgaggttgtgcttaggatagtttatgttaagcgccatgtatgagacaaataatgaataaagtcttctcctc

SEQ ID NO: 57679 - DNA, 656 bp, Triticum aestivum
  unsure (1)..(656): unsure at all n locations
  Clone ID: PAT_TA_57679
gcctcgtgttgatgcaacgtgcttgttgaaatttaattctgtaaaagagaaatactgatataacacaatgatcaatgtggagtaggatggttatagagttcttcctcggttttcattgagcaaagattggacatgtttgactcttctgttgccataattacctcactaggtttggagaaatttatgatcaccatgcacatccccattacttccacttatgattttgtatctatatgtaaagtcatttgtcctgaaattctgtgcagaagtattctgatacttttccttatggcccggtggcagccaatgagggttccccatctgatgcttggtgcggagaaggggccgttctcctctcatgcgagcagcccaagtgctgcctgatccttccgtccaagatggaggtggtgaacatcgatgtggcgacgcctgatgtgtacatgaggtcgctatgtgttgtgtctgatgtaatttggaactccggaattttcatggctgaatgtttgtctttgtgcttgaattcatttgtgtttgatgtactatgaattaatgattagctttccgattgacttggttgtgtcttttgtccgaatcaattgagaaaaaactgaatatatagctgaatgtgggtggnttcacacattctgaacgaanaa

SEQ ID NO: 57680 - DNA, 575 bp, Triticum aestivum
  Clone ID: PAT_TA_57680
gccgcccattcataccttgctcatatttgtgctgctgagggatgcgaccacaagagccttggttcacatcggggaatccatacgaccctgcattgaagagaccggccaacctgcaggccgttacctcacaaagaaagagttatcggcacggacaactattacaacacttattacgaccaccgcctctatctacacttggattgccatggcggcaacgccctcatcgacctcggcagacacatatctgccacatcagcctctattgttgaactacaccaacagcaacgtggcctacgtttgaactccacctgagcagagacagcccacatacattatacagggtggatcctagaccctactacaccgtaaacatgtcttgcacgtatagttccaacgcacctgacagcagcatcatgattaatgaatctcagcaccgacaccgactacagggtaccttgatgcaggcacaccaactagcatgatctcgagttactgactcgcattgtgctccgtactctgcctatgatgtgcaacgctaacgtgccggagtgcgggaccaccaatagcgtgccatt

SEQ ID NO: 57681 - DNA, 707 bp, Triticum aestivum
  unsure (1)..(707): unsure at all n locations
  Clone ID: PAT_TA_57681
cacgcccattttcaaacagcgtcctacaccatttttgcacaaaaacaacactgtatcacacacatccacacttttgcacaaatcaccaacatggttcccagcgacctatccctgttgttcaaaccatccgttctgcattgcacctaaccaccatgacaggggcgtcaccctccaacacacaggtcgtacaccttagtgagcaagtagtcagcaagcgcacgttagcatagcggtcaccaaatcgatggaaaacaggacgtacgtatgtcgcttcgtagcactgacactctaacancgtgattcgagcacaacagactgctctgcaaactaacccagaaccatggcccctcatgaggcactacccgccttcttcatactacatcatgactggggaacaacggctaggccatgccctaccatgttagcgccaaccaccacacgcgccgcctagaggctgccaacgcccacagaagtcgcgagcacaatgacgaacttgtacagtgctgctttgcaacagcctcattgactaccacacttggatcgaactctctgaaacttgcatgtagcttgggcattcttgctgcttacatatacaatatactgagactgtgatggtgacgagctttcacttgcactctagtaccttgcacactatgtgcgcagtatacaaccctcttccacttcgaccactattatgccattcggca

SEQ ID NO: 57682 - DNA, 688 bp, Triticum aestivum
  unsure (1)..(688): unsure at all n locations
  Clone ID: PAT_TA_57682
catggaagtacatcaacagaagtccttctcaactccttccttgaacataaaggatccatgtccagaaatgttcgccgaaaaggttaagcagggttctcggaaagaactgccagttgaggttatggttgatcagaccatgggcaaaaggacatgacattacaggaacagaagcccttctcagttgtctcaacaaatcacccacttccttccttcaacagaaatgagtcatgtttagaacagttccctgaaaaggttaagctgggatctcaaaaagagctgccggttcaggtcaagttagaacagtcaatcggcagaggaaaggaaaatgagcccctgtcaatactcccggccactcttccacactcttccttgaacagaaatagtctgcatatcgaaaaaatcccttaaaaggttcactggttcggatacaaggatgagaagaaagtcatctggtctcatggtnnagatgtggacaantcacggaggagagctcaaagaagggttcagtgacccctgtaacttcctgcaatgcaagttcaagaaatgcagatgccaaacctcaggaggataaagcttccatggagccccaacctactacttcaaagataaaagtatcagaaacttctaccatntctctgaaccagcaaatccatttcaaagggaacgggcagaaacaagctgatattct

SEQ ID NO: 57683 - DNA, 194 bp, Triticum aestivum
  unsure (1)..(194): unsure at all n locations
  Clone ID: PAT_TA_57683
ctcaagcgtaacgcaacgccaaccataccaccacactagagcatggtaaccaccctcgacagcgacgatcgcactatccatagcgcacaagagccgttattgtcctaggcagaatcaatcatcgccatacatacctaagtnctgcatgcgagaaacgttcgccattataacaggcatatctataatcggaacta

SEQ ID NO: 57684 - DNA, 664 bp, Triticum aestivum
  unsure (1)..(664): unsure at all n locations
  Clone ID: PAT_TA_57684
tatcgcacgaggcaagcccggcgccgcagccaacggcggggtctccttttcagtggcaggggccatgcctatggccatggagaccccggtgaccgggctgacagctggcgggatctgatacactggagcggcgccagcgccatccagtggctctgggagcggtgaccgcggcgccggatccggtgccgctccagacgtggccagggccgaacgccgtactgagcctgaccggtatctacgcgtacatccacatgtccgaggggcggcacccagacgttctcaccatggtgacaagccgtgctgtagaagcacggcctcgacgtggaacgactgtgatctcggctgaccgtttccagggcatgtacaccatccaagctcgtataaacggaatgagcaaccaggtcgcagataatgtagtcgcgtgacgacatatacaaactggcggaagcggagataatggggacggctctgtgactaagagggaaacgatgcaaacctttgctggacgtagtagaagtttgtcggccgacgacatatgaggatcatatgtacagacgaacttaagctacgagttgtgatgataatacagacttataaatgtgagtcctggggctgtttcataaactgctctagcatgntaatacacgagttgcctgccttctct

SEQ ID NO: 57685 - DNA, 687 bp, Triticum aestivum
  unsure (1)..(687): unsure at all n locations
  Clone ID: PAT_TA_57685
cggacgcgtgggcttggatctggggatccagtttttgaaggctggatgagatctaccgagtcgagctacaaggataaattccgtggttgggttggatttagtgttccagtttcccacagaataactgcaggttgcgatatattgttaatgccatccagattcgaaccttgcggtcttaatcagctatatgctatgcaatatggcacagttcctgtagttcatggaactgggggcctccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacaaaagaccatacgtgggaccatgccgccgagcagtacgagcagatcttcgaatgggccttcgtggaccagccatatgtcatgtagacggggactgnnggaggtcgaagcggcagtctccttgagctcagaagacatgttcctcatccttccgcggcccggaaggatacccctgtacattgcgtggaacgcggtcctcctancatagtggcaatgcgcctgctttgcttggtcgccggttcttgagtaaatgatgggctgtgctgctgccggcggtgacag

SEQ ID NO: 57686 - DNA, 745 bp, Triticum aestivum
  unsure (1)..(745): unsure at all n locations
  Clone ID: PAT_TA_57686
ccagcttctcagcaagagccaggacaagggcaacaagggcaaatcccagcttctcagcagcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggcaacaaccaggacaagggcaacaagggtactatccaacttctccgcaacagccaggacaagggcaacaaccaggacaagggcaacaagggcactacccagcttctctgcagcagccaggacaaggacatccaggacaaaggcaacaaccaggacaagggcaacaaccagaacaagggcaacaaccaggacaggggcaacaagggtattatccaacttctccgcagcagccaggacaagggaaacaactaggacaggggcancnaaggggtactacccaacttc

SEQ ID NO: 57687 - DNA, 721 bp, Triticum aestivum
  unsure (1)..(721): unsure at all n locations
  Clone ID: PAT_TA_57687
gtcagcaacattctctattgtaaagcaatgccatgctttgggatgtttcccacgtgtgaagattgttcacacatcgaggtggatccatgggcagatatacattcctgaaataaattggatccttatggtgctatgtgtagctgtcacagttgcattcggtgatacaacccttatcggaaatgcctatggtattgcttgcatgactgttatgcttgttacaacattcttgatgtcatttatcgtcatctttgtttggcaaaagaacataatatttgccttgttgtttctattattcttcggatccattgaaaccgtgtatctttcctcatccctcatgaaggttcatcagggaggatgggtgcctcttgtgcttgctttcatattcatgtctgtcatgtttgtttggcactatggaacaaagaagaagtaccagtttgatcttcagaacaaagtgtcaatgagatcaatcctgtctctaggtccaaacctcggcantagttcgggttccgggaattggactgatttacacagaactggtgactggtgtgcctgccatcttcacacattttgtcactaatctccctgcctttcatgaagtcctagtgtttctttgtgttaagtcagttccagtgcccgtatgttcaaccagatgagcgatacctttggtgggtaggattggacctanagcgtattcggatgtaccgttgcattgtcagggtac

SEQ ID NO: 57688 - DNA, 613 bp, Triticum aestivum
  unsure (1)..(613): unsure at all n locations
  Clone ID: PAT_TA_57688
ttttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagggctccttccggccatctcagcaaaactcacaggcccagggctctgtccagcctcaacaactgccccagttcgaggaaataaggaacctagcgctacagaccctacctgcaatgtgcaatgtctacatccctccatattgcaccatcgcgccatttggcatcttcggtactaaatgagaagaaaataactctagtactagatatatgaaacaccgttttcttagtccatggtatggtcgttgtagcggtgaaaaaataatgtgacatgcactatcatgtaagaacccgaactatactagttcaaacttgggaataaaagacaaacacagngtcttgtctac

SEQ ID NO: 57689 - DNA, 775 bp, Triticum aestivum
  unsure (1)..(775): unsure at all n locations
  Clone ID: PAT_TA_57689
ggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaaacagggtactacccaatttctccgcagcagtcaggacaagggcaacaaaccagacagggggcacaaggatactacccaactttctcgcagcagtcaggacaagggcaanncaccagacatgagncacagcc

SEQ ID NO: 57690 - DNA, 606 bp, Triticum aestivum
  unsure (1)..(606): unsure at all n locations
  Clone ID: PAT_TA_57690
cccacgcgtccggccaacataatgccacacagggtataccctcagctggatccaacgcaaacacctgattgtatggtgtacaagatgcaggaacaagcaatgatcatttcactaattaacttgtacccactctatctcaataaatcattagtatgtgtgctcacacttcctctatcttaatttttgcaggagaggttcacatacccagcccttagggaatttagccccttgcctgagtctacatttattgcaaccgctagagaagcaatgccagtaggcagagtgacaatagaaatggctagggggagggtgaggagtcagcaagcaccacctgcaaatggagaggaagcaactcagtcaagtcagcaagcagcagctgcaacaagacccaagaaaaaacaagcaagagggggaggcagtgcagggagaggagcaacaaatgctgcaagaggaggaagaactgctgggaggggagaaagagatggtgcaagaggagnaaagaagtgctggtagaggaagaaatggtgcaagaggaggaagaactgccgctgatacattgagnaaaagaggtgctgctctgnaagatgtcagaggagcaagagctgc

SEQ ID NO: 57691 - DNA, 639 bp, Triticum aestivum
  unsure (1)..(639): unsure at all n locations
  Clone ID: PAT_TA_57691
cactacttggatgctggcagtgaggcaaagataactagcgtggtggagaaagagatgatagccaatcacatgcatagattggtccacatggaaaactctggccttgttaacatgcttatagatgacaaatatgaagatttgggtaggatgtacaccttattccgaagggttcctgatggtctatcaacaatcagagatatgatgacttcatacctaagggaaacagggaagcacttagtgacagatccagagagattgaaagacccagtggaatttgttcagtgcttgttaaatgagaaggataagcatgataagatcatcaatgttgcttttggcaatgataaaaccttccaaaatgctctgaattcatccntttgagttcttcatcaacttaaacaacaggtcacctgaattcattatcactgtatngttgatgacaaactccgcaaaggattgaaaggggcaacagagaaggatgtgggagggtatactggacaaagcataatgcttnnttttcggtaccttaggagaaaggataggtgttgagagaagtactataagcagcatttggcgaaaggccttctgtctgcaaaaatggttnctgatgatgctgagaaggggttttgatagtcaaactca

SEQ ID NO: 57692 - DNA, 707 bp, Triticum aestivum
  unsure (1)..(707): unsure at all n locations
  Clone ID: PAT_TA_57692
gatgatgatgactctgcccatttttctcgaacatctgaaatggttagacttaactctttgttattttctcaccatacaattttgtggtgatgcatcattgagcacttgcacttaagagtattgacattggtactgtgatttgagcctgacttgcaagaagcctctaatatctcatcaatccagactgttagctgataaatatttctaactaatccagaagcatgtggttaggttgtcatttgaatggattttttcagttgcatggtttgtataaatctgagatatgattgtatcacaaattactccatattttttccatatagctgtaaaattgggtaactttgctgtgacaaaaacaagttgtgtatatatgccactgttattgcgagaaactgagatatcagatcgattatgcttattatatcttatagatattgntcctgattgttgtcacctttttgtatcaaagtgttgacacttgcacttttttttatgcgagacacttgcacttttgtacaagttcatttatgtccactgcagggtaaccttgaagagaagcttgaacataagttgtaaccaaacattatgaaaagaggtctcacgctgtgaatatttagttgatgcactagtgtttttagatgttgcgcctctgttttcattctcttttgattcatgtatgtaaatttgatggaatgtatccgatgtat

SEQ ID NO: 57693 - DNA, 657 bp, Triticum aestivum
  unsure (1)..(657): unsure at all n locations
  Clone ID: PAT_TA_57693
tgaatagatattacaggcttgtgtttgacatatattttctgaattacgagcgcatatgtttttggttatgccttgccaaagcacgtgcacttagctagcagcattcaacatgcatgcatattttttaatatatgtttatatgttgacttttgtaggtctgagataaaacggatggcttcggatgatgctttgaaaatgtccgtcgacaaagtcacggacatgctatgacatactatgatggacgggactcaaatctcatcaagttttacacaatgagagatgcatagaaataattgttcttccttgtacatatgttgcacataataatacaaaaggtttatttctatgtatgtttatttttgcagagtatatatcaaagagatggagaaggattatgtcgatgttcaaaaagaatccatagacaagggtcccaaggcaatgtcgttggaaggggctgaaaattttctgagctttatacaacaatattggatatgcaagcagaaaaaaaaaggctaaggccccttttggttcatagggttggaataataataggaatataaaaattatagtaaatgagatgtcatgtatctcaaatcatatgaatagtaatataaaaagagatgtcctttcattcnnnnnnaannnacnnnnnnnncn

SEQ ID NO: 57694 - DNA, 666 bp, Triticum aestivum
  unsure (1)..(666): unsure at all n locations
  Clone ID: PAT_TA_57694
ggaggccgaggcagccgccgccggcgagcctccccttcgccgagatcctgtcgcgggtgccctaccggtcgctctgccgcttccggtgcgtgtccaaggcgtggcgagtcctctgctcccaccgggccatccaaaggagggtgccgcagaccctctccggattcttccacacccaccactcggacggcggcctccgtttcagcaatctctccggaggaggcgcccctctggtcgacgcttcgctccctttcctccgcaggaggtacgcgagcgtcaagctcgagcaatgcagcagcagccttctcctctgcagatgccgggaatcggaggatgacgaggaatgcgattacgtcgtgtgcaatcctatgacccggcagtggaccgtgctgcctcctatagtatggcaggacgaagaggatggtgaacctgcgtatttcagagtggtgcagcccttcctgggtctcaccccggccgttccgcccgtnttggggntgttttcgccctggttgaggtgtcgaacgatgtggcgatatactcgtcggaaaccgggcgatggactcggaacagtgagtgggggggacaacagcgagtatcctgctttttctgcagaatgtgccttcctgaatggtatgatgcattttctgcatttggtgaccgaggaaccta

SEQ ID NO: 57695 - DNA, 683 bp, Triticum aestivum
  unsure (1)..(683): unsure at all n locations
  Clone ID: PAT_TA_57695
cacaagggcatcaaggtcagcagctaggacaagggcaacaaggtcagcagccaggacaagggcagcaaccagcacaagggcaacaaggtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacaagggcaacatgggtactacccaacttctccgcagctgtcaggacaagggcaacggccaggacaatggctgcaaccaggacaagggcaacaagggtactacccaacttctccgcaacagtcaggacaagggcaacaactaggacaatggctgcaaccaggacaagggcaacaagggtactacccaacttctctgcaacagacaggacaagggcagcaatcaggacaagggcaacaaggctactacagctcataccatgtntagcgtggagcaccaggcggccagccttaaaggtggcaaaggcgcagcagc

SEQ ID NO: 57696 - DNA, 804 bp, Triticum aestivum
  unsure (1)..(804): unsure at all n locations
  Clone ID: PAT_TA_57696
gccgggacaagggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaggggtactacccaatttcntcgcagcagtcaggacaagggcaancaccaggacaaggggcacagggatactacccaactttctcgcagcagtcaggacaggggngcacaccaggacatgagcaacagccagggacatggctgcacca

SEQ ID NO: 57697 - DNA, 522 bp, Triticum aestivum
  Clone ID: PAT_TA_57697
gcggcggagcgtaaccagatcgtggcaaggccgagagaaaggcaagtgtgcgcactcttacgaaatttactgcggaaagaccggggaagcaactgactgacccgtttgttgtttgggggatttgggtgctgctgcagaaagccgcagggtcgggtccaaaggttagtcactgttcggttcttcctccttccagcaatgcatcaaattatctgtagaacaatcgagtgatgagtactgacctttgtgctgtgtgctcaggatgatgaccagcctgctcgggccgaagccgccgacgtatgaacagaacggctacagatgaactatgattgtactctggagcaagatgctcgcagctcgattcattccattggtgacatagtgtgacgtgattggtgtgggatttgtgtacttgtggtgtgtggatctttattgcatcggttgttgtttggaaacatgtaacaaagatcaaaactgcccatggcaacaactgataataatacaacaattgaagaatttgttcta

SEQ ID NO: 57698 - DNA, 737 bp, Triticum aestivum
  Clone ID: PAT_TA_57698
ttctggcttgcgtgtcttatatgatacataaatttgtactcttatcacatgtctataggaaagaatgcacaacacaagttttttaggcatttggcatgcagggtagatgttatggtttatgatatgctcggtatcacccgagtatttgcttggcttagtcaatgcttgtgttgctttggcatatgcttataagatgagaacttccacctgaatgtccagattattttgattgggcatatccagattgtattgtgtagccatggtgccctcagttcaccattctgttagttttaattagtttcaagaaactggcccaatctatgatgtgatgctacagtaatatgacagtattgttttgcttcatgtttttataactcaaaatcatagttgttaccttcacagaagaaactcttgtgttaaagttgaacaaaggtttttctatttgcatattttctctttctattcaccgtattgttttaagatcatctgatattagctagccaatcttccagtgcttgcttgtctatctgtaaattcacctgcttgtcacatatacactgaaatttctgcacttaaaaaacccagaagctgctcattctattcagaaacacacatgtaaccattactgcccgtgctgtatttcaggtggacatgagctgagcaagagcactggaaacgctggtgcccgtgttgcttgcgggatcatcgggctccaggcttagatgtcatcttcgccg

SEQ ID NO: 57699 - DNA, 818 bp, Triticum aestivum
  unsure (1)..(818): unsure at all n locations
  Clone ID: PAT_TA_57699
aaggacaagtgcaacaaccaggacaagggcaacaactaggacaagggcggcaaataggacaagggcaacaatcaggacaagggcaacaagggtactatccaacttctccacagcagctaggacaagggcaacaaccaggacaatggcaacaatcaggacaagggcaacaagggtactacccaacttctcagcagcagccaggacaagggcaacaagggcagtacccagcttctcagcagcagccaggacaagggcaacaagggcagtacccagcttctcagcagcagccaggacaagggcaacaagggcagtacccagcttctcaacaacagccaggacaagggcaacaagggcactacctagcttctcagcagcagccaggacaagggcaacaacggcactacccagcttctctgcagcaaccaggacaagggcaacaagggcattacacagcttctctgcagcaaccaggacaagggcaacaagggcattacccagcttctctgcagcaggtaggacaaggacaacaaataggacagctaggacaaaggcaacaaccaggacaagggcaacaaacaagacaagggcaacaactagaacaagggcaacaaccaggacaagggcaacaaacaagacaagggcaacaactagaacaagggcaacaaccaggacaaagggcacaggggtactatccaacttctccacaacagtcgggacaagggnncaacaccagnacatcacnnacaccaggacaaggngcaacaggggtactactcaagttctctacaaacagccagacaagggctacaagggcacta

SEQ ID NO: 57700 - DNA, 772 bp, Triticum aestivum
  unsure (1)..(772): unsure at all n locations
  Clone ID: PAT_TA_57700
cggacgcgtgggttcgcagcaacaacaaccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgcccgntgtatagaaccaccactagtgtgccattttcgtgttggcaccc

SEQ ID NO: 57701 - DNA, 335 bp, Triticum aestivum
  Clone ID: PAT_TA_57701
ggcgatggccccttcctgtcagctacaacatcagctcataaattaccttcttctagtgccagaactctaacaagaaagcatggcgttggtgcaagaaggactttgtttgccaccaaggaaaaagccaccaatgcttagatgccaagggatcaattagcaacaacacaagttctattagctcgtgtagtatatgttggaactcttggttgtacgcttttgagtagcctatatgagctaacaaacaaaacacctcttctatatcaatgtattatactttcatgatttcatctactaaaaatgcttctacaatctatttatcatttgtatgcttttat

SEQ ID NO: 57702 - DNA, 698 bp, Triticum aestivum
  unsure (1)..(698): unsure at all n locations
  Clone ID: PAT_TA_57702
ggcatgcacaactcagaccatttctcttttgcattttgcagtagttatactattttgatggcatgaatcaaataccaactttacttactacctaatattctggtgtttgagtgataccgatagcttttgcaatgcctaaatttagctcggtgaattgtactcttcgtgtgttaccaatttgtggatgtatagctatgaatagtactgatacatacaatttcgcctcttctctgtagactttgaaggatgaagaataaagaacattctatgatcaggtaacaatttaatccctctgattacacttgtctatgctcctttgactgccaatggctatttctttttgtatgttcaggagatacaaagaattaattgtttgaaacttaagataattaagtttgcaagagtcatcaacctgtctaaaaaacttcattgaattctgcacataacaaatntattaggaagatttctcaaatcatgtaaatgattctagatcagccatctaactccaataccatgcaccaatgcttggaactcatgcaagtgtcatactcgcattaccaaatcaggctacgaagacaagtncttcgtgcgcacaatgtatgaccttaccgtctggnncggtggtaattattttctaaagaaaaaactactctcattaggctctaaatttgcanagtaactaaacaacaatacatatt

SEQ ID NO: 57703 - DNA, 746 bp, Triticum aestivum
  unsure (1)..(746): unsure at all n locations
  Clone ID: PAT_TA_57703
ttcctcctagctctccttgctcttgtagcgagcacaaccttcgcgcaatactcagaagttggcggctggtacaatgaagttggcggaggaggtggttctcaacaatgtccgcaggagcggccgaagctaagctcttgcaaggattacgtgatggagcgatgtttcacaatgaaggattttccagtcacctggcccacaaaatgtggaagaagcggctgtgagcatgaggttcgggcgaagggactgcaagcagctgagccagatagcaccacaatgtcgctgtgattctatccggcgagtgatccaaggcaggctcggtggcttcttgggcatttggcgaggtgaggtattcaaacaacttcagagggcccagagcctcccctcaaagtgcaacatgggcgccgactgcaagttctctagtggctattanctggtgatgatatagcctctattcgtgccaataaaatgtcacatatcatagcaagtggcaaataagagtgctgagaatccgtacagggtcaaagccaaagccaaaagtttaaagatgagcaccaaaaagttcaccgtttcaacaggnagatgtcattgcattaccggcagncattgtacatttggttctacaatgacggtgatgcgccaattgtgctatcttatgntttncgacgtaaacaactatgctaatcaacttgagcctagcataaggaatttttttgttcgctggcactattataggagttcgcaacttc

SEQ ID NO: 57704 - DNA, 664 bp, Triticum aestivum
  Clone ID: PAT_TA_57704
gacaagggcaaccagggatactgacccaactctctttagcgggagcacacgacgaataggcagcacaccacagacgacgggcagtcaacgcacgacgacgggcaacaaggctcagcagcctggactgggacaacaatgacggacaaggacaacagggatactacccaacttctctgtaccagccttgacaagggcaacaactgggacaagggcaaccagagtactacccaacttcacagcgactcggaacaaggccagcagccttgacagggaaaacaaccacgacgaggacaacaagggtactacccaacttctccgtaccagtcatgactggggcatcaatcacgacaagggcaacgagggtactacccatcttatgtgtgggaaccaggacaagggcaacaaggctacgccagcccataccatgttatcgcggagcacctggcggccctgctaaaggtggcggaggcgcaccaactggcggcacagctgccggcaatgtgcctgctggagggcagcgactcattgatgaccacgcagtgattgaactctctgcagcttgcatggtgcttggtcatgcatgcaccttagctatacatatacgagacgtgtgtgtacagctttttcgtgctactagagtaaagcccaataataatgcacgatg

SEQ ID NO: 57705 - DNA, 620 bp, Triticum aestivum
  Clone ID: PAT_TA_57705
gcccagtatcttgatatattactgccaccattactcgaaaaccggctgcaacttcccaactctgacatggatctatttgcgcatcttgattgcttacacatttatggtacaagcacattgctaccagctatctgtgtcattttgctgatcagtagtttgggatgcgtatgattcttatccaaactcagcagttggcaaaggttgatcctgctgcagcaggtgcgttgtatgataatgaatacattgcctgttcattgaacctgttgtcctggacttacagatggacttggtggcggcattgaaagtctggctgcgcaaagcatcttgagagatctacttgtgaaatgctgcgtggatgacgcacctgatgtttgacaaagtgctctggtccttcttggcgacatttttagggtctggcctatacatattcagcctcgcctccaagaattacttactgctgcagaaagagcaattgacttcacaatctgcaaaagatgctgtgtcagtttgctaacaactgcttgttggaccattgcagaattaacaatcatgattggcaaggatatttcacctgtggcgatcatttgtcgctacatgccttggtttctattctaacaacc

SEQ ID NO: 57706 - DNA, 712 bp, Triticum aestivum
  unsure (1)..(712): unsure at all n locations
  Clone ID: PAT_TA_57706
gggcccagcagggcagaagaaacacaaagccatgtgcacagaatgtacttcatgggacctaatacattccgagaaccgtggcatcttccttactcgccccctgaatctataattggcattgtgtatgaagatgcttttaatcgttttatcgatgagataaatttggtagcagcctttgagtggtgggaaggttctgtgcatagtatacttgcagtacttgcatatccttgtgcctggtcttggaagcaatggcgcagaagaaagaaaatccatcgtcttcaagaatacgttaaatctgaatacgaccattcatgtcttcgctcttgcagatcacgggctctatataaagggctgaagggttggttcaactccagacttaatggtcgcttacattgatttctttctggngaggtgatgagaaacgacttgatgtagcggccacaatccgaaagaggttcccatgntgtttaattttggcggtgaggggagctatatgtccccataccacctacacagtgatacattactgtcaaatcttcttggcccagtatgtgtctactgcgatttggaacagattagtagctggcttgaatactcagtntgagggtcagtaaagcaaggcagcatccggtcactcttgtncccgggnttgtttcttggattaagagtcatgggaatccccaacttgacgacnatggtggttcgagtaagc

SEQ ID NO: 57707 - DNA, 533 bp, Triticum aestivum
  Clone ID: PAT_TA_57707
aaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaatattaaataaagaaaaacaaaaaacaattcactggcacgtaaatttacaatgtttggggctggcgttttccatggagtcgcccttctttttcgcgttggggcacgttctcatttcttctgtgggggccccaatttttttgcctgggccgcttgttccttccctccgggtggggggactgattggggtttgcccctttcacctgttgtggagcattaccccttttgggcgggggggttacccccaatggggccgctccatttgcccgttccctagcgccccctcccttcactttaaagggtgcttcctcgggagggtcgccggcttcccccgggatgttctggatttccccctgcgttccgggttcttttttcgtgccttacggccccttgacttcgcttttcttgcttttttttttggctcatgtagcggtctttccc

SEQ ID NO: 57708 - DNA, 726 bp, Triticum aestivum
  unsure (1)..(726): unsure at all n locations
  Clone ID: PAT_TA_57708
gcgacaagtaccattgcgcagatggagactagctgcatccctggtttggagagaccatggcagcagcaaccattaccaccacaacagacattatttccacaacaacaaccatttccacaacaacaaccaccattttcacaacaacaaccatcattttcgcaacaacaaccaccattttcgcagcaacaaccaattctaccgcagccaccattttcactgcaacaacaaccagttctaccgcaacaatcacctttttcgcagcaacaactagttttacctccacaacaacaataccaacagcttctgcaacaacaaatccctattgttcagccatccgttttgcagcagctaaacccatgcaaggtattcctccagcagcagtgtgccacaacgtcttgctaggtcgcaaatgtggcagcagagcagttgccatgtgatgcagcaacaatgttgccagcagttgccgcaaatccccgaacaatctcgctatgatgcaatccgtgccatcacctactccatcatcttacaagaacaacaacaggngttttgtccaagctcagcagcaacaaccccaacagttgggtcaagggtgtctcccaatcccaacaacaatcgcagcagcagctcggacaatgttctttccaacaacctcaacagcaactgggtcaacagcctcaacaacaacagatactacagggtacctttttgcagccacaccagatagct

SEQ ID NO: 57709 - DNA, 774 bp, Triticum aestivum
  unsure (1)..(774): unsure at all n locations
  Clone ID: PAT_TA_57709
caaccaccgccacaattgcagttagagttccagtgccacaattgcagccacaaaatccatctcagcaacaaccacaagagcaagttccattggtacaacaacagcaatttccagggcagcaacaaccatttccaccacaacaaccatatccgcagccgcaaccatttccatcacaacaaccatatctgcagctgcaaccatttccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcaacaacaacaacaacaacagatccttcaacaaattttgcaacaacaactgattcncatgcagggatgttgtattgcaacaacacagcatagcgcatggaagctcacaagttttgcaacaaagtacttaccagctggtgcaacaattggtgttgtcagcagctgtggcagatccccgagcagtcgcggtgccaagccatccacaatgttgttcatgctattattctgcatcaacaacaacaacaacaacaacaacaacaaccgttgagccaggtctgcttccaacagtctcaacaacaatatccatcaggccagggctccttccagccatctcagcanaacccacaggcccagggcttctgtccagcctcaacactggccccagtttggaggaaataaggaacctagcgctagagacgctacctgca

SEQ ID NO: 57710 - DNA, 696 bp, Triticum aestivum
  unsure (1)..(696): unsure at all n locations
  Clone ID: PAT_TA_57710
ccgcgctccattttgatagtcaccgcagggaacgactacaagagaaagacgcacaaggtgtccgagatgcgccggggatggggaaggtcatgcgtcgctgcgccgggaggcagcatctactccgctagaagaatgctaagcaaagaatttggatcagatgtcaatagcgcaggggcaggggggctactcgatgggccaaaaaagccgaggtttggttgcagttcccagatgcacagcagtggtgcggcgactcccatatgcacaacggtggcgcgatgactgcgagatgtacagaagtggtagtgatgacattacgcggtgactgtggactgtgacgtcaaaggacaaaacatggttcagattcataagatattttgacgatgcatggcttagacgttgattgcatggtccagaatggtgctgcatgatagtcttatcatctgattgcaaggtcagaatggttgtntgttgctggatagttttatcatctgattgcaaggtcgagaatgggtgttgctgctatatagtcttatcatctgattgcaaggcgagaatggggntnggcttggtggataatctatgggtaatggttttaggatatcattttccagtggtcaatgtttcaaaacttctaatttcgaatagttgagaaaaatgattgaaaggtccagattgggctagtattggtatcttttg

SEQ ID NO: 57711 - DNA, 709 bp, Triticum aestivum
  unsure (1)..(709): unsure at all n locations
  Clone ID: PAT_TA_57711
catcatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaagaacaacaaatccttcaacaaattttgcaacaacaactgactccatgcatggantgttgtattgcagcaacacaacatagcgcgtggaagatcacaagttttgcaacaaagtacttaccagctgttgcaagaattgtgttgtcagcacctatggcagatccctgagaagttgcagtgccaggccatncacaatgttgntcatgctattattctgcatcacccacanaaccacnnacacactatcgagccagggtctcttcaacagcctcag

SEQ ID NO: 57712 - DNA, 728 bp, Triticum aestivum
  Clone ID: PAT_TA_57712
tttccatcacaacaaccatatctgcagctgcaaccatttccgcagccgcaactaccatatttgcagccacaaccatttcgaccacaacaaccatatccacaaccgcaaccacaatattcgcaaccacaacaaccaatttcacagcagcaacaacaacaacaacaacaacaacaacaacaacaacaacaacaacaacaacaacaacaacaacaacaacaacaacaacaacagcaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggctatctcagcaaaacccactggcccagggctctgtccagcctcaacaactgccccagttcgaggaaataaggaacctagcgctacagacgctacctgcgatgtgcaatgtctacatccctccatattgcaccatcgcgccatttggcatcttcagtactaactgagaagaaaataactctagtactagatatatgaa

SEQ ID NO: 57713 - DNA, 653 bp, Triticum aestivum
  unsure (1)..(653): unsure at all n locations
  Clone ID: PAT_TA_57713
gcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagataggaaaagggaaacaagggtactacccaacttctctgcagcaaccaggacaagggcaacaaataggacaagggcaacaagggtactacccaacttctccgcagcacacaggacaaaggcaacaaccagtacaagggcaacaaataggacaagggcaacaagggcactacccaacttctctacaacagccaggacaagggcaacaagggcattacctagcttctcagcagcagccagcacaagggcaacaagggcactacccagcttctcagcagcagccaggacaagggcaacaagggcactacccagcttctcagcagcagccaggacaagggggcacagggcactacccagcttctcagcaagagccaggancaggggcacaaggttcatgctgctcct

SEQ ID NO: 57714 - DNA, 711 bp, Triticum aestivum
  unsure (1)..(711): unsure at all n locations
  Clone ID: PAT_TA_57714
caacccgatccccctctcgtttatgtgggtcgattggatcctctcccctaagattgattggcgtcgtcgcggtggctggctgggtgaaattttgttgcttcgatgtgctaggtttagttagtggatgcgattgggaataggcaggtagccattgattttgcgttcctcagtttgttgcggtccatgtatgaggggcagcgccgtgggtatatactggttatatgaggcccgggtttccttgtagtaggttgcaagtgaaatcgtcgtgcagttttgtccggtgcgcgcgcctgggtctgagattaggaggcttatataacagcttatgtcacgtgatagcaagtaccgcgtgtttcataggcagtaagtggacacgccgtgttctgattgatgcatatctgcaagcttgctacttgttgatgcctaatagtaattcatactgtattcattcatactcttaccatgattatttgatggacacgttgttgtagttcgtctattattaggctttggtaggtgacaagatattcttatcattagaatttgtgatgcatccaaatgtatctctttgtgcttctgttaacccaatatgccgctattaatttcttgactgatcactcantacacatatgggttgaaaaaatctatttcgncattttcttatttctcttgggctttctattttatgaacttttctagcatctatggaaa

SEQ ID NO: 57715 - DNA, 736 bp, Triticum aestivum
  unsure (1)..(736): unsure at all n locations
  Clone ID: PAT_TA_57715
caaggaccggatgttcataacggccacggagtgggcgacagagtggggtggcgccaagaacagggaggccatcgcgccattccagcgcctccccttctactgctgcgcgctcacgttcctgccatttgaggatccggtgtgtacggcagatggaagcgtcttcgatttgatgagcataatcccatatattaaaaaattcgggaagcatccggtaactggaggagcactgaagcaggaggatctaattcctctcactttccacaagaacacagatggagagttccagtgtcctgttttaaataaagtttttacagaattcacgcatatagttgctgtaaagactaccgggaacgtcttctgttatgaggcaatccaggagcttaacgttaagccaaagaattggaaagagttgctaaccgatgagcccttcgcacgaaaggacttgataacaattcagaatccaaatgcgcttgataccaaggtcctagggcaatttgatcatgttagacaaggcctcaaacttgantgatgaagagttgcagcggatgaaagatgatccaacctacaacataaatgttgcccggtgatcttaagcaaatgatgaaggaacttgngactgaaaaaggaaaattagcttttctgatgggtggtgggaggacagaaagctcaaaaggaaagagctgccgcactggnctgtccttttagcanaagaagagnaaagagtgactcgaaatcg

SEQ ID NO: 57716 - DNA, 698 bp, Triticum aestivum
  Clone ID: PAT_TA_57716
gggcaacaaccaggacaagggcaacaagggtactatccaacttctccacaacagtcgggacaagggcaacaaccaggacaatcacaacaaccaggacaagggcaacaagggtactactcaagttctctacaacagccaggacaagggctacaagggcagtacccagcttctcaacaacagccaggacaagggcaacaagggcactacctagcttctcagcagcagccaggacaagggcaacaacggcactacccagcttctctgcagcaaccaggacaagggcaacaagggcattacacagcttctctgcagcaaccaggacaagggcaacaagggcattacccagcttctctgcagcaggtaggacaaggacaacaaataggacagctaggacaaaggcaacaaccaggacaagggcaacaaacaagacaagggcaacaactagaacaagggcaacaaccaggacaagggcaacaaacaagacaagggcaacaatcaggacaagggcaacaagggtactatccaacttctccacagcagctaggacaagggcaacaaccaggacaagggcaacaagggcagtacccagcttctcagcagcagccaggacaagggcaacaggggcagtacccagcttctcagcagcagccaggacaaggggcacaagggcagtacccagcttctcaaacacagccaga

SEQ ID NO: 57717 - DNA, 185 bp, Triticum aestivum
  unsure (1)..(185): unsure at all n locations
  Clone ID: PAT_TA_57717
acattgtcttgatacaactttattttattttatttcagaatttaaacaactagtatgggcgggtccacacgacattgngngacactttctttgtcgccgctgcgtcgccgtctccgtcgcctgtcctgcggcgatccctcttctnttcctagcgacctttccttgcttgcgtgcccctcgcgggg

SEQ ID NO: 57718 - DNA, 457 bp, Triticum aestivum
  Clone ID: PAT_TA_57718
tactatgcattactactggtgaatggaagggaccagtgtgactttacaggctgatgctgacaagtaccgagcgacaatgttggacgtgacctggaccaatgatacgtgctacgtctagatccaaccgaaagttgagatgctcaacgatgtggcgctgcagatctttcgtgctatggtatcttgcacgccgttattacgcaacaacaacaacgatcgtgactagctacttgcacccaaccttggcacatggaacttcaagggcaccacacctacaggggactgagatatagccagccacatcatcaaactcaacgtggatcacatgatgacattgatgggatagggacatgactgatccagaccatcccgggagtgagcacatggcatgctccagcatactgcttcaccaccatatcaccatgcagcgacgtcactaccgacatgggccgctactgag

SEQ ID NO: 57719 - DNA, 478 bp, Triticum aestivum
  Clone ID: PAT_TA_57719
cttttagtaaccaaagtccagatgttcgaaagagtgttgtattctgcttggtggatatctacatcatgctcgggaaagcattcgtcccgtacctggaagggctgagcagcacgcagctgcgcttggtgaccatctacgccaaccggatttcgcaggcaaggtccggcacggcgatcgacagcgctaaccaatgagatgtaacattcttctgttttatatggacatttgtttggtagggtgtgggatttttggggggtcccgtttgtttgtgtaggtttgtgtatagtatataagcaaacgattcccttgtattggggagtttcctggctttggttctttgtgtgattatgtattccttctctttttttggttagcatgtggagaggagagtgttagcgagcgtgtgttgtcttgggttgtacaactaggtgacaatgtacaaagaaaggagatgtaacgtactggagaaagtgtgtgc

SEQ ID NO: 57720 - DNA, 473 bp, Triticum aestivum
  Clone ID: PAT_TA_57720
gttatggtcgcgtcgccgtacctaaccaagacgcagtgctgtggagagcttgtaaacatttggcatgagtgccgatgccaggcgctgctctatttaaaggagctcgctttctcgttcggactatagcagtctactgctactctcctctagccctagctaggaggagactgtctctgttaggatcctccggacgccagaggactgtgacttgacgaccgcatacccactatcgcaccgcctcgctaaggcggagcctcatcggcactggaaacaatcctctctatcatgaatgaggaatcatgtggtaacaattcatgcgtcacatgctgatatgcagttaggacgagcatacgaacgctgatcatgactggtgctgagcgctacttagagtgcatgcaagaaagaggacacagatgtcgatggaattgtttctctgaacttccagctgcaccaccctacatggcgccgacggt

SEQ ID NO: 57721 - DNA, 746 bp, Triticum aestivum
  unsure (1)..(746): unsure at all n locations
  Clone ID: PAT_TA_57721
gccaggacaagggcaacaaggtcagcaaccggggcaagggcagccagggtactacccaacttctccgcagcaatcaggacaagggcaacagccaggacaatggcaacaaccaggacaagggcaaccaggatactacccaacttctccgttgcagccaggacaagggcaaccagggtacgacccaacttctccgcaacagccaggacaagggcagcaaccaggacaattgcaacaaccagcacaagggcaacaagggcagcaactagcacaagggcaacaagggcagcaaccagcacaagtgcaacaagggcagcagccagcacaagggcaacaaggtcagcagctaggacaagggcaacaaggtcagcagccaggacaagggcagcaaccagcacaagggcaacaaggtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaatggcaacaaccaggacaagggcaaccagngtactacctaacttctccgttgcagctaggacaagggcaacaagggtactacccaacttctctgcacaaccaggacaagggcagncaccaggacaatggcnnacatcgggacagggggcacatgggtactacccaactttctcgcagctgtcaggacaaggggcacg

SEQ ID NO: 57722 - DNA, 254 bp, Triticum aestivum
  unsure (1)..(254): unsure at all n locations
  Clone ID: PAT_TA_57722
cagaatatagcatgaacaacattgtggatggcttggcaccgcgactgcttggggatctggcacagctggtgaccacacaattgttgctcccgctggttagtgctttggtgcgaaacttgtgagcttccctgctctttgctgtgtttttggcggttcgtctttttgggtggttggcttttggtgttggggggggtggctttcntcctgctcgtttcctttcctccctttttgggtccctttgcatggttgctctt

SEQ ID NO: 57723 - DNA, 324 bp, Triticum aestivum
  Clone ID: PAT_TA_57723
caaccgggaaatcttggggcgcagaataagatttatgcctgctaaactgaaaacggggggtggcggcgcttggaccgaccacaatggcattgagctgacaaggacccatccaccaagcctgccctgtgaaagcagcgcgctagcctgggagaccttaaatggcatggcgtcaaagctgaacagtagtaccgctaacaacagaactgcagccgtgaagccagacactgacgaggacaccattctagccgtcacagataccgtgaggctctcaatgataaaagtatcactatcgtacatcttcctaggaaacacattctcccgagg

SEQ ID NO: 57724 - DNA, 765 bp, Triticum aestivum
  unsure (1)..(765): unsure at all n locations
  Clone ID: PAT_TA_57724
caaccatttccaccacaacaaccatatccacagccgcaaccatttccatcacaacaaccatatctgcagttgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaacaacaacaaccgttgagccaggtctccttccaacagcctcaacaacaatatccatcaggccagggctccttccagccatctcagcaaaacccacaggcccagggcttctgtccagcctcaacaactaccccagttcgaggaaataaggaacctagtgctacagnacgctacctgcatgtgncatgtctacatccctccatattgcactatcgcgccatttgggcatctttggtactaattgagaagagaataactctagtactagatatattaaacaccattttc

SEQ ID NO: 57725 - DNA, 570 bp, Triticum aestivum
  Clone ID: PAT_TA_57725
gctatttgcaatacgactcactatacgggcgagacggggcaccgtccgcggcacattaggtcttgccgcactgggatcttgggactctcgacggagaaccttccctaacattcactccgcatcgggtaaaagacgttggtccctcctcgtactaccaatggtttgagaccaagacaaagtgatggatggaactaccctttttttctgcggcggacgggactagggcggctttattccctggacaacaggctctgcttcgatacacagttgggagatctctgccgcccccctacggcggttatgggccgccgctctcggaacagatgccgtggattccccggatgaagggcggggacgcactgtcccgctctcggcgatagaattgtctgtggctcgcgtgaggcttatgcttgcctgcactttagctatacgatagaatgcgacttcgtgtacacagccattaatgtctctagagtaaagcccacctactctgcataatgagaagctattctgggtggcttgccaccgcgttctcacaacggagctgggcgagttaccgccgggctctct

SEQ ID NO: 57726 - DNA, 260 bp, Triticum aestivum
  unsure (1)..(260): unsure at all n locations
  Clone ID: PAT_TA_57726
tgagctatagatctctcgctctgttcacttggcctggtcggggtcacacatgatggtgcacaccactttatttgtcatcgctacaacgattggtgcatcagctaagcaatgatgaatcttgcatttcttcattggccaccaatgccagcgtntatgnnggcntcgggggccagggnagggngcccgaacnagaggcgggcggacgccngggncgccccggaaaccccggaccgggaccggcgggcggacccgcgccccct

SEQ ID NO: 57727 - DNA, 410 bp, Triticum aestivum
  Clone ID: PAT_TA_57727
tgaaccacctttcatcccagtgtcgtgcagtcagatggcatcaaatcaaacatgacaacaagttgtgccatcgaacaattgagacgtgatggcatctcccttatccttctggaattggttccaatctacatcagaacaatcaaactttaacggaaggatgtagtattctttcttccagtttcttaagggacatatattaaagccttgattttctcaactatgtaaaaacatttcaaaccgttgttcaaactattgactactatattatatattttgttagcacagacagaaggtaaatagagcaactaatgcaatatatttatgtagttttgtaccagtaataggagattatgttgcaacaatatgtagatttttgtaatctacaaagtttaccaagatgaatattcgtc

SEQ ID NO: 57728 - DNA, 246 bp, Triticum aestivum
  Clone ID: PAT_TA_57728
ccgggattttggcattacctccaagattaatgaaggcgaaatttggaatggagtttgctaagccaattggcaggattattcatgtggaatcagatgctgatggacgatgctggggtgcctacatgcgtgtccgtgtcgagattgatgtgcaagagcctgtgattcgatatgtgactgtgacctcagcgaagttaaagacaactgagatgtactctgtaatgtatgagaaacttcctttttactgct

SEQ ID NO: 57729 - DNA, 231 bp, Triticum aestivum
  Clone ID: PAT_TA_57729
accacatagggtactgatgagaaagcatatccaggaagtgtgatgaggctgcatgacagcgaaatgcagtatcctcacacaacaataatgtgcgtgagccagagataccaacgcagctgtctccgggggcagcggcactgttcgagttcttaccacccctgatcagaagagagctgctcctgcatcaagaagctgacgactatgtccaaagggcccacaggtgccccgaac

SEQ ID NO: 57730 - DNA, 315 bp, Triticum aestivum
  Clone ID: PAT_TA_57730
gcccgggaatctccgggggcgggaccccgcgcgccggcgcgagccctatactaggcacagctccggcacggtctcgcacgccggctagcacatagcagggagcggcgagcgcagaacaccggacgacggcagggagaagcgagggaacgcggtcgaggagcacggaagggacgagcgaggcaggagcgagcacggccacgggggcgagcaggagaaatcgaggggctacaggcaggtgaggggccagatcaaggaggggccggtgatcgggctccccgcgggcgacccggagacggaagcggccggtaacgaggg

SEQ ID NO: 57731 - DNA, 587 bp, Triticum aestivum
  unsure (1)..(587): unsure at all n locations
  Clone ID: PAT_TA_57731
gttcatctgtattacaacatcatctctcagccttgtttggtctgcaaaaatataactgatgctgagctattgcacaagtactctgtgttgcattctcttcctttggacaagagctgtaagatagtcagggactttcttatttctgctaccgcgaaggactgtagcctcatgatgtgctttcggccacgagagtgtgagagaacagatcctgagtatgattcagtgtttcttcagtcagtgaaccgaacctatgattacaaggcatactttgttgatctggatgtgaagcctctggataagatgacacattattttaaattggaccagaagatcgtcaatttctacactaagacgggnggaagtcgattctcagaaggggggttggcaccagtgatgacacagcggttcagccacaacattgagtagctccttcaacttgaagcctctggaccggaaagggcacatgtgccattggtccctgttggtttcgtcttgcgcctgtgtgttgtaacctttgtaagtacagctccattgtcgaggagctcttccctttcatcgggaaaaaaagatgctgccgagcggtcact

SEQ ID NO: 57732 - DNA, 657 bp, Triticum aestivum
  Clone ID: PAT_TA_57732
gacagatgcatacgtttcacacaaagcagctatcaacgccactggaggcatcagcacagacaactctgctgactagcgcttcaaaacattacctatcacgcgagcaggctaccaaggaacgaagcacttgtaggatacatcgctgtctgagacattgaaaccatgccagaggatctcaaaacacatactttttggctcggcagcaacatctccagattcagatccttccataactcctggaatacctcttgtactctaccacgacactagccatgaaccacctgaggagattgcaggtgatcgtactggaggatcaaacattgacctaccagctggggaagcataataagtggacaggagaatgcacatacccagcacaagtgagcgatccgcattcaaaggctgtgcagggccttctatgatgatgcttttacgccagtgctgcacacactatgatgctcctaaagagccgctcgtgctctccatagcatagacactgtcactgttggacctgtgctgattgcagactcctgatctgctctacaacatgagtgctcttgctatgctgatcttctgacccaatatgatgactgtaagaacctaaagatggagacactagctgctgtgtgcaacgtctataatcatagctatagctgc

SEQ ID NO: 57733 - DNA, 672 bp, Triticum aestivum
  Clone ID: PAT_TA_57733
gttcggtgtcccagtaaaagaaatcctgtaccatcatgtactgatcaaatacttccccatttaaaacatgagtaaggtggtggccttctggtttgattgagttgtgtatagcggcaaatgaggggttcgagactccacaattgcattacttgtttttgttttctttatatattttttaaatcaaaagaggtctggtggggttgacctcaccaacaacttgaattgcagctctctcagattgttgacaggatttcgttaaatatgtgcaggtatgcgctatgtgtagcgcggaagtttctacctcaacaaacaagaggtatgcgcaatgtgtagcacggaagtttctacctcagcaaacaagcaggcatgaccaatagttggcacttcaagttataccgaggaaaaagaagttggcatttgggagtatgtagtagcagcatcatttatattatctttgatgtttaaaccagagcagcaaaaacttgtacaaacttgtgaagggacaaacttgtacaaattatctcatgctttagttttcagtcgcagagatatcctgagaaatatttgacttctagttattctttggaaagtttcatgattattcattaaagcacagagatatactgggaaatatttgattaataatatatatatactgggaaatatttgatt

SEQ ID NO: 57734 - DNA, 755 bp, Triticum aestivum
  Clone ID: PAT_TA_57734
ccatttttgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacagcaactagttctaccgcaacaacaaataccatttgttcatccatctatcttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcagcaacaacaacaacaacaacagggtcagagtatcatccaatatcagcaacaacaaccccaacagttgggccaatgtgtctcccaaccccaacagcagttgcagcagcaactcgggcaacaacctcaacaacaacaattggcacatggtacctttttgcagccacaccagatagctcagcttgaggtgatgacttccattgcgctccgtaccctgccaacgatgtgccgtgtcaatgtgccgttgtatagaaccaccactagtgtgccattcggcgtttgcaccggagttggttcctacta

SEQ ID NO: 57735 - DNA, 556 bp, Triticum aestivum
  Clone ID: PAT_TA_57735
gcgatccggcgacgggctacaaggtgagcgcactcacgggctgccgggcaatggtgaagctccagtgtgtgggcagtcaggtgcccgaggctgtcctaagagattgctgccagcagctggccgacatcaacaacgaatggtgcaggtgcggggacctcagcagcatgttgcgtagtgtttatcaggagctcggcgtgcgtgaggggaaggaggtgctcccaggttgccggaaggaggtgatgaagctcacggcggcgagcgtgcctgaggtctgcaaggtgcccattcccaacccgtcgggagacagagcaggtgtctgctactgggccgcgtatccggacgtctagtcaagcgaatctgcatcttaattggtgcggtgcgtgcgcacaagataaataaaattaagtaatggtgcggtgcgtgcgcacaagataaataaaattaagtaatggtgtatgtgcctctgcgagatgcatgggtcatgaataaatgtgaactttgtttcctgttgaatgcaagctcacaagttttgcaacaatgttgccagcaattgcgg

SEQ ID NO: 57736 - DNA, 661 bp, Triticum aestivum
  Clone ID: PAT_TA_57736
ttttcacaacaacaaccaccattttcgcagcaacaacaaccatcattttcgcagcaacaacaaccaccattttcacagcaacaaccaccattttcgcagcaacaacaaccagttataccgcaacaaccatcattttcgcagcaacaactaccaccattttcacagcaacaaccaccgttttcgcaacaacaacaaccagtactaccgcaacaaccaccattttcgcaacaacaacaaccaattgctaccgcagcaaccaccattttcgcaacaacaacaacaaccagtgctaccgcaacaacaaataccatttgttcatccatctatcttgcagcagctaaacccatgcaaggtattgcttcagcagcaatgcaggcctgtggccatgccacaaaggcttgctaggtagcaaatgttgcaggagagcagcagccatgtgatgcaacaacaatgttgccagcaggtgacgctaatcccccagcactggcgctatgaagcaatgcgtgctatcatctactacatcatcctgcaagaacaacaacaggttgagggttgcatccaatctcagcagcagcaaccccaacagctggtgcaatgagccacccaaccccaacagtaggcgcagcagcaactcgtgcaacaacctcagctacaacaattg

SEQ ID NO: 57737 - DNA, 854 bp, Triticum aestivum
  unsure (1)..(854): unsure at all n locations
  Clone ID: PAT_TA_57737
attcccnngggtcgacncccacgcgntccggnaaaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaacctagtgtactacccaacttctccgcaacagccaggacaattgcaacaaccagcacaagggcaacaagggtactacccaacttctccacaacagtcaggacaagggcaacnaggggtactaccccaacttnnctccgcacagtcaggacaggggcancnaggggtactacccaacttctnncgcacagtcagggacagggcagcag

SEQ ID NO: 57738 - DNA, 643 bp, Triticum aestivum
  Clone ID: PAT_TA_57738
gtgttcgccaccgacgtcagcgaggtggctgttgaggtcgcgcggctcaacgtccagaggtacggggtgcaggataaagttgagataaggcacggctcatggttcgaacctctagaagatgtcaaaggaaaactgatgggtgtcattagtaaccctccatacataccaactgatgatctacctggcctgcaacctgaagttggttggcatgaaccaaaattggcacttgatggaggcaaagatggccttgatcatttgcttcatctatgtgaagggttatcttcggcactgatgcctggaggtttctttgtttttgagacaaatggcaacaagcagtcagagtttcttgtcgacttcattagtacaaagtggagctcatctttttgcgacgtggaggcagttttagactttgcagacatcaaacgttttgtaagagggtaccgcagatgaaaaaaagaaaacatggatgctgatgaaatattcttggagatcacttctgttccttagtgattttgggtaagattgcccaatttctgacttgtttgcagtgcagcagcagcacttggttgttttcaaccatcatcttctgtctctggcatccctgcagtttgtggatctttagttagtgaaatatgtgcttatt

SEQ ID NO: 57739 - DNA, 802 bp, Triticum aestivum
  unsure (1)..(802): unsure at all n locations
  Clone ID: PAT_TA_57739
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcanatcccccagcaatcccgctatgaggcaantccgtgctatcatctactccatcatcctgcaagaacacaacaggttcagggttccatccaatctcagcagcagcaaccccaacagttgggcccaatggtgtttccccaccccaacagcagtcgcagcagcaactcgggcaacaacctcaacaacaacaattggcaccagggtaccttttttgc

SEQ ID NO: 57740 - DNA, 745 bp, Triticum aestivum
  Clone ID: PAT_TA_57740
caacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgcagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgcccgttgtatagaaccaccactagtgtgccattcggtgttggcaccggagttggttcctactaat

SEQ ID NO: 57741 - DNA, 703 bp, Triticum aestivum
  Clone ID: PAT_TA_57741
gaagttgccggaggtgtggcgatctatcgacatggacaaacacgaggttgtgcttctaaagggcgatggtgtcctgtgtcagatggcgaaggcagctgtcgaccgttccgacggacagctcagggagttcgccgggaggctgtttgtcactgatgagctcatcaagtatatcgtggaaagcaaacaactcgccaatgttataaaagagtcacctctgctggagctgcattcccttgaacttgaaaacattgacctcatcgtgagaaaattgaccgctgtccttgagagctgccctgtcctggaagttcttggcttgcagtattgtttcttgattggctccaatgatgagcatgccttgcgggcggaattcactaggatcaagatcacaacgctcaagtgggataatgagtgccgcgactagtaatattatgagagctccgacaatgaccatgctcttgattctaaagatgagaggacatattattcagtgtgatctaagaatattgtgatctttatgatcggtataccttattcagcatggatccttatgtttgtgatagtgattctcgaatttatgtggggcttactttaccaattctggcttgtactcccctttcaatttttaataaatttgcctctagcgttgtatcaaaggactagttatttaatatgcttgttgagaaaaaaaagaaaaacttgagtt

SEQ ID NO: 57742 - DNA, 738 bp, Triticum aestivum
  Clone ID: PAT_TA_57742
cagagaactcaaaataagcagccagcaacatggtttgccctaagcatctgctaaggtcctccatgaatcgcgcacagaaaggcgccataattaaaagttcagtattttgcctgagaacacacacacacacacacacacacacacacacacacacacacacacacgaaagagctcccattctgcctgagcttccctccgcagttgcaagatgatcacttcagctccatcgcctcccagaatagtttctcgatctcttcgctttccgggtccaactccagagcccgcgagagtgaggaatacgcagcatcatactccttcatgaacattagagctgcccctttccgatagtgcgcctttgcccacttcgggtgcagctttgtgcattcagctgcatcctcataagcccttcgcccttcacccatgcgaagcaagcagaggctcctgtttgataacagcttggcgttgaagttatccatcttcagtgcctgtgtgtagaacactgatgcattttgataatcctgcttcttaaatgcttcatccccttgttgttttaagtcagacatcttttttttcccaagccaaaccatcggatgcaagatttatttatcatcacaccacacagcacatgattcagacacgcctcagctggcaaggaacacacacaacacaacgatacctaggccttcctgcagacgtctccctcgcacacgtacccagctggggcagaagcatgctcct

SEQ ID NO: 57743 - DNA, 682 bp, Triticum aestivum
  unsure (1)..(682): unsure at all n locations
  Clone ID: PAT_TA_57743
ccgcatgtcgttcccaccgccgacgtcgcggacctcgccggcgagctcgccgcgtacgacgtcgtcttcctggccgcgctcgtgggcatggctgccgaggacaaggccaaggtgatcgcgcacctcggcgcgcacatggcggacggggcggccctcgtcgtgcgcagcgcgcacggcgcgcgtgggttcctgtacccgatcgtcgatccccaggacatcggccgaggcgggttcgaggtgctggccgtgtgtcaccccgacgacgacgtggtgaactccgtcatcatcgcacagaagtccaaggacatgcatgccaatgaacatcgcaacgggcgtggtggacagtacgcgcggggcacggtgccggtggtgagcccaccgtgcaggttcggcgagatggtggcggacgcggcccagaagagagaggagttcgccaacgctgaagtggccttctgatcgttgcgaggtaatgaaaatgaatggcgtgcgcggtcatcatcagtacgtggctgcatgatcgcaggcaatcgtacggngtagttttactactactattatctatgcatttcatgtcatgtgttgtttgtacccaataatgtaaagtgtgatgtttacaagcgcatgtcttgtctatgaaaagcaggctagaccaggatagtttgccaagaagcaatatgtgtcg

SEQ ID NO: 57744 - DNA, 199 bp, Triticum aestivum
  unsure (1)..(199): unsure at all n locations
  Clone ID: PAT_TA_57744
cggacgcgtgggggaagtttgaacttagcgagagcgattggagatatggaatttaagcagaacaaattcttgcctcctgagaagcaaatagtgacttcaaatcctgacatcaatgttgtggaactttgcaatgaggatgactntcttgttttagcatgtgatggcatttgngactgtatgtcaagccagcagttggtgg

SEQ ID NO: 57745 - DNA, 395 bp, Triticum aestivum
  Clone ID: PAT_TA_57745
cagtagccctggacctgtgggttttgctgagatggccggaaggagccctggcctaatggatattgttgcagaggctgttggaaggagacctggctcgatggttgttgttgttgcttttgttgttgatgcaaaataatatcatgagcaacattatggatggcttggcacctcgactgctcaaacatctgcaacagttgatgcccgtgcttttccaacttttaagccttaaaaacctttccctttttaacgataatggctttagaaaaaaacccccttccgctggcggttttaaaaagaagaaggcccccatggtggaattttacaccccctttagaggtgcattaagaaagggggacgtgttgttttcccccaaatgaaccgcgaagcttttgggg

SEQ ID NO: 57746 - DNA, 491 bp, Triticum aestivum
  unsure (1)..(491): unsure at all n locations
  Clone ID: PAT_TA_57746
tttcgtctccacgcattcagccacaccaaataccagtcgtacctcacccgancgagtaatttcgtgcgccgcaatcagagcacgagatgcttgatcctggagctatgcgacatactctgttgggatcatcgcgtgatagtagttgcgtgggcagacacagggggaggaggaccgccaatggtctctcatgactgcgaagctgcctgagatcacatgagtaaaaggctgatgaggatgaatgactattgagtatgcagagatgacacaccgtgcctgatgagaatgcaatgggatacagcaatcctaccagctataagacaacacgaggtatcatctacttcttggccttgtgaaaactgcatcttaagtatgaacgatcatcaagatgaacgaggctgccatgaagcaccctttccgcagcatggtctataacatgaaccccatgtaccccaagggaaacaacgcgtcctgtccatccattcaagatgaat

SEQ ID NO: 57747 - DNA, 431 bp, Triticum aestivum
  Clone ID: PAT_TA_57747
attgcatacacatgactactagttctagcgcttttgcgaaaaaacacttgctgcctcgaatttagcagcgtattgaatatacttatctactacataatatcatgctcctcgagtacattgactatactgtttagtggtctacaggatgctcctgcagctgcagacactgacttaacatatcccgagcgatcatggggatcccgcatatagcacaacattcgctctactatgtaagatcatgacatactttactacatggcatcgaacatgcgttcagtacaatagggactgacgctcccgatgcagacactgaagactcaaccgccctaagtctaggcttgctatatgacagacgacacgtagtacacctgcctagaggactctacatgcaagagatgcacgtacattacagcagatgatgcggctacagc

SEQ ID NO: 57748 - DNA, 731 bp, Triticum aestivum
  unsure (1)..(731): unsure at all n locations
  Clone ID: PAT_TA_57748
accatttcgaccacaacaaccatatccacaaccgcaaccacagtattcgcaaccacaacaaccaatttcacagcagcagcagcagcaacaacaacaacaacaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacagcctcagcaacaatatccattaggccagggctccttccggccatctcagcaaaacccacaggcccaggngctctgtccagcctcaacaactgccccagttcgaggaaataaggaacctagcgctacagacgttacctgcaatgtgcaatgtctacatccctccatattgcaccatcgcgccatttggcatcttcggtactaattgagaagaaaataactctagtactagatatatganacaccgttttcttagtccatggggttgggtcatggnaaacgggtgaaaaaaatatgtgacatgcactatcatgtaagaacccgaactanactag

SEQ ID NO: 57749 - DNA, 780 bp, Triticum aestivum
  Clone ID: PAT_TA_57749
taatcctgccttacaggtttgttacggtgacattaactggacagtcttccatgccatctgcagatggtcaagttcgacttgataaggtaggtaggtagtctctatgtttgcattgctgggactatactgtgtgtgatatttctcttgtttctcagctatccttttttgacgtgaagtccctcaggtatctctttgctaattatggcttgtttgctgattccagcttttggggactgagcctgaggactacagtgtcaactggaacagctccaaaggtccagcaagagcgaagggcctttcagctccagggaaattggtgaggcacagcgattcttgtgggaagaaagttccaacgaaaaaggtctcatttgcggagcgtcctgtatcttttgtgtcttctggcactatggcggaaactgctaccgaggcagtagcagttggctcaactgctggcgatgtgtcatgtgagaaaggttgtcggaagcgactccaagctgggcacctttgagacgcacaccaagggcttttggttccaagatgatgggcgaagatggggattcatagagggcactggccttggcaaagatggccaaggcatattgcagcctgtccaagcaattcagcgtcccaaattcttgggtttaggtggtagaatttgacagcgaattggaggcgggcaaaagcagggtcagagccaccggccaaagcaaggccagagccaccggctaatgcaacgcgagaactgagtagaaccaggtcagaaccgaagcgcaacacacg

SEQ ID NO: 57750 - DNA, 573 bp, Triticum aestivum
  Clone ID: PAT_TA_57750
tgattgggcagaggttctaaagcccagggtgtgagtgaacataactactatgccaggacaagtagcatgttacaaaatctgggcctcgagaaatatgagaagaatttcaggaagggtctccttactgatcataccttgcccctccttactgacagtgctttgaaagatgtgaagatcccccctggccccagattgatcatacttgaccaaattaaaagggatccttggctggcgaaagcacagtgaaaacttgccgctatctgctggtgcttcttttttagttttatacagatagtatcatccggagctatgtccatctctgttttgatgataacctgtctgggcaccgccacttaatctgaaggcggaagtagtttttgtttctctagttattattagactctgcgttttgcaattccttatttgatttctggtaataattttttcgctgataactgatttctggtaataattagttgcctgcatctttgagttccaacccagtcattctactctgtaactcaatagcaatgtgtgatttgttgaattttgtaatagatcacagtttttttt

SEQ ID NO: 57751 - DNA, 617 bp, Triticum aestivum
  Clone ID: PAT_TA_57751
gacttcctggtccttggcttcctgcctgtcgtgcatatgctgaggctccagcgcactgtcaactgggtgcccgatggtgtcctaagggactgatgcactaatgttcagacacatcaccgagtgtggcaggtcgcgaagcacctatacagcactgtaggacgaggatgcttaggagcatggcgctcatgacgcgacaggcagcgacaggatcgtatcgccacgctgtcggagggaggtggggaagctgtacggggtgatcatcacagcgggatgcaggctacccatcgctaatgatgcgcccggagatggagcgatgggatgccatgctgagtgcgcataccgccactcttatgcaagcgcatgaacaactgctactgatgtgctatgcacctacctcttaattagcaggcagctgcgcacaacactgaacatggtgagtgtatgtagctatgcacaacgccttcggcaacgacagaagctggatcacgtgtggtgtcgcggcgatagggacatgggtgattcagaccgttccggcgatgggctaagagcatgctgcatcatactgctacaccagcatatcattatcgagtgacgacactaccgtaatgggcggctct

SEQ ID NO: 57752 - DNA, 343 bp, Triticum aestivum
  Clone ID: PAT_TA_57752
ttctagctggttaactcctttaccgagcgcgacgctcagcactagctatgtagcctctgtagcagccactcccatcagcaagctagactgcttagcatggacctacatcgtcgtcataaggccgacgagaagtcttgacggcaactaacagggcctgatcgatgctccattagatggttatggggcacgaacgcagcggctacacttgatgtactatcaacgattatataggacatggccgacaggcccgagtaatcgtatgggaaattatcatcgtgatggggatagatcattgaaattgttggacttacaacgaggaatgcctagccagcgctgagtcatc

SEQ ID NO: 57753 - DNA, 458 bp, Triticum aestivum
  Clone ID: PAT_TA_57753
ggaggcggggctcgtcgagggaggcggcggcttctcgtggaaggaggcggagatggaggaggaggagggggaggagtacgagggcatcgcggaggagtcggtggaggaggtgatgcggtggctggagctggagatctcctcctcgccgggcaagggcggcgacgacgggttcgtgaccatcaacggcaacgaggagagctgcggcccgtccttctccgccgcggcgtccagcgtgatggcctccgtggacacgcgcgccggcgcgccgccgcccccgacggccatcccctggccgtggcccgagcccgacgacgacaccaaggcggcggcggcggcggcgcacggcgacgccgacgccgacgcggacatggcggagctcgtcgacgaggagtggctggtggagctggtgaccggcggcgggcccgcgctggaggttgagtatgagtatggtatggcgc

SEQ ID NO: 57754 - DNA, 443 bp, Triticum aestivum
  Clone ID: PAT_TA_57754
agggagatgagcaggcgctctaacactgacccgaacgacacgtctgtgaggacctgatgatactggtgttcaagacctgactgctgacctttggatcgaggctggacgaccccatcatcttcgccaccagctatccaccgcatgcatcaagctgggcctgagcatcgacgaggacgaagaagctgatgtggctgacacagacatgccgacgatggaggaggacgccggagaaagcaggatggaagaggtcgactatgcgagcgcgtgaacttgctatccgaggcgcaaagctagcatatcttttgggctactgccgggaggccggtgtgctattaatggtatactgtgcctagcctgctgtaatggggtaggggagcggtctgtggtagacacgcaactgcacatacgaatcgatgcttatatatatcgtctttactaccttt

SEQ ID NO: 57755 - DNA, 714 bp, Triticum aestivum
  unsure (1)..(714): unsure at all n locations
  Clone ID: PAT_TA_57755
gcaaaccgaaggaccacatcttcatctattacgcggatcatgggggtcctggtgttctaggtatgcccaacaggccatatatttatgctggcgacttcatcaaagtgttacgagagaagcatgcttccaaaagctattccaaaatgattatatatgtagaagcatgtgaaagtggcagtatatttgagggtttattgccagaagatcttaatatttatgttacaacagcatcaaatgcggtcgaaaatagttggggagcatactgccctgggatgaaatcatcacctcctgctgaatatgatacctgtttaggagatatctatagtgtttcttggatggaagacagtgaaactcacaatctaaagaaggaaacactcaagcagcagtacgaggtggttaaaacgagaacatcaaaatcaaaggaatttgataagggttctcatgtcatggagtatggtgacaagacattcaaggatgagaagcttttcctttatcaaggtattcgatcctgcaaattccaatgtcgcaaacaggctgcttttgcccgaactggagggtgcaatcaatcagagagatgctgatattcttttcatgaggaagaggatggcagaagttaaatgggggattcggaagagagcatnagggttcttaagggagatcaaatgaatctgtggtacacagcgaagcatgctcgacagcagtgatccgatttca

SEQ ID NO: 57756 - DNA, 737 bp, Triticum aestivum
  unsure (1)..(737): unsure at all n locations
  Clone ID: PAT_TA_57756
gcgaggccacgcggctcaacacgtggcagggacagctcaatgtgtggcttcaggcaacaccgtaggtagttcagaccagcgttttgttggcaagaagcgtttgttcatttttgaatttagatcaaatcctccaggaactccatgtggggtagtaatccatcaagaagtaatcaaatcagcttgacgtaattgatctagtaatgtattttgcttctaatctttgggatttaacccagcatctccactgtcatcgacctcctgtaaatttaatagtaacacttgcccactgggactcctgctccattactgttggcaggctagtcttcgaatcatcatgcatgcatgcactgctctattaccctctggctgaacccccaattttcttttgtttcgtacttgacgagataagaaccacaccagcagggggtaccctcggcaaagcgaaagcgagtctcagaaaaaggaattggcgagagcgaccgtgcggggcatctcaaggcggaggctgcttaagaccgcgccgnncggctgttgaccaaggcgtcaggaagcatggctgcggatgcgggcaatagcgaaacccggcagaggcagcaagcgaaccacagcttgaggcaccgggnagccgtgatacagcgattcagcggaaactggattggcccggaggcgaagggcttncnggcagttgcttgctgctagcgggcggtttacgcgcggcggctgagcgatgcacatag

SEQ ID NO: 57757 - DNA, 561 bp, Triticum aestivum
  Clone ID: PAT_TA_57757
cgcctctttgcctagagccgaaggtgaacggtataaatgattgaataccgatgtgggacgacgaccgaccgacacttctagacacggcgaggttggcaggtagggctgatgattttatgattacacggtatgaaattatgaacgggtgtgaacagatagagagaaatcgtacgcagaacatggagtgatgcaatccgcgtgtctgacggggattctactgatcatgagtacaggtgaactatatacatgctagtagtacaagatcatttgattatgatagattgttttatcattctaatcaccgcatgtacagaagaagatactctgcatagtgttcttgtatacagctacaggaatatttggctgcacacgaaagaattcacactagcttctgcagatcattcaagttggtgaacatgttgctcccgatagtgaatgtcgatgtttatatcacaagttgatgccgtgttatccagtcatctcgaactatttgatgagcctgtaagctttttgcgtagtaattactgagattcgtgttgtgcgtgcaggcttcctttgtat

SEQ ID NO: 57758 - DNA, 630 bp, Triticum aestivum
  Clone ID: PAT_TA_57758
cggaagaacgtctcaggcccggctctatccgggatgccaacctcatgcagggcagtctcatgcctcacatatcaacttatggcggttggaagtggtttagaggagaacttttgcgattcataagctaagcgtgacacatccaccatcccagctacgctgacatatacaacccgcgtgccggtacgataccccggctctactcccatacgttgcccatccttaacatcgggcaaatgagtgctaccagagttcatctgtaccagaccgcccttatttcaccattatggtacattactgcccatagtgtgatgtgcctgagccaacgacatatatgggttcaacgttggcaatgaccatggccgggacgtgttacatgaccttgttagcccctagcacctattcatcatcccacacaacgactgctggggtgactaccgcacttctctgatggagcctgtacattggcatcaggactgacgcgggctacatgcatagcacacatcgcaagcaagacatgggctctcgccgccacgatcggctgctgtcatgaccagggcatccagggtacttcccgacttatctacacagctcaggactagggcagcaaggggcattacctagcattctcat

SEQ ID NO: 57759 - DNA, 725 bp, Triticum aestivum
  Clone ID: PAT_TA_57759
tgatacactacaaggtgagatggctgtcatttgcgaggatgtgtctcaacttaagcaaatagtggatgagcgcttatcttggagcaagttgcagcgatcaacaatgtcaagtctctcctcttcgctgcattcttcgcttcacaggagtgctagttcgtcagacaggaccaccgaagccgttgagtctaaagataaacatacagttgctgaagttgcaaggccagtggctgaggatccggatgtcgacgggagaaaggttgaaatgttagatggctgtgacagtgaaggtgcaagctctgtgggtgaagacaacagcaaggacaagggcaacaagggtactacccagcttctctgcagcagccaggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaatgtccccgcagcagacaggacaagcgcaacaactaggaccaggccaacaaataggacaagggcaacaagggtactacccaacttctctgcagcagcctggacaaaggcaacagtcaggacaagggcaacagtcaggaca

SEQ ID NO: 57760 - DNA, 541 bp, Triticum aestivum
  unsure (1)..(541): unsure at all n locations
  Clone ID: PAT_TA_57760
gcggcaccctgcttgtgtaccgggacaagcttttcggcgaaaggcttgtgtgggattcgttcccttacagggagctgaaaaacggagtgctctgagaagtcgatggtcattgggtcgatgaaggagcctctgatgtggacattggagccaatccctatgctgagggtggtggggatgatnacggagttggatgaccaatgaataaaagtgaatgtcattgttgacaccttacgtcttcaggagcaacctgcttttgacaagaagcagtttatctctcacatgaagcgctacatcaagaacctctctggcggctcgaatgtgatgacctagatgctttcaagaagaatggtgagtccgacacatattatattgttagccgatcaaggacctttagcctttgttgacgagagcatgcatgatgaagccgtggtggtgcccgcctaatacaaggagggagctgttgatctttctttactggactttgcacatgggatgcccgaggtgaagtgcttatcgcactgtatgctaaaatgtatgctga

SEQ ID NO: 57761 - DNA, 716 bp, Triticum aestivum
  unsure (1)..(716): unsure at all n locations
  Clone ID: PAT_TA_57761
acgccgcccagacagttacagtcctggtgcggaatataccacctgatccagatgaatcaattggtgagcttgcagagcatttcttccttgtgaatatcctgacactatctacacatcaggttgtttataatgcaaataagctcgccaaactggtcaaagagaagaagaagatgcagaattggctcgactactatcagctgaagtatgaaagaaatacaagtaaaaggcctactgttaagactggttttncttggatgttttggttctaaagtggatgctgttgaacactgcgcatcggaaattgagaggatagaaaaggaagaagctgaagaacgtgaaaagatcgtngaaggatcccaagttagttgttccagcggcatttgtctccttcagaacacggtggggtgccagcagtatgcgctcagacacaacaaaccagtaatccgacggttttggttgactgagtgggctccagaacctcgtgatgtgtactgggataaatttgtctattccaattgttcaccttacagttagaaaggttgataatttgcggtagcattcttctttctgaacttcttttaaggtgatcccaatcgcattnngttcagtcccttgcaatattgaaagggattgagaaaggcagttccattttctgaagcctataattgaaatgcctactatcaaaatcgttatcnccaagggttccttccctggaa

SEQ ID NO: 57762 - DNA, 634 bp, Triticum aestivum
  Clone ID: PAT_TA_57762
tggagagaccatggcagaagcgacgcattaacaccacaacggacatttgcacaacaaccactattttcacaacaacaacaactatctcctcaacaatgcatcattttcgcagcaacatccaccattttggcagatacaaccaccatctttcttagtaacaaccaattctactcacagataccaccatctatagcaggaacatcaactagttctaccgcaccaaccaccattatcacaggaccaacaaccagttatacctccacaactatcacctatttgcacaccaacaacaacaccaacagctggcgcaacaacaaatccctgttgttcagccatccattctgcagcagctaaacccatgccagctattcctccagcagcagcgcagccctgtggcaatgccacaacgtcttgcgtaggtcgtgcatggtggaggagaggagttgccatgtgatgcagcatcgatgatgacaggagttgccgcaaatccctcagcaattgcggtatgaggcaatgtcgtgctatcatatactccatcatctcgtgcagacaacagcagggtcatggatccatccgatctcactagcagcaagcccaacagtcgggccaatgtgtttcccaaccacaacagcat

SEQ ID NO: 57763 - DNA, 702 bp, Triticum aestivum
  Clone ID: PAT_TA_57763
gagaggagcggtggagcctcgccggcaagacggccctcgtcaccggcggaaccaaaggaattgggcgcgcgatcgtggaggagctcgcggggttcggcgtccgggtgcacacatgcgcccggagcgacgccgacgtgcaggagcggctgcgcgggtgggccgccgacgccgacgcggggcgcctgagcgggcgcgtcacggcctccgctgcgacgtgtccgtgcgcggcgaccgggaggcgctcatggccacggcccgcgccgagctgggcggcaagctggacatcctcgtcaacaacgccgggcagaccttcttcatgccggccacgcagagacggcggaggactacgcccggctcatggccaccaacctcgagtcctgcttccacctcgcgcagctcgcgcacccgctcctcgtcgccgccgggggcggcagcgtggtgaacatctcctccgtcgcctcggccatcgcgtacccggtgcttgtcggtgtactcggcgaccaaggcggccatgaaccagctcagccgcaacctcgccgtcgagtgggcgagcgacggcatccgcgtgaactgcgtcgcgccggggggcatccggagcgacatcctccagagcagcggcattcgaggttgacatggagggcgttgctggcgatggggaaagaaaggagaacgagccgcgtcgcgctgggccgcatgggcgag

SEQ ID NO: 57764 - DNA, 651 bp, Triticum aestivum
  unsure (1)..(651): unsure at all n locations
  Clone ID: PAT_TA_57764
attccgtgatagagaagattctgagatttttggctcaaagttattgaaagagaaacaccctggttccacaggaaacagtgagaaacaaagtggaaaaccacctttaccaaataatgtgctggcagaactacggaaaggctcttactacgcttcactggagctagttcaatcattatgtgatacatcttatggtctcgtagacatatttcccgttgaagatcgcaagattgccttgcgagagtctcttacagagatcaattcacatattgcttccagtgagaaaaatggaggcgtatgcttcccaatgggaaggggcatatatcgagtggttcatatacctgaagacgagtctgttcttctaaactctagggagaaagctccctatcttatatgtgttgaagttttgaaagcagaaacaccaagtcactccaaagggtcctcagatgtgaacaaactatcaaaaggcgggataccgttggctaatggagatgttcagttgccaaagccgcctccatgggcatatcctttgtggagtcgacatgaaccacannattatganacagacagaatgctgaactctacctctcaggntattgaccaagccatggctcaactatgggagccaaagtgaaaattgnaaatgttagtttc

SEQ ID NO: 57765 - DNA, 587 bp, Triticum aestivum
  unsure (1)..(587): unsure at all n locations
  Clone ID: PAT_TA_57765
ggaagaaaagttgcttgaatttgacatgagctataagggctggtgctgagaatgatgcactctcaagatcactccaagagcgggcagatttgttgatgaaaattgatgaggaaaaggctcaagcagaagctgaaattgaagtcttgaaaagcacaattcagtcaggtgaaagggaaataaattcgctgaagtatgaagtacatgttgtcaccaaagagcttgaaatccgcaatgaagaaaagaacatgagtgtgcgctcagctgatgtagcaactaaacagcacctggaggatgttaagaaaatcacaaaactggaagctgaatgccaaagattgcgtggtcttgttcggaaaaagttaccggccctgctgcattactcagatgaaatggaagttgagagcctaggaatgggcagagattatgcttttgataacctacagcacatgcagaaagagaatgagtttctgactgcacggtttgttanactatggaagaagaaactaagatgctcaaagaggcattgacaaaacggnaacagtgagctacaaacttcaagaagcatgtacgctaagatagcgggcaagctt

SEQ ID NO: 57766 - DNA, 687 bp, Triticum aestivum
  unsure (1)..(687): unsure at all n locations
  Clone ID: PAT_TA_57766
ggaggaggcaatagaggcagaaaaccgtgctaaggaggaggcaatagaggcagaaaaccgtgctaaggaggaggcattagaggcagaaaaccgtgctaaggcggaggcaatagaggtagaaaaccgtgccaaggaggaggcattagaggcagaaaaccgtgctaaggaggaggcaatagaggcagaaaaccgtgccaaggaggaggcattagaggcagaaaaccgtgctaaggaggaggaagctgcagctcgaaatcgtgctgctgaggaagaaaatgagaggaagaatcatgccattcaagaggaatcaggacagacaactaaggttactgatgaagaagctgcaggaagaaaagaaatcaatggagatcagatggatatggacagtgcagatgtcgctggagaacttgtaggtccaattcctccattgcctgacacagtggataacgatggggcttcaattgaacagagtacttctaacgctcagagtggtgacaccgttactgtgaatgagggagccattgacaaggtcgattcatccaaattagatggccaggacaataccagttgtagcatggatattgatgctggtagccaggaagagggaaaaaatgttctcgcggctgctgctacnagtgttagatgtagggaacacacctgtatctttcagatcaagctgtctcgatg

SEQ ID NO: 57767 - DNA, 739 bp, Triticum aestivum
  unsure (1)..(739): unsure at all n locations
  Clone ID: PAT_TA_57767
gcaacaaccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttatcagctgctgcaagaattgtgttgtcagcacctatggcagatccctgagcagtcgcagtgccaggccatccacaatgttgttcatgctattattctgcatcaacaacaaaaacaacaacaacaaccatcgagccagttctccttccaacagcctctgcaacaatatccgttaggccagggctccttccggccatctcagcaaaacccacaggccncagggctctgtccagcctcaacaactgcccccagnttcgaggaaataaggaacctagcgctacagacgctacctggcatggtgcaatgtctacatccctccatattgcaccatcgcgccatttggcatcttcggtactaactggagaagaaaataactctagtactangatatatg

SEQ ID NO: 57768 - DNA, 638 bp, Triticum aestivum
  Clone ID: PAT_TA_57768
gacatcttgatacaggaggctatatctcatggctggatgctgttggctacaggatgcttatgaggaaacgcatcgatacgacagctgatcaacattattgacagcacggcaccaccgatgcctactgctcggcgctcatttgcatatgcacatgtgcacgaccagattaatgttactgaaagactgcaacatgaccgagatgccatgtaaggatggtgacttgtatcaccacaacatagagtatggatctcacacaaatgccgcagctcacttacgactggtgcaacacttagtggtggaatgacgagctgagacctccacaggcgcgctgccaacagcatgcacttggcggtaatgctattattgtgcgtcctgatctgcaggggcaacgagactgggagagccatgtgttcgtaccagccgcgctaggagacaatatacatcacgccatagctgccttgcagacatcttagcaaaaccccagaggacatgggctgtgcccagcctcagcaagctgcacccgagttcaggacataaggaacttatcgctgcagacgctggcaagaatgtgcaatgtctacaagacctacataattgctcgaccaccattgcgccatttggatcattcggtactaact

SEQ ID NO: 57769 - DNA, 622 bp, Triticum aestivum
  Clone ID: PAT_TA_57769
gacggaccatggagagataagctcatgctactgtcaattcatgagtagaggacggccatggatgaggagagagcctcgctgttgcaatgcctcacctagtcgacctcatggatagtgccacggatatggctgtggatcaatctgttcgcacttggggcaaagaaggagaaggattgatgatggatacgcaacgtgtcgctggatcagaagttagctgcatcaccatcgtctgaatgatgatggagaagcagaaccgcctgcagagcaccgtgggccgaggacaagcaacgactgggagcgcctgtacgaagaagaagatgacgcagagcagaagcacaccgccaccatgagcaggacctaggctgacgagagaagccacgaagcagcgtaggatttgaaatcactgcgcggaggaagacgaccatggggatttgaaaatagaggcagcgatggcaaaagactattattatgaatttttgccttaaacaaataaatatattttcacatattttatcacagagggtaaagacatgagcgcgcggcgccggagaaggaaaagctgcgccgcgcttgctgcgaggaaaaccaagcaatcttcgcccagcctctagatatcatctat

SEQ ID NO: 57770 - DNA, 560 bp, Triticum aestivum
  Clone ID: PAT_TA_57770
cctaccgcgccgacatttaccttgccattctacacgccgatgacagcattaaggattgagatacacgcctggcgagagcgggaaggcatcttctggcctacttacgatggcctcgagcgcactgacaaagaatggacctgctcttgctaaactcgccgagacttacagagactacgatgataccattgagactatccacaacgctctcactgaacatagaaacccagataccctgaacagactaaacgatgctgaacgagcaactaatgagctcgagcatacaagaggactatgatccaaaactagctgatgactgagcgcgagacaggaaccgaacttctttaagcatcacaatacccactagcagagcagctttacactgaaccgctcaggagacacccgcaagatccgaacgtttacacactcagagctgcctgttactccaagttgcccgccatgcccgtaggtctcaaggatgcccataagcgcatcgagctagatcctacagttctccaacgcatacaccgaagaagggtgccatcgcagtttttcatgacaga

SEQ ID NO: 57771 - DNA, 597 bp, Triticum aestivum
  unsure (1)..(597): unsure at all n locations
  Clone ID: PAT_TA_57771
gacgccgatgtcggagtggtccaagggatggtagtcgtgcttgtcgacggagatgctccacccgtaggtgttccggaagctgggctcgtgatcgaacaggttgtaaggctccggcgcgcgcacagtcttgtccgacttcttgttcagctcccctccgatgaacctgctcatcagtttcctccacgaccaagtccaagtggattgcccgctaccgcgttcgtcgtcgttgccggagaaggagaagggggggaaggagagggaaccgtttgttatgaagcaagtggcgatggagtgagcgcacgcggctagccatccgcttaaatgctttattgagcagatgatgatcgatcttacctgtgttcttctggtcgaaacttctgtacatcatgcgcgtgtttgcgccgtgtgtttcagtgtttgtgtcgtgtcgctagtgtgtgnttgagttctagtacctgtttgttcatgtgagttctggcgtcgtcaataaataaagatgcatatcagaacaagtacatcgacaagtcacggtccaacagggagcacagcttggtggactgggcctgccccaagctgaatgacaagaggaggcttctc

SEQ ID NO: 57772 - DNA, 236 bp, Triticum aestivum
  Clone ID: PAT_TA_57772
gaccacgcgtccggaagatggtgaagcgatggatcccgctaagaggccaaccccgacggcatgaaccagttcatactggggactgtgagacaccgagggggaggagcagaactagagctgatatggctagaaaagctaagaaggaagaccgctagaatgatggtggtatggcttcggagtgatcagctagcgcaggatggggggggggagggttggctgattatatacctgtgaag

SEQ ID NO: 57773 - DNA, 829 bp, Triticum aestivum
  unsure (1)..(829): unsure at all n locations
  Clone ID: PAT_TA_57773
ggggcgtcaccttctgcaaccccggcctcttcagtacagggctccacaataaagaatacattctcaagtttggcttctttcccctgccccaagagttggttgaaaagtccaaggatcatcgacgtagcaacagccgagtggcacggccagaagcctaccgcaccatgggcaccaccctccaaacttggtggcgtaaattccccccgttctacaatgtcaggtttgtctccatcgatggcttccttgagcccatcgatctcaaggaccgcgccgtaaccgtgtggtggctgtgccaaaaagggctcgagtggaagctggagtacaagatcagcctcgaggctctgtgggaattcaatggatttggcgatctgccaaggaatttaactccaatgtaccccctcctcagcccaaatgatcatgagatggtttattttgcacttgctgaatggcgtgaaaaccagagcaactggttgttcatcccgacatgtgcgcgatatttacttgccatcaacccacagcacaagaccgtagttgcctctgtgtgtctcgctgactattttggaaatcctaacatccctcctgacatcatcagctctgatttccagcggcacatccataccgtgagtctggatcttcacataatgttgatggaaacgatgaagcagatgtcattgacatcgttggaccctgctgaatatgatgaagaggaggctaagaagctgatgaaggaggagccatggacctggncaganaaactgaggaaacagaaggcctcttnctcttctcttcagctcgtactacagcagccttctttggctcgactcatagc

SEQ ID NO: 57774 - DNA, 261 bp, Triticum aestivum
  unsure (1)..(261): unsure at all n locations
  Clone ID: PAT_TA_57774
cggacgcgtgggggacgagaaactggagctgaagcttggccttccaggcctcgtacaagaggagccagcggccagctcaagagagaagagggtgcatcaggagagcccggccctctaccttgggtacccccctagacactccacggccaccacaacgacgaccaccaccggagcaaagagggggttcctggacacggttgaggccaaagcacaaggttatgagaaggagcangcgagagccagcacatgtgggaaggaact

SEQ ID NO: 57775 - DNA, 345 bp, Triticum aestivum
  unsure (1)..(345): unsure at all n locations
  Clone ID: PAT_TA_57775
gaaagggagggcatgctgcactncctcaacacactatggggggggggggggatgcatccaatgttattgaaagccttcagcaacttgatacacaagaagctgaccccttggactcacaggaagtaacggttggaaagtaccaaggtggaggagccttcaagggtatccctgattccgtgacaataggcgggacccttccgagcctttgtgaaggagagctttaatcaaaatgaagcagcgaattgaagaggtcataggcacacaggcatcgagtgcagcgctgcaatagcagatgcggactttccttgacaaagataagccctttcttccctccaacaatcaaca

SEQ ID NO: 57776 - DNA, 491 bp, Triticum aestivum
  Clone ID: PAT_TA_57776
catgtgatgttagaattgcaacaatcacagaatagcgcatggtatagctacaagatctcgtaactagtacttaccacacttggtgcaacacttgcgtatcgcactagtaggtgtggcagatccccgagacacaccgcggcgccaatgccactacacaatgccgatgatgcctattatctctgcatcaacaactaccacaaccacaacaacgacgaccgttgagcccggtctgcttcacaacagtctacacaaacatatacatcttgccaaggttttttacaaccatctgattacaagccagaaggccagggttctgtacaacctcataaactgtggcagattgagggaattgggaacctatagctacagactgttgctggaatggggaaggtatatactcctgcatattgctccaaggcggcatttggcatccttgccactaactgagaataatattactctggttctacatatatgaaacaccggcttct

SEQ ID NO: 57777 - DNA, 562 bp, Triticum aestivum
  unsure (1)..(562): unsure at all n locations
  Clone ID: PAT_TA_57777
attcccgggnnntcgacccacgnnncgtccggcacatagatgttatgatgtaaatatataccataagttcggatacgattgtgatcttagcatgtgagaagaagcagagaagcacgcgctcgagtgtaatcgacagcacgaaatgtgtccgagtgaccatggtgagccctctgtagatgagggcatacctcttggccaggacatgggcatttcattacctgcctgggttgaagcggatcaatcaaacactactgaggggggggaaagccggacatgcgaaggtggcaccccgccagaacatggatcattgccgaaataaagcccgcgaatccgtcattcgctgagacgaatgttgcaagcatgaacgacgaggcgcaagtagtaaggtggggaaacgcctaaaagccacccccaagagctttttataaagacccttcggaaggaatcaagacacttcttaaatttgntcggcttaaccttggtgctcctacactaagggctgtggacagcccatccgaggccgtgtgatggggcatgatgatcactgaagaattaccctgct

SEQ ID NO: 57778 - DNA, 453 bp, Triticum aestivum
  Clone ID: PAT_TA_57778
caatgtcacagcaccacgcagatgctgaaggatcaacagaggaagcatctacaacaacatctactgatgattcaacaaaatctgcaacaacaactgattcctgcatggatgttgtattgtaggcagcacaacatactgcatggaaaattacaagttttgcaacaaagtacttaccagctgctgcacgaatgggggagctaacacctatggtacatccctgagacaagctgatgccagtccattcacaatgattggtcatgctattattcagcatcaactacaaaaacatctatgaccaccacaacagcaagtgatattcttacagagactccaacaagtatgcctttgcctactttgttctcagaggtggcagattcacatatgcatccatgttgatgaccacttgtcatagaatgtgccgtgagcatgtcagcaggcacagatgccctatgt

SEQ ID NO: 57779 - DNA, 798 bp, Triticum aestivum
  unsure (1)..(798): unsure at all n locations
  Clone ID: PAT_TA_57779
cggacgcgtgggtgccgatgatgatgatgaagaagatgatcaggatgatgagtcatctccagtgcttgctccaaagcagacggatcaaccaaaagatgaacctgttgataacagcccagccaaacctacaccttcatcaggacatgctcgtagcacacctcctgcatcgaaatccaagcaaaagaggaaatctggtggtgatgatgccaaagcatctagcggtgctgctttaaagaaagcaaaggtggaatctgatacaaaaacatcaagtatcaaagaggagacaccatcttcctcaaaacctacaccgaaggcctctgcttcatcaagaagtgccaatgtatctcctgtgacagaggatgagatcaggactgttcttcttgcagtggctcctgtcactacacaagatttagtctccagatttaagtctagactacgaggtccagaggacaagaacgcctttgctgaaattctgaagaaaatttcgaagatacagaagactaatggccacaactatngttgtccttagagaggataagaaatgatgagctcaaaagtggcgatttccttcattgcaaagtatcctncttgtgtcttcctggggataataagttntgtactgtattatgttagacgaaatttggtcttctgacaagtatatgccgaacttctacccttctactagaaatcannataactagttagtgccctgttcggaaacctctnncagtcttgaaactccgctccgcatgatgagnctccggtttgagccactccctgccattgtgctacagctgc

SEQ ID NO: 57780 - DNA, 546 bp, Triticum aestivum
  Clone ID: PAT_TA_57780
gcctacatgacatttgctccagctgttgcatgatgctgtactgaaactgagcgccatcatgtctattccactcagtactgtggtagcgtcttcgatgtgcgcgacattactgtccctgattgggcgcggaatgactgcgccagatgattcgtgcattctctacacccgatcatgatgggactaaggaacatcgcagaccgtcacccttggaggcgctcgtccattactctcttgcatggtggacctgccggacgatgtatactgatatacatgcttagctgcacaggaccacttgacagagtttttggatgccctggtcattgaacacattgtacttatgctggtacccactgtggagatgacgttcccttactatctttgtacccatgtatggaccttccgatacgtagctgaattaatatgctatgatcctaccctgcacactgactatatgtcagcacttctgaacggtggacattctcagaggctataccatttctatgtctgactactctgtgcttctttacaaacatctgactgcttaat

SEQ ID NO: 57781 - DNA, 472 bp, Triticum aestivum
  Clone ID: PAT_TA_57781
gctgaccgtttcctacgacccgtgcacggaacggtactcgacggcgtactacaaccggagggacgtgcagatggctctccacgccaacgtcaccggcgccatgaactacacgtgggcgacctgcagcgacaccattaatacccactggcatgatgctccgaggtccatgcttaccatttacagggagcttattggagcggacctaaggatttgggtgtgcagcggtgacacggacgcggaaggccccttgacagcaacaagatacttcatcggcggtctgggtcttcacaactactaccagttggtgcccttggtatgacgaccagagaggtcggcggttgcagccaggagtacaacggccttacactggtgtccgtcagaggcgccggccatgaggttcccctgcatagcccgcggcaagcgctcggactgttcacggtgcttcctgcagggcgagcccatgccaggccag

SEQ ID NO: 57782 - DNA, 439 bp, Triticum aestivum
  Clone ID: PAT_TA_57782
gatgcagcgcctgctgacggatataggactgatgcacatgcgatagcaggcgtggcagacgcaggcccaatggtccctcactctttagtgggaggttgatgtgcatgaacatccacaacgttaccggcatcatagcttgtcctctatgattgtgctgacaaattctgcgttcacccatataccattgaagcctactgctgtgcgctatacaacatacatagattttgagaagttttatggaacaatcttacttggatattgtgcctataacccttgaggaggctgagtacccagctatgctgcctttttcggtgaaccacacagagcgcgagcgccgcttaggtggaatttctaggctgtgcaaggagagactattgcttgacgtgcttgggccttcagaggaacctgttagttgaccgacctatatggacgatgcgct

SEQ ID NO: 57783 - DNA, 369 bp, Triticum aestivum
  Clone ID: PAT_TA_57783
agctccttccggccatctcaacaaaacccacaggcccagggctctgttccagcctgcaacaactgccccagttcgaggaaataaagaacctagcgttacagacgttacctgcaatgtgcaatgactacatccctgcatattgcaccatcgcgccatttggcatcttcggtactaattgagaagaaaataactctagtactagatatatgaaacaccgttctctctagtccatgggttgagccatatgtagcggtgaaatagaataatgcgacatgcactatcatgtaagaacccgagactatactagatcaaacttgagaataaaagacaaacacaggtcttgcctaatacaaaagaagaaagttgaac

SEQ ID NO: 57784 - DNA, 685 bp, Triticum aestivum
  Clone ID: PAT_TA_57784
tgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatggtggtcatgctattattctgcatcaacaacaacaacaacaacaacaacaacaacaacaacaaccggtgagccaggtctccttccaacagcctcaacaacaatatccatcaggccagggctccttccagccatctcagcaaaacccacaggcccagggctctgtccagcctcaacaactggcccagtttgaggaaataaggaacctagcgctagagacgctacctgcaatgtgcaatgtctatatccctccataatgcaccattgcttcagttggcttcttcggtactaactgagaagagaagaactctagtagtagacatatgataca

SEQ ID NO: 57785 - DNA, 555 bp, Triticum aestivum
  unsure (1)..(555): unsure at all n locations
  Clone ID: PAT_TA_57785
cggacgcgtgggggcgcgcccgagtgcctgtggctcggcgcggtggccgcgtcgaggaggatcagcggggaggtggcgctggtggtggctgagcaggcgacgctgccggagtccccaggggggttctcgtgcacggcgaagatcgagtgggagtgcggcggcggcgagcgggcttccatccatgcagcgtgcgacgtcagccggctgcagtgcgagtacaggcactacctcttcgcctggaggtttcgcgccgccgatgcatcatcgcccgccgacagccaccgcgccggcggcgaagcatgagacactcaggatccgagctgcgtgcgaaaccaagtgcacaggtcatagattaaggtgcatgttttgttactgttaaaccactaggttaaggtgcatgtttagtggtactggtaaacctaggtgaactgtttcctcttttgggaagcctgcatggtgcatgcccgggttctaaagtacatatgatgttgaccggacaacgcaagggaaaaatatgacgtgtgctttggtgaanaaaaaaaaaanaaaaanann

SEQ ID NO: 57786 - DNA, 739 bp, Triticum aestivum
  unsure (1)..(739): unsure at all n locations
  Clone ID: PAT_TA_57786
gtattttggagcttcgatggagtggtgttggcattgaggattggtggaaaatgagcagttttgggtcattggtggcacctctgcacatctctttgctgtgttccaaggtctcttaaaagtgctagcagggatcgacacaaacttcacggtcacatcaaaggcaaccgatgatgatggtgattttgctgagctgtatgtgttcaagtggacaactcttctgatcccccccaccactgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcatcgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaaagatgtgtcggtttaagttcactctactgcatttgngggtgggcagcatgaaactttgtcaacttatgtcgtgctacttatttgtagctaagtagcagtaagta

SEQ ID NO: 57787 - DNA, 336 bp, Triticum aestivum
  Clone ID: PAT_TA_57787
agaggcgactaactgctacacgcctatgaaacggtgcaaaagtccagagcgtactgagccatggaagagatctagttggtgctcggaggacgccatagaccctgacgcgccgatgggaactacttcagccttcgactaaattgttgcatgaagatagtcagaggcataagctcgtcactgagtgccaccagtgtatgcgcttacaaggcggatgggcggaccatgctgactgcgctctgagggcaaaaggctatcccagagtgatatgacacctctcacataacgagacgcactgagtatagaatgacaagctcatacctatcattgggcttctga

SEQ ID NO: 57788 - DNA, 660 bp, Triticum aestivum
  unsure (1)..(660): unsure at all n locations
  Clone ID: PAT_TA_57788
gggggctacagcacggaccagttcgaactgaactcagccgaggttctcgacccggccaacggcgtgtggcaaccaatcgccagcatgggcaccaacatggcctcctctgactcggccgtgatcggcggcaggctctacgtcaccgagggctgcgcgtggcccttcttctcgtcgccgagagggcaggtgtacgaccccagggccgaccgctgggaggcgatgccggccgggatgcgcgaggggtggacggggcagagcgtggtcatcgacgggcggctgttcgtcatctcggagtacgagaggatgaagngtgaaggtgtacgatccggagacggattcctgggatcctgtcgacgggcctcccatgcccgagcggatcatgaagcctctgtccgtgagctgcctggacagcaagatcgtcgtcgttggccggggtctcatgtgggtgatcggccatgtcaagaagcaatccggcggcaacaacggcggtggcgggcgggttcttgtgactacttgggttcgttggcaggatgtgggaaggntcccaggggcgttcagcgatcntgacgccttcaagcagtcaagattttacatgctttaaaagtaactctgcctctagaataaaagctctcctagtctgcaaagccctgttcgatgtct

SEQ ID NO: 57789 - DNA, 469 bp, Triticum aestivum
  Clone ID: PAT_TA_57789
cccgaatggccgcacctcaacgacttactaggctgctctgcccgaacctgatgttgggcttggaccagccatcgcagacccgttcggatgatgctcgcagaagaacacagagactgaacaggacagacctctacctggaacgcgtgtggaaccctctgctacaaaggatgcacttgctcctaatgcagtatcaccgggcacaattgacgcacggcatgggccaacaagatagcatacaaggcagcagtgcttcatatgcaacctgactaccatagtgacgacatgttactctgaagatagtagaccttatccgcgattgctgatgttctctcatacagaggggcaacatgtgagagcgttgagaggtgatgaaactcttaataccctcatagtgctgtgttgtgtcaggacagccagaactgatgactacaaggctgcttttgcagcatgtaaattgctatttcctgag

SEQ ID NO: 57790 - DNA, 648 bp, Triticum aestivum
  Clone ID: PAT_TA_57790
agcgtcgcgcgatcaaccgcgggagtggagcacagtatggttacaacacgtggtgcaaagcacgttgcgggcaagctcgtttgggcgcagacatggacagacggatatgcacgcccgagaggcggcgcatgcacactgcatggagtggcggggaacgcgcgcacacacactgggagagatgaatgttcgcgctggatgtgaaccatgactgcatgcactaggtgcgggagtgcacgctggaaacgtagcgcatggagtaggagcagttatggccaccatagattagcaacatggagcacgagctgtgtgtgtgatcgagctatgggcagcatccgatgagcagtcgcatgcgtgctggtgctccacaatgaatgagcatgctatgatatctgcgtcgaggactacaacactactagtagcatgtggaccattatccgtgcgacaggctctggaagaatgtcggttaggacagggatccttgctgccatctctgcaacacaggacaggccgaggtagtctgtccagcctgggcaactgaccctgctagaggagatatgaacctagcgttacggacgctagctgcattgtgcaatgcttacatttctccatattgcatcatcgtgccatttggcatcttcggtactaact

SEQ ID NO: 57791 - DNA, 778 bp, Triticum aestivum
  Clone ID: PAT_TA_57791
ccttaaccaagcataccataaaagaggatttttccgctctgaataaagaaaaatgggatattgaactgtagacatatgctgctctgagtgcccaaaatcttcattccggctatctaaaccggctttatactagccgcgacttgaagctgggctggtaaaaatgatgagggataaatccgacgctgaggtgagaatcaaggaggaccggattgctgatttgcaggaggccttgaaaactcaacaagctgaaacaaacaaggcacagcatgaattaaccagcgccttgagcaccgctgaacagctaaaggaaggcttcaggaaagagcggtctgattgggccactgagaaggcggctttaaccaaagagcggaaaatgctgaagctgcccttaaaccggtggcggatgaactaacgtccgtaaagcggcaaatacactccatgaccgctgcgatctttggcacacgcatcgggcacttgggaaacgatgtgcggaagaaactgaaggctgcctacaccttagtggaacaattatataccggagcccagcggatcatcaccacagcctctcataacaacccggcaccttctttaatccaggacactcttaacatgttgtcgatgcttccggcgcggatggaggagctgaagaaatctactgctcgaaccggagctattaacgcccttgatccgggcaaagggcatgggtgccagatttcgaccctgtgggaagcatctcaaggctatcccagcctggaagaagatggctctgaattcaacg

SEQ ID NO: 57792 - DNA, 562 bp, Triticum aestivum
  Clone ID: PAT_TA_57792
cgcggcaagggaggcaaggggctcggcaagggcggcgccaagcggcacaggaaggtgctgcgcgacaacatccagggcatcaccaagccggcgatccggcgcctggcgaggaggggcggcgtgaagcgcatctcggggctcatctacgaggagacccgcggcgtgctcaagatcttcctcgagaacgtcatccgcgacgccgtcacctacaccgagcacgcccgacgcaagaccgtcaccgccatggacgtcgtctacgcgctcaagcgccagggccgcaccctctacggcttcggcggctaggcttttcctcgcccccctcccctgcagatatcccaaaagcttgatggaaccgcggcttgtttagctctctatttgctctgtagttcgaactgaatcgtggaacaaagtgcttcgcatatgttgctggaaatcaaacttgtctcagtgaaataccgtgtctctgattttgttctgctgcatctctgttaatgtaaaattgttcttctgtgatgcaaagttgcgtgcgcttgggagtttgattgttttgccattctttttt

SEQ ID NO: 57793 - DNA, 537 bp, Triticum aestivum
  unsure (1)..(537): unsure at all n locations
  Clone ID: PAT_TA_57793
ggtactgtcactagggcaaccaagtgaagctctatcagcaccatgtgaagaagttgttttccatgttccgccgcaaaaaaccaaataccaaatactatgtctgcaccgtcaacaaaacattcgtaaagccatgccaagggatggtaaactccttccttccacttcattgaaaaagtattttcaggtccactacactgaaagaaaactaaaagattacattgacccaaattatgatacactcaaggtcaggcttgcaaatagtgatctatatgccaattgttgcgtcatgctaggaaccggcaagagagccaccgtaacaacaaactggtctgagttccgccaccttgcaaaaatccatgaaggagacaattgcaanttgtgatctatatgcacgatgagaaccaggcgctgcttntgtggtgaccttgataaataacaagacttctgctactgcatatttttgcagcataagtaacccacagcggaattcacattgcaatatacttgactctttaatcagcggtatggttaggtttc

SEQ ID NO: 57794 - DNA, 241 bp, Triticum aestivum
  Clone ID: PAT_TA_57794
tgggaggaggtccgaatccagagttggacagcaattgaggcaagacgacgtctcgttgccgatgcacggctatgtggacatcaatccaaggcgatctaagcggcttgcaaggagcactctcaacacagtgtcttatagccagaacggtgcatacggccaagagccttcccacccagggcaacattgatccgataattctgcaacatccccatgactagctggtatattactcttgtcgcat

SEQ ID NO: 57795 - DNA, 513 bp, Triticum aestivum
  unsure (1)..(513): unsure at all n locations
  Clone ID: PAT_TA_57795
ggcacgcatggccggctaaggccgtggagaatcctgtttgattgacttgctcagatccagtccagcccctttccgctgcgtttatgcccaaatcacttgaccggcggcccgtgcatgccggcctgccgtgagcaactccgacgacccgcctcttgcttcttcaaccagggcgagtctcgtcgatcccgcgcttatcagttggtcacgggcgacggcgtctccgtgtacgcagatcttgttgactcaagtgcgtaggcagcttggcactgacacccgttagctcgcgacggaaacctccaacagctacacgcaggaacgcacgatggcctgcgccttcttcttcgacgccgagccggtcggcgagcccggcgtgcacgccctggacgcgtgcgcgctctgcaccaagccgctggcgcgggacagcgacatcttcatgtacagaggagacacgcccttttgcagcgacgagtgccgccaggagcagatgcagntcgacgccgnctgcgccaggna

SEQ ID NO: 57796 - DNA, 203 bp, Triticum aestivum
  Clone ID: PAT_TA_57796
gacgcgcacctgagtgctgcatcatcatgggcaccatttgccagcttaatcgcgtggagattggtggccaatgaaaaaagcaagatctatactaatgagatagatggattcatcgttactctaggcagatgcaccaagtcgatgctagcgatgacaaataatagtggctgtgcacgcatcattgtgctgatcccacgaccatg

SEQ ID NO: 57797 - DNA, 232 bp, Triticum aestivum
  Clone ID: PAT_TA_57797
gcagcgtcgttaaacagcccgtgagcgtgtgacgccctacttgataagcgatataggagcactaccaccatatagccaggatcaccgaagatctaaacaaggccatatccgaacgcccttcccaccaatagcgcgtcccaaatggccaaggggaccccccctagaactaggctgcattaagcgctggaggaagagacggatacacgcgaatagacacaatgactatatcggc

SEQ ID NO: 57798 - DNA, 454 bp, Triticum aestivum
  unsure (1)..(454): unsure at all n locations
  Clone ID: PAT_TA_57798
agtttatgggattgaaagagagggtatactacatcgtatccatcctttctttatgatctggcctcccacattccctatgcgcaaggacgatattgcaagtgagatcacatcaagatgaggaaggtgcagctgagcagctgctgttagttatgtggtattaaggaccgcctcagacaagtgttgtatttgcttcagcgaaagcaagccaaagttacttcagggctgagttagcaacgtaaagctctagcaaataaatggattgtcagttagagaacacaactgaactttcagctttcactacttttccttgtggttggcaaatgtgcttaattgtgtcttgtactcttgtgggaccatatcacccttgcattactgttactgctatcaagatgagcgttggattcgcttcanaaaaaaaaaaaaaaaaaaaaaaaaaannnnaaannnnnnnnng

SEQ ID NO: 57799 - DNA, 635 bp, Triticum aestivum
  Clone ID: PAT_TA_57799
ggccgactatggaaacatgggctagtggaattgatagacgatttacttgtggggctgaggttagaaactttgtgctgacccactacatgttatgaaaactaaggtccctgttgaatctcctactaattgacaatttggacgatccttatgaagccgtcgaactgcatacagcttgaacctataacgcctacatctatcactgaacatgttgattcggatcgatgtccttacatctcccaaggggcagactgctttaaatgttgtgaccatatgggatggtacaggattttactcgttaaatgcagctgccaccggacatctaatgtcaaaaacataaggagacactgaactgatgcctacttcttgctatatgatcatggcaactgaattcattaaatgcactgaggtcgcgccatggaaagccaggggaagcacaagctctctgaaaaaaagcgatacagaaggggttgcctacacgcgctgctgtattagtataccaaaatatcaagagcccaaacacaagaccggtggacagtctgatcgttcttcagatggagttgactcaacgatattgcagcagtgtacagtgaacttaacaagtcgcccgagagagatttctgaggactgactacaat

SEQ ID NO: 57800 - DNA, 711 bp, Triticum aestivum
  unsure (1)..(711): unsure at all n locations
  Clone ID: PAT_TA_57800
ggaagaatacaggcttggattatttgatatgattatgataaaagataatcatatttctgttgccgggggcattacaaatgcaatgacatctgttgatcagttcttggagaaggaaaatcttgcagttcctgttgaggttgagactaggacactcgaggaagttagagatttattgaagtataccgatgagaacaagacttcattaactcgtataatgttggataatatggttgtacctcttcctagtggggatctagatgtatcaatgctcaaagatgcagttcagttgataaatggaagatttgagaccgaggcatctggaaatgtgacaatcgatacagtgaagaaaatcggagagactggagttacgtacatttcaagtggagcgttgacgcattccgtgaaggcgctcgacatatccctcaagatagacaccgagctggctcttcaagttggaaggcgtacaaaccgcgcctgacaccacaagtctgagatccacctgtgtaacttgacctcccgttctcctatacttctacagcccaactctctgcagtggacaagatgtttctctgcttggcgtggcttgtcggtttgtcattcgacatcaggctcgtcaccgcgctgtgattntctaactaatatagcgaaaggatgtcgnaccaacaccacggntactagagagtacaatgggaccagcatataatagcctga

SEQ ID NO: 57801 - DNA, 512 bp, Triticum aestivum
  Clone ID: PAT_TA_57801
aaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaataaaaaaaaaccaaaaaatcaaaaacgggggcgccgccatggaagattcttttttttaggggcccctaattccacttcttgggcccttctttttgcaccggcgggggggggaacatgcgccgggcgtttcccattttaacgcgctggggaaccccctccctttccccctcctggcccctttgggaactaggccccctcctgcttccccttcctaacagccgccccgcccccctgcggaaggcccccccccctggggcggtactttccccgcggcggggtgccctcttcacgcgcggggtgcccgcctcctttgcctgtgccctcccccccgttgctctttctctctgccttccttttttcgcccccttctttgtctttccccgttgctttttggggcgggccccccgttttccccccc

SEQ ID NO: 57802 - DNA, 198 bp, Triticum aestivum
  unsure (1)..(198): unsure at all n locations
  Clone ID: PAT_TA_57802
gccccggcatcacgtttgcgcaggccggggggagattgncctctcaccactacaaacccgtggtggcacccacttctttgtcccacccttggcgacgcagagccccagcccagaccccgcccaaagcactcatttaactggccttgcggacccacgaggcttctgcttactgcaactccctcgggggggggggcgtat

SEQ ID NO: 57803 - DNA, 326 bp, Triticum aestivum
  Clone ID: PAT_TA_57803
cccacgcgtccgcccacgcgtccgaaaaaaaaaaaaaaaaaaaaaaaaaaaaaaaaaaaaaaaaaaaaaaaaaaaagaagaaacgatataaaggataaaaagataaagaaaaagaaaaaaaaaaagataaataattttatatagtgaaacctttaattagtttaattgggccgatatttaaaattatcttagactgggagggacgggtggcgtttctccaagttaatcggcttttctggccgccccggttttcgccatgttgttttttttttgttggggcctgtttcgacttgggcttccgggctttttccgcggcttgattgggg

SEQ ID NO: 57804 - DNA, 367 bp, Triticum aestivum
  Clone ID: PAT_TA_57804
gaaactcgtctcccagtgagtccgaggtaagagtcacatctgtctcatatatgatgtataaattactgttttatgcacatctggattgtttttctataaatgattgggatttgaaatataagtttcttttctcgtctggatgtagcagagttacctcatttctgctatctgttctccaatatgggggagcttcttgccatttgaacagtaaagtgcacttatcaaaattcatgttatattgataactgggagtgatattcgtaaagcttgagtttgctgtctaggtgttttgatgaaatatgccgaccactaatacagcttgaaactctgcttccactttttttgacactggccgctttcatacgcc

SEQ ID NO: 57805 - DNA, 429 bp, Triticum aestivum
  unsure (1)..(429): unsure at all n locations
  Clone ID: PAT_TA_57805
gggaccaagtctaggagtgctgagagagactgcagctgtgacctgtggaaagatgtccctgcaaaatgaataccaaaacgcaggctggtcaataacaagttactgtcaccgaaagaaagaacagagtgatgggaggcaagacctgggttgactaggaccagtaccaaatcgacgtctcggttccgcgccgccacggcaagagcaatgcacgctccgacggattctccaacaagatagactggcctgtcgggtgccctcgagctctctgatttcaccgtcctctccacgtgctcgacaagtcctgcgttcatcggtgaggtgtcagagcctttttggtcagtcagggcctcaaagtagatatgcaaaccgcgattgcaagatgatcattngaagaatgaatcatggctttgcttttggttctcccctgca

SEQ ID NO: 57806 - DNA, 498 bp, Triticum aestivum
  Clone ID: PAT_TA_57806
gggacaagggcagccatggtactacccaacttctccgcaggagtcaggacaagggcaacagccaggacaatggcaacaaccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacaagggcaacatgggtactacccaacttctccgcagctgtcaggacaagggcaacggccaggacaatggctgcaaccaggacaagggcaacaagggtactacccaacttctccgcaacagtcaggacaagggcaacaactaggacaatggctgcaaccaggacaagggcaacaagggtactacccaacttctctgcaacagacaggagaggaaccatatgcagatttgcattatggtgttatcattggtggcattgtgagcaacactct

SEQ ID NO: 57807 - DNA, 488 bp, Triticum aestivum
  Clone ID: PAT_TA_57807
ggcaaacgctccatactactctggatggacaggtcttaccttggcagagaagctgcttttgcttttgcgcaacactacacaacgatgcctgctgagatgagaaccacagaaagagttgcttcgcctagggctgtagggcggagggagaagagaagaggcccccacagcactccctgtcgcctgtggacaggggcacgccgttcgcgagtccattgggagcaaagatcggatggtgttgacgatgagagagcacgccttagtataccgtgtgaggctagcgatggctctgctcgggcctctagaactctagtggagttgcttgtgggactgtacgttcgatatgagctcttgtgaaccgcgctatctgtggatgtatagagagattatatggcgtcgcgtacccgcaaagagcgtgccgaattgtgtactgcgactctgaccgtgagcactatgttattcaccgcataaatcgagatgactctgcttcg

SEQ ID NO: 57808 - DNA, 682 bp, Triticum aestivum
  Clone ID: PAT_TA_57808
tgtgggcggtacacgggcaaccagcgtactacccaggctcttctcatgagcccgcacacagatcacctaatcatggacagagcgcacctattattgacactgcgtaccttgtgctactactcgcagcctgtgtccgtagcagccaggcctatagcaaccactcagcgcaccgtcaacagccagcacaggggctgcattctactcatgagcaacagcctgtacaagcgcatcaatcaagacactggcgactagtgaactacccaacttctccgcagcagccagtacagtggcaccaaccagcacgagggccacaagggtactacccaacttctccacagacagtcaggacaagggcagctggggtactacccaacttctccgcaacagtcaggacaagggcaacgagggtacgtacccaacttctccgcatcagtcacgacaagggcagcagccaggacaaggacaacaggcaagacaagggcaacaagggtactacccaatttctccgcagcagtcaggacaagggcaacaaccaggacaagggcaacaaggatactacccaacttctccgcagcagtcaggacaagggcaacaaccaggacatgagcaacagccaggacaatggctgcaaccaggacaagggcaacaagggtactatccaacttcttcacagcagtcagga

SEQ ID NO: 57809 - DNA, 541 bp, Triticum aestivum
  Clone ID: PAT_TA_57809
caagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagtacgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaaataatgtgacatgcactatcatgtaagaacccgaactatactagttcaaacttgggaataaaagacaaacacaggtcttgtcta

SEQ ID NO: 57810 - DNA, 692 bp, Triticum aestivum
  unsure (1)..(692): unsure at all n locations
  Clone ID: PAT_TA_57810
caacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgactttcattgcgctccgtaccctgccaacgatgtgccgtgtcaatgtgccgntgtatagaaccaccactagtgtgccatttcg

SEQ ID NO: 57811 - DNA, 423 bp, Triticum aestivum
  unsure (1)..(423): unsure at all n locations
  Clone ID: PAT_TA_57811
gggaccacgccgccgagaggtccgggaggcgcaccatcgtcaccggcacctagttagcttctggctagctaggcccactgacagcatgtactactagtagcgtaagtaacctcggttgtaagcgaatcgaggaatcaaaataagcggcagtccgtcatagaatgaggttcgattcgatccttcatcttctaggcttataaatctgatctttcgaaaaatgcgacccgtctctatcatcctctaggatcatatatactcaaacaatctttcacacaagtctgttgtgatgatgtcttagtcgatgatgtctgcttcattgccgacgggctacgttctgtaatcgatgagacactcaaagacagagaaattccaaccagccggtggttggaagtttttggtcannaaaaaaaaaaaaaaanaaaa

SEQ ID NO: 57812 - DNA, 142 bp, Triticum aestivum
  Clone ID: PAT_TA_57812
gtcgaccccgcgtccgccagagcctgcagagggagcaccgaagccagcagtgctaagacgtcatggccggaggtggtcgggatgtccgccaagaaggccaaagagatcatcctccgggacaagcccgatgcccagatcgagg

SEQ ID NO: 57813 - DNA, 569 bp, Triticum aestivum
  Clone ID: PAT_TA_57813
gacacgagcttccaaagaacatcctgaactctgaacgacatttgcaagtgcacggatctgctgcatgtgtgcaactactgaaagcacagcagaccaagatcaaggactaccacaagagccgcatcagtgaaccgtactcggtgtggtgcatgatatcaacacggtgatgcaggctataagatagccgtgatcaggttcacggctcaagacagacacagtggacaccatgcaaacagttgtggatcgacatgtgcaacggcctgacggctaacaaggcacatgtgatctatctacgacctcaaagcgatatacgatcagatccagcgtcacttggccatgatcaagttaacattgagaccacaccgatgcagctgaagctgaccagctgcacgaggtcgaagaaatagagacacctagcgctacagcactactaggtgctgtgagcactcgcaacatgtgtgcatactgaacgatcgggacgattttgaatattctcgactccatgagatgataataactctacaactacatatattaaacatcgacttcttaaaccatggtataggccg

SEQ ID NO: 57814 - DNA, 620 bp, Triticum aestivum
  Clone ID: PAT_TA_57814
cgccatcgctcgcccccatgcctcagccccaccgacgctgccttcttcttcttcttctgcacgccagaaacagatccaaacgcaatcgcccccagcccttcttcctcctcctacatagccgccatgggagccccaaagtagaaggagctgcttcaagatctaaagggcagggtggtcagagccataccaggcagtaagatcgagcagggagtgtgtggcagcatccaaaaacaaagggaaaaaatgcttgatctcaatgagttgcctccagatctcaatgagcttcctcatgatatggatcagcagcaacccagcatacaacaaggaaactggacagaaaatggtcgatctgtttactacacgcaagcaagtcgtgatggtaaccctacgagccatgacaatgtggcaggccagtcatcagcccctggtgcccctgtagtggtgtctttgcagtcagagagccatactcttgatgacacaggaaccgaggcaaatgttcctggtccaaccaggactgagctaggagctcgggctgttgacggagctgtgcaagtagaagaaggagaggatgaggctggttctcaacctatggaaccctatgttggcatgaggtttgacag

SEQ ID NO: 57815 - DNA, 475 bp, Triticum aestivum
  unsure (1)..(475): unsure at all n locations
  Clone ID: PAT_TA_57815
gccgatgacaattgaggagagtcgacaaaggagattggggatgacaatcgaggagagtcatataggagtttgtggtgctagcaaccgttggaggaagacgatgttgatagggggctcttaagtcgagaggaaagctaattaaaagataaaaagaaggtactccaagaccctggggaatgtgaaaaggaattcgagcatccatcggcatgtccttcttttctggttatacggcgtactacctgtgtaactaaatataaaatgtttttgcagttcaaatttgaactccaaaaacatcttatatttagttatggaggtagtacaatagtgcacgccgtcatgtgcgttgtcgactcaggtctatgtctgcactaattaccatagaccagtcttcacggtgagctaataagccatgaagccatctaaataaagctaatccaacaatttacccctanaaaaaaaaaaanaaanaaaanaa

SEQ ID NO: 57816 - DNA, 764 bp, Triticum aestivum
  unsure (1)..(764): unsure at all n locations
  Clone ID: PAT_TA_57816
caacccatttccaccacaacaaccatatccacagccgcaaccatttccatcacaacaaccatatctgcaactgcaaccatttccgcagccgcaactaccatattcgcaaccacaaccatttcgaccacaacaaccatatccacaaccgcaaccacagtattcgcaaccacaacaaccaatttcacagcagcagcagcagcaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccagttctccttccaacagcctctgcaacaatatccgttaggccagggctccttccggccatctcagcaaaacccacaggcccagggctctgtccagcctcaacaactgccccagttcgaggaaataaggaacctagcgctacagacgctacctgncatgtgcaatgtctacatccctccatattgcaccatcgcgccatttggcatctntcgtactaactgagaagaaaatactctagtactagatatatgaaacaccgttttctcagtccatgggtttgggtcgt

SEQ ID NO: 57817 - DNA, 608 bp, Triticum aestivum
  Clone ID: PAT_TA_57817
gacattatgtctaggagaggatttcagcatctccggagggtccacagcctaccctcaagggcaacgtggccgccgactggacgcaccctagcgtgtgtgaccggcgtaagacttagcctctattcgctgccaataaaatgaacatatggtggctagtgagaaataagagtgctgagtgatgatctatgaataaggtcgcccttgcatattgatccgtgctcaagatccctggctatcgagtttgtaggtggtggatttgggcgcctgagtgcgcttctttgacacgtaagttatacatacaactggctggataaaccctgacgttacccaaggtaggtcgcctctagaggatatccgcctttctacagcgtgcatgcaacgcgataaggtcttctatagagcgaccttcccaaaatttactgaccctgaatgtacaacggcacgccccctgaaaccctgcattaaccccgcttagtgtggctggctacacatcacccctgttcgccacatgttggcagtagccctagaggcccggtccttatcgtcctttccatcacttgctcagcccgaatggcgaatgtcccgcgccctgtatagatcgcattact

SEQ ID NO: 57818 - DNA, 661 bp, Triticum aestivum
  Clone ID: PAT_TA_57818
cgctcgccccccattttgtagagaactgggtccatcacatccttcagcccacagtacatggtgtcttccatgtctagtgccgtcttcacctcacggacaatgtacttcttctcgtatataggtggattggctactatgagctctagtagtaccacgccgaagctgtagacatcgctcttcgccgtaagttgctgcgtcatgtagtactctggatctaggtaacccagtgttcccttgacatttgtgcacagctcgccttcctcgctgtctgataccaacaaggagaggccaaaatctgcaaccctttgcggtcatcttcgaatcaaggagaatgttggtggacttgatatctctatgaatgattggaggattggcatggtcatggaggtaagctagccctctagctgaatctagagctatttgaagtctcatactccaatccaattgtactcctttcataccatataacgcctcacttagagttccattggatatgaactcgtaaaccagcaatctcctcttctgagagtgatagctgagcgtctttcagaagaggagattgctggattaagagaattattcaagacagtggacataaaaaatagaggcgtaatcactttttggtgagcttaggaaagggctgacaagatatgggcacgaa

SEQ ID NO: 57819 - DNA, 278 bp, Triticum aestivum
  Clone ID: PAT_TA_57819
ggacgccgcggtccggtccggatcccggtcgaccccgcgtccgcccacgcgtccgagggaggccgtcaggggttggaggttaggaaggtgcttgactcgcacgatgaggtcatctgccacccattgagccttggagtgaagactgggctgtcatacctgtggcgcagcagggcttgcaacccatttgtcagcttgaagaaagagtactagggcatcttctggctggaggaggtggtccccttcttccagaacgccgccctctccttggagtgtgtcac

SEQ ID NO: 57820 - DNA, 140 bp, Triticum aestivum
  unsure (1)..(140): unsure at all n locations
  Clone ID: PAT_TA_57820
gtcgaccacgcgtcncgggaaattggattcgaaataagatacgaaaaaagtaggctcaacgtcaagagaaccaaatgtatgcaggagatagtatgtggatactcggtgggtccaaattaaattcattgtcccattcctgc

SEQ ID NO: 57821 - DNA, 364 bp, Triticum aestivum
  unsure (1)..(364): unsure at all n locations
  Clone ID: PAT_TA_57821
ccggtcgaccacgcgtccgccacatagacgctgctctatattagcgctgggggttcgctgttctacacctgacagatgggcgaggggacagggcgagcgccggactccgacgtcgtcacggaagccggcgccgcgcgggtgccagatccgcggaaggccagtattctctgggccagcgatgaaggtggggggggcgctaccgnttctccancagccgtctccgtcggccacggagatgctgtgcttccaccggtccgggtcggcggaccgggactcgaactcgaaccacttcatgccgggcctgctcccggactcccgctccttggagcgcgcgctgcgcttgtcgtcggccgacttcctgagc

SEQ ID NO: 57822 - DNA, 198 bp, Triticum aestivum
  unsure (1)..(198): unsure at all n locations
  Clone ID: PAT_TA_57822
gcgtccgcgtgcatctcgcgctcccggcgtcgtcggcggcggcggggtccgggcgggcagtggccaccaagaccgcgaaggtggtggacgtagacggcttcatggcgcagttcgtggagctggtttggttgaggatggtcgtgctggttgccacggntctttttggntatattttaatgatgtgttctttgtgggggg

SEQ ID NO: 57823 - DNA, 308 bp, Triticum aestivum
  unsure (1)..(308): unsure at all n locations
  Clone ID: PAT_TA_57823
tccgcccagcgtncgcggacgcgtgggcggacgcgtgggctacaactaaagaatgggagcggtgcaacaaaactttgtttgtcctgttttcgattaaattcattcactaaaatgtacatccaatacatgctcccgtggaggatttatacgagttttgttctctgaagattgcacttctgctacttgcaattgtaccttctggtctaatgtgacgatgttatagagaaagtcttgtgcaacagtagtcaatcaagatgggatattgattggctcactgcagcgtgtgccgagggtagcgagggcagttg

SEQ ID NO: 57824 - DNA, 483 bp, Triticum aestivum
  Clone ID: PAT_TA_57824
gcgccatgcacgcgcggagccctgggcctgaccctcatcgcggagctcgtaggcgtgctgcaggtgaccaccaccaacgacaaggcgctgtgcacgctgtgcaagaacctgaaggaccccacccctgccctgaacagctgggaccccagcgtggtcatgctctgcacgtgggtcgacggtgacctgcgaccgcggaaaccgcgctagctgtgtacatcagcgaatttgacttatgtaccatctgagcctgagcttggcaacagcagctttgcaatacctggaactctacaaaaatactattgaaggaactatacacgcgggacattggcgatctgaacaacctaaataacttggacttgcacaagatcaatgcttcagggactatacctccaacactgagggagttaaagtgccttgaattcttgcagctcagcggcaatcgtttgactggaccaattccaaggggagctggctggaatatct

SEQ ID NO: 57825 - DNA, 151 bp, Triticum aestivum
  Clone ID: PAT_TA_57825
gtccgactcctggtcaccacgcgtccggtgcctctcgacgcgtcgacacggcacaccgccagggcccgaggagagggcgcgccgcgcgccgttcgcgaagccttttgggactagcgagctcccttcctcgacggatgtcgattttgttgag

SEQ ID NO: 57826 - DNA, 297 bp, Triticum aestivum
  Clone ID: PAT_TA_57826
ccggggtcgcacccacgtcgtgccgacacgacccgtctccaacaacactacatattgcgtgtgctctcctatcctatagtaaccacaggagcagcagcttcgttttgctctagaccgaggcaacaagcctaccattggaaccgagcagcagttagatcgctatgataaataggagccgcacgctccgcaatagcttaacaggcggcccggcagcaccagcaggcccacgaaccccgacgagatcctacatgacttccacgctacccaccccatgcgacgcctactccacctccttcg

SEQ ID NO: 57827 - DNA, 826 bp, Triticum aestivum
  unsure (1)..(826): unsure at all n locations
  Clone ID: PAT_TA_57827
gccgggacaagggcaacaatcaggacaagggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactacccaacttctctgcaacagccaggacaagggcaacaactgggacaagggcaaccagggtactacccaacttcgcagcagtcggaacaagggcagcagccaggacaaggaaaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaaagcgcacaatcaggacaatgggcactagtgtactacccaacttctnncgcacagccaggccaattgcaacaccagcacaagggcaacaac

SEQ ID NO: 57828 - DNA, 621 bp, Triticum aestivum
  unsure (1)..(621): unsure at all n locations
  Clone ID: PAT_TA_57828
gtcataaatttgtgtaattttacttgatctagttgacgaaatctgatgggggaactaacttggccaatcattgcaatttctttctctcgaatattgcagaaatatatttgggtagaccgagtaaagctaattggcaaatattctaaatagtacaaaagagcgaaacatcctcaccttatcaagaatactaaatttagcggacagtagtcattttgcagcacacatcatcagacatgtagcgaacttgaagcaacagttttcaaataagaatatagagcacaaaaccatcgattactaaattcaacagaacataaaatgtaagaacatccatgtcaagctgatacccctgtccaagcatcacctgtgtgtcataaacagggaacaaaaataaaataaagattaggaactacatcatcgtttagagactattggantagacttgtgttgtgccgagtgttgcattgtgtgctcttcaggtcactgaaagcgagtgtctagtactgtaaaaagggagaaaccggactctgtattatcatcatcatctaaggaaaaaaaccctgaaataaatctgaactttcaccgtctccttctctctctataactcttcggcaatttcctctg

SEQ ID NO: 57829 - DNA, 603 bp, Triticum aestivum
  Clone ID: PAT_TA_57829
ggaacatgtagtgccagtgcactctagtgtgatcgtacatatcgcaaattgcgatagtgcactctagactatgtgatagaggtatctcaacctatgtgcgctgatcggtatgtatgtgtgggaggaatgctctgtattatggagcgcgcaaacgcacagaccatggactctatgagcatcactatagctaaggtctggatagcatgaatggcttgagcgaactgactagagggccaagaggcactggcatgaaaacagatcagggcgctggataagctgctgctgtacctgcaaaaggacatgatctttatactggcgacagcctctatgctgataggccagatcagaacaacagggctgactatcgttgaaacatactcgcatgccgaattcttcgatcttagatgatacagtgaggtatgatgtctcacacagagcatgcatactacaaatgtattggagcgatgcacccccagagaaagtaagaggcttgatgctgcttatcaagcaggtaaagacaagtgaagcaattcacctgtacttgctgttgctctactgtcaacaccagtggtcaggtcattggacttgccgagatggttggac

SEQ ID NO: 57830 - DNA, 556 bp, Triticum aestivum
  unsure (1)..(556): unsure at all n locations
  Clone ID: PAT_TA_57830
cacggagtgtctgagttcaccatcgacggacataccacctcaaggacggagaacaagttaagaacgtcatgagcgctgccggtggagccggtccttcagtgaacctaaacatgcctgcctttttgtgtcatcctatgaccgaacatccttgcaccatcattcagcttctctccctctacactttcaactggcaatctggtcaagcgacagaggtgttagagtatcaagatagtattcttgagaggctgcaccggctgttggtctcctgaaaatgggtaagtggtccgatgatgatggcggcttctaaaacgaatgcatgtggtgtgcactctaggtaggctgcaccggctgttggtcccgatacgttatgtggatgtatcggtgacgacacacgttttagatatgggngagtgagatcactccacattattgagtttgtaggtgtgagtggtggcttcggatggatttatgtatgttcttgtcagacctttggagaataattaataaagatggctacatgcttcgattaanaaaaanannnnnnnnnnnnnnnnnn

SEQ ID NO: 57831 - DNA, 268 bp, Triticum aestivum
  Clone ID: PAT_TA_57831
cattattgcagcaacaacaaccaccattttgacaacaacaaccaccattttcgtagcagcaacaaccaccattttcacaacaacatccagccattttcgcagcaacaacagccagttctaccgcaacaactattattatcacagtaactattaccaacattttcacagtaacattcaccgctgttgtaggcataactaatgctactacaggagcaactccaatttttgaatcaagactaaccacgtctaccgtcacaaacaacatttt

SEQ ID NO: 57832 - DNA, 783 bp, Triticum aestivum
  unsure (1)..(783): unsure at all n locations
  Clone ID: PAT_TA_57832
caacaacaacaaccaccatttacacagcaacaacaaaccatncgctttgtcacatagcagctcactcagattgtcacaggcgagacagcangacaggcaaccgaaccaaacacactaatcaatcgcatttttacgatcagcgaatcagacaagccaccgcatctattcactaactagtccacacagatatctcacactaatgtcatcacactcatcgcatttgtacgcagcatacaaaccaactcacacagtgtttgcacatgccaaacaagcaagatgacctagctagttcataccagtctgtgtattgcattcagtataaacaccatgtgaaggtatctcctccagcagcagtgcatgcctgaggcaatgcagcgatgtcttgctaggacacaaatgttgcagcagagcatttgacatgtgatgcagaaacactgtagccagcagctgcggcaaatgcccgagcaatcccgccatgagtaaatccgtgctatcatctactatatcatcctgcagcagcagcagcagcaacaacgacaacaacaacagggtcagagtatgatgcaatatcagcaacaacaacctcaacagttgggccagtgtgactgccaatctcagcagcagttgcagcatgaactcgtgcaagagactaaacaacaacgattgggacatggtacctttttgcagccacgccatatagctgagcttgaggtgatgacttgcattgcactccgcaccctgacaacaatgtgcagtgtccaggtgccgttggacgaaaccacc

SEQ ID NO: 57833 - DNA, 602 bp, Triticum aestivum
  Clone ID: PAT_TA_57833
ctggagcacaagtgggagcagctgcagcacatgtcggacggcggcgccgaccaggtctcgcaggtgttcgagaagtcgcaggcctacgtcaagcgcttcagccgctacaagaaccccgacgccgtccgccaggtccgcgagacgctctcccgctacagcctcgtcgagttcgagctctgcaccctcggcaacctctgccccgacaccgccgacgaggccaaggcgctcgtcccctccctcgtccccggcggcaggttcgacagcgacgaccgcgtcgacaagatgctcaacgacctctcactcatcaagaagttcgagtagccgcccccataatatgctcctgcttgctcttcttgttcctgttcatccaatggacatggcatggagattcatctccctcctctgccctccatgtgtcatttatcagtctcaagaagtacttactagctactggtagcttagtttggcgatgtttgatcttcagattatctcctcctatgctatgatcagaagacatcagtgtcaatctcaaatgtatggagctaactaaactttgttgctatgctgtctttgagaaaaatgtagtagctgcttgttgttat

SEQ ID NO: 57834 - DNA, 751 bp, Triticum aestivum
  unsure (1)..(751): unsure at all n locations
  Clone ID: PAT_TA_57834
ggagcatacagtcatagccagggtataaaaggacttcgtgatgcaattgcttctgggatcgcttcacgagatggattccctgctaatgctgatgacatttttcttacagatggagcaagccctggggtgcacctgatgatgcaattactgataaggaatgagaaagatggcattcttgtcccgattcccgagtacaaagggtactgaggcttctatagctcttatggcggatctcttgtcccatactatctcaatgaatcgacgggctggggtttggaaatctctgatgttaagaagcaactcgaagatgctcgctcaagaggcatcgacgttaggngctttggtggttatcaatccaggaaatcctactggacaggtacttgctgaggaaaaccaatatgacatagntgaagttctgcaaaatgagggtcttgttcttctggctgatgaggtataccaagagaacatctacgctgacaacaagaaattccactctttcaagaagataggtgagatccttgggatacggcgagggatgatctccctctagtatcatatcaatctgtttctaagggatattatggtggaagtgtggtaaaagaaggtgggtacatgggagattactggcttcagtgctccagtaagagagcagatctacaaatagcatcagtgaacctatgttccaatatcaccggccagatccttgctagncttggcatgaacccaccaaggctaatgatgaatcatatgc

SEQ ID NO: 57835 - DNA, 769 bp, Triticum aestivum
  unsure (1)..(769): unsure at all n locations
  Clone ID: PAT_TA_57835
ctccgaaatctccaccagctgctaaagctgctgtggttcctctgaaatctccagcgactgataaagctaatctggtacctctaaaatctccatcagctggtaaatcttctgtagttgtacccataacactaccatctgctaaggatgctggcactccttcaagatcactgcaagttgataaatccataccagccccccaagactaccacaagttgataaagctgctccacttccctccgcatcgccacaaacttcttccaccacttattcagaagctcgggaagagactactcctataaaggttacatccaccagagttctgaggttgctgtcacaacatcaaggccttcaagtgcccctgtattccctacaccaagaacaactgtaccagctactccacaagttcaagtttctacattgcttccgcgctcagcgagtgaagcagctggaagatcaggaaatgatccttccccttctgccccagcgtatgttccacagacctaccgtaatgccatccttggtaagcctggtctgggtacatcctcttcaattctttcatatcagtcaactactctgggacaaggtactgcactttcgcagccgctatcaacatatgcatcaactgcgtcactaatgatgcctcctgctgggaggaaccgatcagttgttgtcagctaggcatggatttaaatctgggttggnngaattcagatacactntgatagttggcaaccatggnanaggntgatangtagcatcaacaatcatc

SEQ ID NO: 57836 - DNA, 808 bp, Triticum aestivum
  unsure (1)..(808): unsure at all n locations
  Clone ID: PAT_TA_57836
gacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccaggacaagggcaacaaggatactacccaacttctccgcagcagtcaggacaagggcaacaaccaggacatgagcaacagtcaggacaatggctgcaaccaggacaagggcaacaagggtactatccaacttcttcacagcagtcaggacaagggcatcaatcaggacaaggnngcacagggtactacccaacttctctgtggcaaccaggacaagggcaacaaggctacgccagccccataccatgttagcgcggagtaccaggcggncccgcctaaaggtggcaaaggcgcagcagctcgcggcacagctgccnggcaatgtgccnggctggagggcagcg

SEQ ID NO: 57837 - DNA, 777 bp, Triticum aestivum
  unsure (1)..(777): unsure at all n locations
  Clone ID: PAT_TA_57837
cggacgcgtgggttcgaacgctgtggagatcgaaagaaaattcgtcaaggacttgaagaagcaaacactttggatgaagaagatggaacatgttgtggaaaaacttgtttgcgttgtacatttcttgcggttagagataaaaaatgtcttcaagaaatacgaagatgaatcaatggaagtgaaagggacgattcagttaactttagggtctgccgatctcgctctgcattatgcgaacatcattttcaagataaagagtttggcatcatttgtaccgtcaattccgaaaagcggcgttgattcattgtaccaagcgttgcctccatatgtcagatcagccatacaaaccaagttgaaatgtcatgagtacaaagaaaagaggacagttgaacagctcacatatgacatgaacaagacaatgaaatggctcttgccaatggcagaatccacaataaggatgngggcgtcggatgcttggtgaatggcaggaccaaggggagcccaacggaacaaatggcaggaaggcgctcaagattcagacgctataccatgccgacaaggagaagaccgaacactacattctggacatggtgctggctctccccatctcgtatgtgcgatccatgcgaggctcgacaagttcttgaacagtacttctgatcggtcggagatgcaggaggcgagcaaattcagttagcactagcccatagtggnaccggcagcccctttcacngnggggaagggatagcccccgggatcccccatatcatgataact

SEQ ID NO: 57838 - DNA, 490 bp, Triticum aestivum
  Clone ID: PAT_TA_57838
gtaaaaatatgactttctgacgtagaagacctcatcaactcttggaaacatgaatggaagcatgtgatcgagtatagaggagagggacttgtcattcagtgttgaacacttcagtgaaacacatatgctatttgaactgctggcgagtatgttaagagcctgctaggtactcaaggaggattacactcgaacaccgtactgtgtgctggaaggggctggtatccatcactgctggtagcacttggctccctactgcaacacagatatcaggtccttgtcgctgtcaaggctcgactctgagcttagccagctcagtgttttcgacattgaactacacaccaaagctccaattgcacatggccgctggatggtgctatctgtagcattaaaaaggcgtgagcgctatacacacaagagcctggcttaatacatgtctagacgcttttgcgcacatgtagctcgaacctgagacatgcttgtgagatgctgt

SEQ ID NO: 57839 - DNA, 689 bp, Triticum aestivum
  Clone ID: PAT_TA_57839
cattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgcccgttgtatagaccaccactagtgtgcatttcggtgttggcaccggagttgggttctactaataggggaaggtctctagtata

SEQ ID NO: 57840 - DNA, 518 bp, Triticum aestivum
  Clone ID: PAT_TA_57840
caacgcaaaagtagctggagtgttatgcttcctagtccttgtggttgcctcttcttgttcgctccatgcacgtgcagccaatgacatagatcattgccgccttgataaaaaaaggtgatgcgagattgttggcatcacatcgagaagaaacttggtgaccagtacccgccactccatagcgcatgttgcaatacaataagagatgcgaaagacatccactgcatctgtgatcggttcaccgctcacgaactgactttgctcagtctagccaagtttgccatggctacacatgtatgcggcaatgggttgcacacagacactcactgtgcaggttatcatgttccggaaataaagctaccacccccacccacggcaagtacctaggccttaagtgtaagaccattttcatgatggagaaatagttaactaaagcgaagaatgatgtccgatgaatggcatttgctgcgtatttgacctttttgtgcgtattaaaaaaaattgcgcatagcctcgccact

SEQ ID NO: 57841 - DNA, 696 bp, Triticum aestivum
  unsure (1)..(696): unsure at all n locations
  Clone ID: PAT_TA_57841
gtggacagtctggcacatttcggtggcaagatttttgtacagttacagtggcagatttcagaaatttgtagagcacatgattaacaagaagaagatattctgtcaaggtgtgtactttttacccattgcactaatcgtttgctttgagcgatagctaaaagaaagtacttcctttggtataatctttcgtgcactcacacgtataatatctccatttccttattttttgttcttccgtcagtagtatttcttttagctactatttgcccttggataaatcactcatgctattttaatgaggttcattctagccgtttgctcacgagaacagaaacattttatctgttagctaaatgaaagtacattctttgaatttgccactttttcctgcattcatggatataatctgtccatttcctggattttttattcttccattagtagtatttcttttagctactttatgccatagcataaatcgctcatgctattttagtaagatccactcctgctctatgctcactagaacggaaaaacaaatattatctgcttattttagcgtcgcatttcgctcacggtattcatggtcacagataaaacagtaataaattgcccttctctgtcaacttacggagtacnaaagttgtcatgcctgatcagcaaaagatttgtgcttctttggcccatatgtatcac

SEQ ID NO: 57842 - DNA, 661 bp, Triticum aestivum
  unsure (1)..(661): unsure at all n locations
  Clone ID: PAT_TA_57842
caacaacaacaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcaccaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttgggtcgttgtagcggtgaaaaaataatgtgacatgcactatcnatgtagaacccgaactatactagttcaaacttgngaataaaagacaacaca

SEQ ID NO: 57843 - DNA, 727 bp, Triticum aestivum
  unsure (1)..(727): unsure at all n locations
  Clone ID: PAT_TA_57843
caacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggccncagggctctgtccagcctcaacaactggccccagttccaggaaataaggaacttagcgctgcagacgctgccagcaatgtgcaatgtctacatccctccatattgctcgaccaccattgcgccatttggcatcttcggtactaactgagaagagaagaactctagtactagatatat

SEQ ID NO: 57844 - DNA, 278 bp, Triticum aestivum
  Clone ID: PAT_TA_57844
cacgcacgaaatcgatataccgcggtcggacttcgagagcttcctcaacatgggagtctggttcaagaaatatctgaaggagagctgaggccagagatttcgagggcttcctcaacatagccagaggacttcaaagctacttgacgaatttgtcttttttgtgaggcgactaaatattttttagaaccgacaacaagtatatattccccctccacccccccaataatgagcctaaagagattgataaaaatgaacagcatcagtctagttcttggttg

SEQ ID NO: 57845 - DNA, 673 bp, Triticum aestivum
  Clone ID: PAT_TA_57845
cattttcgcagcaacaacaaccaactataccgaaacaaccatctattttctcagcaacaactacacaccattttcacagcaacaaccaccgttttcgcaacaacaacaaccagtactactcgtaacaaccaccattttagcaacaacaacaaccaattctaccgcaacaaccaccattttcgcaacaacaacaacaaccagttctaccgcaacaacaaataccatttgtttatccatctatcttgcagcagctaaacccatgcaaggtattcctccagtagtaatgcagccctgtggcaatgccacaaagtcttgctaggtcgcaaatgttgcagcagagcagttgccatgtgatgcaacaacaatgttgccagcagttgccgcacatcccccagcaatcccgctatgaggcaatccgtgctatcatctactacatcatcctgcaagaacaacaacaggttcagggttccattcaatctcatgagcagcaaccccaacagttgggccaatgtgtttgaccaccccaacagcagtcgcagcattaactcgtgcaacaacctcagcaacaacaattggcacagggataccttttgtgcagccacaccagatagctcagcttgaggtgatgacttccattgtgctgcgtaccctaccaacgatgtgccgtgtcaat

SEQ ID NO: 57846 - DNA, 763 bp, Triticum aestivum
  unsure (1)..(763): unsure at all n locations
  Clone ID: PAT_TA_57846
gcaacgagtgcaggaagtgctgcatggaggaggagatagacgaggtggaggtggagctcatggtgctggattccggcggctcctctgctgatctgcattggtgaagattgcttgatgttgctagtggtggtggcgaggaggcgttgcccacaaagcgtctgttctttctttattttggtttggaacttggtaggactcagcagcaggggaagggagggagaaaaacgcttctcatccttgccctccttgctatcgtggcgaccaccgccacaactgcagttagagttccagtgccacaattgcagccacaaaatccatctcagcaacagccacaagagcaagttccgttggtacaacaacaacaatttctagggcagcaacaaccatttccaccacaacaaccatatccacagccgcaaccatttccatcacaacaaccatatctgcaactgcaaccatttccgcagccgcaactatcatattcgcagccacaaccatttcgaccacaacaaccatatccacaaccgcaaccacagtattcgcaaccacaacaaccaatttcacagcagcagcagcagcaacaacaacaacaacaacaacaacaacaacaacaacaacaacaacaagaacaacaaatccttcaacaaattttgcaacaacaactgattccatgcatggnnatgttgtattgcagcaacacaacatagcgcatgggaagaatcacaagttttgcaacaaagtacttaccagctgntgcaagaaa

SEQ ID NO: 57847 - DNA, 720 bp, Triticum aestivum
  Clone ID: PAT_TA_57847
cattatcgcagcaacaacaaccaccattttcacagcaacaaccaccattttcgcagcaacaacaaccagttctaccgcaacagccatcattttcgcagcaacaactaccaccattttcacaacaacaaccaccgttttcacaacaacaacaaccagtactaccgcaacaaccaccattttcgcaacaacaacaacaacaaccatttgtaccacaacaaccattattttcgcaacaacaacagcaactagttctaccgcaacaacaaataccatgtgttcatgcatctatcttgtagaagctgaacccatgccaggtatacctccagcaggagtgcagccctgtgggaatgccacaaaggcttgctaggtcgcaaatgttgcggtagagtaattgccatgcgatgcaacaacaatgctgccagcagtagccgaacatcccccagcgatcccgctatgatgcaatgcgtgctatcatctactccatcgtagctgcaagaacaacaacaggatcggggttccatccaaactcagcagcagcaaccgcaacagttgggccaaagtgtttcccaaccgcaacagcagtaacagcatcaactcgagcaacaaactcaacaacaacaattggcacaaggtaccttgttgcagccacaccagatagctcagcttgaggtgatgactgtcattgtgctccgtaccctaccaatgatgtgccgagtcaat

SEQ ID NO: 57848 - DNA, 739 bp, Triticum aestivum
  unsure (1)..(739): unsure at all n locations
  Clone ID: PAT_TA_57848
ggcactacccagcttctctgcagcagccaggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaatgtccccgcagcagacaggacaagcgcaacaactaggacaaggccaacaaataggacaagtgcaacaaccaggacaagggcaacaagggtactacccaacttctctgcagcagcctggacaagggcaacagtcaggacaagggcaacagtcaggacaaggacaccaaccaggacaagggcagcaatcaggacaagagaaacaaggctacgacagcccatatccgcagccgcaaccatttccatcacaacaaccatatccgcagccgcaaccatttccgtcacaactaccatatccgcagccgcaaccattttcacaacaacaaccaccattttcgcagcaacaacaaccagttctaccgcaacaaccatcattntcacagcaacaactaccaccattttcacagcaacnaatcaccgttttcgcaacaacacnaatagtactacagcaacaaccaccatttttgcagcaacaacacaactagttcta

SEQ ID NO: 57849 - DNA, 401 bp, Triticum aestivum
  Clone ID: PAT_TA_57849
tggacccgtccgacgtgaacgtgatgcggctgcacgcgtacttttctctggacaaggccgcgcatgacctgctcgggagcggaggacatgtttactcagcgccatcctaatgagccggacaggagcctccaccgaaagcatatactgcgaggttcttctggatgaccggaggagggtagacatgggatattgacttcgaaggcatggacctcacctgatgaatccgttggtcgtatcaggggcctgccgttcaatctctagcttaatacactaaaagagcgacctctgcggtttgtgcctggacggagaggctgccatccattctagatggcgcatttgagtaccttatgcgcactgaaaagaggtgcacttagtcctaggactattcatgtgtacactat

SEQ ID NO: 57850 - DNA, 786 bp, Triticum aestivum
  unsure (1)..(786): unsure at all n locations
  Clone ID: PAT_TA_57850
gggcaacaaggtcagcaaccggggcaagggcagccagggtactacccaacttctccgcagcaatcaggacaagggcaacagccaggacaatggcaacaaccaggacaagggcaaccaggatactacccaacttctccgttgcagccaggacaagggcaaccagggtacgacccaacttctccgcaacagccaggacaagggcagcaaccaggacaattgcaacaaccagcacaagggcaacaagggcagcaactagcacaagggcaacaagggcagcaaccagcacaagtgcaacaagggcagcagccagcacaagggcaacaaggtcagcagctaggacaagggcaacaaggtcagcagccaggacaagggcagcaaccagcacaagggcaacaaggtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacagggggcacatgggtactacccaacttctccgcagctgtcaggacaaggggcacggcncagacaatggctgnncaccagacaggggcaacagggtactacccaa

SEQ ID NO: 57851 - DNA, 261 bp, Triticum aestivum
  Clone ID: PAT_TA_57851
tttttcttgatagacacatgcataattagatgtttgtaagagaaacacatacatacataagggaaactaaagtatatattattccatggtcacatttattggtcacatacagtggtatgtgatagtttattggtcaccaatggaagctacatcacaagtaatatccgctagtgatggggatgttgcagaatttcggatcaatgttgcactgggtgggaaggctcttacaaacatctaattatgcatgtgtctatcaggaac

SEQ ID NO: 57852 - DNA, 742 bp, Triticum aestivum
  unsure (1)..(742): unsure at all n locations
  Clone ID: PAT_TA_57852
cagggcaatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaaggggcacaagggtactacccaantttctcgcagcagtcaggacaagggcaaaacaccagacagggggcacaaggatactacccaactttctcgcagcagtc

SEQ ID NO: 57853 - DNA, 665 bp, Triticum aestivum
  unsure (1)..(665): unsure at all n locations
  Clone ID: PAT_TA_57853
cccacgcgtccgggaagaagaagtttgagcggctgctcaagagcgtggaggagaagttcccgagcaaggtgaagggccgtggtcaggttcaacgcgccgctggctcaccagatgatggccggcgccgacgtgctcgccgtcaccagccgcttcgagccctgcggcctcatccagctccaggggatgcgctacggaacgccgtgcgcgtgcgcgtccaccggcgggctcgtcgacacgatcatggagggcaagaccgggttccacatgggccacctcagcgtcgactgcaacgtggtggagccggccgacgtgaagaaggtggtgaccaccctgaagcgcgccgtcaaggtcgtcggcacgccagcctaccatgagatggtcaagaactgcatgatccaggatctctcctggaaggggccagccaagaactggnnaggacgtgcttctggaactgggggtcgaggggagcgagccaggggtcatcggcgaaggagattgcgccgctcgccatggagaacgtcgccgctccctgaagagagaaaagaaggtttttggtgcatggagcattcatccatcttcagggttccccgtgtgaaggagatagccgcttgntgtagtgaagggccgatatatacatatttatatatagactaataagtacttat

SEQ ID NO: 57854 - DNA, 537 bp, Triticum aestivum
  Clone ID: PAT_TA_57854
gtgcttaccaacccaccatgaagacatttctcatacttgccctccttgctatcgaggcgaccaccgacacaagtgcatttagagttccacacgccaaaatcgcagcctcaagatacatcttagcttcagccacaggaccaagtcccattggaaccgcaacaacgagctgtagggcagcaacaaccatagccagcactacaaccatatccacagccgcaaccatcttccatcacaacaaaccatatctagcaactgaaaccattatcacagccgcagctaccatattcgcatccacaaccatttcgaccacaacatgcttatccacgaccgcaaccacagtattcgcatccacagcaaccaatttcacagcagcagcatcagcagggtctaccacggctgcaacagcaacaacaacatcaagaaaagaaattcttcaacgaattttgccacaacaactgactccatgcatggatgttgtattgcagcgacacaacatagcgcgtggaagatcacaggttttgcaacaaaggacttacc

SEQ ID NO: 57855 - DNA, 711 bp, Triticum aestivum
  unsure (1)..(711): unsure at all n locations
  Clone ID: PAT_TA_57855
cgacgagatcgtagactacatcaagaagaacaaggagactgctgggcaggcggctgcggcggacaccgagaaggcggcggaaccggctgccaccgagcctctgaaggacgagctctgagcatcggtctgtctagcagcagacaggtagaggagggggaaacatgtcttggcaagttcgagctgtctggcatccctcccgcacccaggggagttccccagatcacggtctgctttgacatcgatgccaatggtatcctgaacgtgtctgctgaggacaagacgactgggcagaagaacaagatcaccatcaccaatgacaagggcaggctgagcaaggaggagatcgagaagatggtccaggaggctgagaagtacaagtcggaggacgaggagcacaagaagaaggcggagtccaagaatgccctggagaactactcgtacaacatgcgcaataccatcaagggacgagaagatcgcctccaagctgccggccgacgacagaagaagatcgaggatgccatcgatgctgccatccaatggctggacacgaaccagctcgctgaggcgggatgaagttcgaggacaagatgaaggagctggaggccctgtgcaaccccatcatcgccaagatgtaccagggtggctggtgccgacatgganggcggcatggacgacgacaccccagctgcatccggcggccctggccccaga

SEQ ID NO: 57856 - DNA, 335 bp, Triticum aestivum
  Clone ID: PAT_TA_57856
gcaagacagcagcgaccattttcgcagcaacaacaacaaaccattatttatcacatgacctacttacttcggtgtcgcaccaggcaccaattgcagagcaggagccggagccacaacagcaacaacaaccttttactcagcaacaacaaccacaatgttcacaggtgggacaacaacggcagtatctagggcatcgagtgtggtttatactacacgcacctgtgccaaggcagcaacatttaccatctaatcatccatcttgtaggcagcaccataaccccagccggtgctgccatatctgatgcctcgtgcatgtggatcacttctgccagtat

SEQ ID NO: 57857 - DNA, 673 bp, Triticum aestivum
  unsure (1)..(673): unsure at all n locations
  Clone ID: PAT_TA_57857
ggtgatactagaaggaactcaaggaagtatctgcaattggttatggtttcatcttgctgctgttagctattattatttagcaactgtgatattcagcacccaggctggctaatttcttgtcctaccaccggatgtctcagctgagtctctggcgccgccacggtgctaagagagccccgcaattactccttccttgtagattatcgttatcatcagttacacacttgaatcgagatcttaacagtattgacctcacgaaggaggaagaagcgtcagcagcgcagatcaggagttcccttttgaaggcacgcaatggaaatgtgcaggatttgggttcagtcccttggggttgactgtccgggaattcagcttacaagtaacactgtggacagcttgttgtgtaagtttggggatgactggaaatctgcttttggtctatttcagtgggcacagttgagtggcaattacaagcacacggcatatgcttgtagtcggatgatcgacttgcttgngaagatgaggcagattgcncgatgtgggatctattgtctgacatgcactgcagaggccttgtgactgtcgagacagctgcgaagagcatcaggaggctggcaggtgcaaggagatggaaggatgctgtcatgttgttcgataagctggaggacatggggct

SEQ ID NO: 57858 - DNA, 489 bp, Triticum aestivum
  Clone ID: PAT_TA_57858
gtaggaccttggatggatgatggacatgtggcggagaagagactacaccaacttgaatggagcgcactgtacagactactatggaacattacgggccgactgccgctactacaacataataccaatgttagctggggaccaacctacatcgtctcatgccctacctgtgggtctttggaatgctccttccaaaccgagctgtgtcgatatagggccgaggggagggcacccacccattgtgccccaatcagtgcttaaacgctatgcacatcatgcggagctgatacacgccagccgtggaactattctatacttgtgacggtgcttgcagttttgcatgtatcctaagctttgcccatattctttgggcactgatcttatgtgctggctgagatagaacagaacgtgagctatgtcgcgtatcgggctacaagtgcaatccacaatggatggctatgctgtttagactatcctgctttacttgcctga

SEQ ID NO: 57859 - DNA, 483 bp, Triticum aestivum
  unsure (1)..(483): unsure at all n locations
  Clone ID: PAT_TA_57859
gtacgcnnctgcaggntactctggtnccggnnaattcccggnngtcgacccccacgccgtccggcaccatagctcgtagtacacgtcacaggctcttcttgattacaccttgtgtgccattacctcccttactgagctctggaggatgctgtactctgttaaaaatgatgggcttaggtccatctggagaaatggtgactcattgacaaccattccctttactgactcgaaggtcatgattatgttctccatgactaaacctacaaggcggtgctcattggagacgccttcacgcctcaagttcatccttgtgtggtcatggaactggctatctataagaaggatctctcgaggaaaactctatctgttggctcgcatgtgatacctccatgatttgcacaatacgtggattgtagacaccattgtattactaccatttccaccacctcaaacatttttgttccaccaaccacgcctgcccat

SEQ ID NO: 57860 - DNA, 384 bp, Triticum aestivum
  Clone ID: PAT_TA_57860
gccaaccccgcagcggggctggcacgcggctaggccaacaactctctagcaataacaattggcgcagggccccgttcgtgtaaccataccagcatggctgaacttgaggtgatgacttccattgggctccgtatgctggcaacgatgtgcagagctagtgtcgccgacgcacagaaccaccagtagcgtgccattcgacgctagcaccgggatgggcgcctactgatgaggaaagatgtctagtactatattaatagagtcaccgttgcttactcgatggatatgtcgatgcagtgttgactaatgaagtgtaacacaatgtcatgggtgacccgtccaaactagttggtcagattctgaactagaataaaactaaagtagtct

SEQ ID NO: 57861 - DNA, 497 bp, Triticum aestivum
  unsure (1)..(497): unsure at all n locations
  Clone ID: PAT_TA_57861
gaataaagcgcagcaaatacgaagccacctgtgggacagaataggctcctactcctgtggccgaaaagaaacagcaggaactcgtcaacgggaagccaaaggggtctttaccgaacgtcggccattggggacgaaacagacaagattgctggcaacttgggaatgccaacagctcagcctngatagacaataatgggagtactaccgtgggatcgcagaatgggctctcggcaagatgaaagagcgttgctcgctgcgtcctacaggtgtgacctacacagccatagtgtgccacacagctacggccgataacaatcctggggccaccgagaaacagcctgtcgacaccaacggcgctgctgagaccgctgcagctgacttgatcgcatacctgatcctcccatgtagccatgaagaacaaacagacggtgctgacgaaccatgcgaaacatgcaaggtgccaagtaccgatcaccataggcgtatggaaagcgggt

SEQ ID NO: 57862 - DNA, 390 bp, Triticum aestivum
  Clone ID: PAT_TA_57862
gtcagagaagatgagctgacggcgctgggcgagggggctcccgtgaccgcccgaagggccgcccaagctaacgtggataagcacatcccagagccatacctggcccgagctctggtggcgccggacgtgtaccatactggagggagcaaggagggcggccaccagcaccagcgaagagaacgtgctggatcagaatgtcgacttcttcgacatggatggcgacggtgtcatctatacatgagaaaacttactgaggactgagggcactggacttcaacatgaacgaggccatgctgaacgctataggcatacatactactctgagctacacagctctgactagatgggtaccatgtgtgctgtatcacagctacatcgacaacatccaca

SEQ ID NO: 57863 - DNA, 498 bp, Triticum aestivum
  Clone ID: PAT_TA_57863
gctcgacacaagggtcactcacaggacatgaaccggcgcacgggcacacggaggactatgcagcttgtacgtagtaatgacgacaagggtcaccagacaggcacactggcgacaaccagcaccagggccaccacggatactacccaacttctgtgccgcagactggactagggcagcagtcaggacaagggccacagggctactacagctcataccatgctagcgtggagcaccaggcggccagcctaacggaggcatacgcgcaggagctcgcggcacagttgtcggcaatgcgccggctggagggcggcgacagcattggcggccagccaacgatagaactctctgtatctcgcatggagcttaggcatgcatgcactctagctatacaataaatgagacgtggggtcacaggttttcatgtaactagagtacagcccagtactaatgcacaatgaagagcttttctggctaccaactgcctctgcatccatatgc

SEQ ID NO: 57864 - DNA, 234 bp, Triticum aestivum
  Clone ID: PAT_TA_57864
tgttgttgcaagacaacatccctgcatggaaatggttgcgtctgcggatatggtagttgtggcggaaatggttgcggctgcggatatggttgttgtgatggaaatggttgctgatgcggatatggcgtgtggtgtgcatgtatacatatgtgagctccgcgcgctcaacatgtgtgggctatctgctatgaatgagaataaagagaatcattctgtggttctttaatttcaact

SEQ ID NO: 57865 - DNA, 509 bp, Triticum aestivum
  Clone ID: PAT_TA_57865
acgcctcgctcagcagcagaccacaagagcaggcaccattggctacaacagcaacagtttctagggcaggagcaaccatttccaccacaacaagcatatccacagcctgaaccatttccatcacaacatccatatctgcaactgcaaccatttccgcagccgcaactaccatatgcgcaaccacaaccatttcgaccacatcaaccatatccacaaccgcgaaccacagtattcgcaaccacaacaaccaatttcacagcagcagcagcagcagcaacatcaacaacatcaagaacaacaagaacaacaaagccttcaacaaattttgcaacaacagctgattacatgcatggatgttgaattgcatcagcacaacatagcgcatggaacatcacaagttttgcaacaaagtacttaccagctgttgcaagatttgtgttgtcagcacctatggcagacccctgagcagtcgcagtgccatgccattcacaacgccgctgatgctatta

SEQ ID NO: 57866 - DNA, 426 bp, Triticum aestivum
  unsure (1)..(426): unsure at all n locations
  Clone ID: PAT_TA_57866
gctggagcttcagaagatacagtacgtgctgctgaagctggaagaagagcacgagtacacaaggctcaaggtgtcggacaagcgcacccgggtgctcctcaaggattatctctacgggaggaaggaccaccgtggaaagaagaagaggtcgcccttctgcggctgtgtgcgctctaaatccaggactgagccatgaccatttttcgttgccgtggcggcaagaaataagaaaacctttctcgtcttgtaaaaagagaaaaccatacttatagtaggcgcgtgtcccctttgtaattgagctagcatgttagtattcagaataagncttgtgtatctagagntattttttttttttcagctgtcggtgcgagtaaaatgtgttaattttcttcggcatcaatgagaatagatggatcaggcatttta

SEQ ID NO: 57867 - DNA, 327 bp, Triticum aestivum
  Clone ID: PAT_TA_57867
tcgcgtacctggccaagcagaatgctgtgagcaggttgcaaacattccacatagagggccgatgccaggcgctgcgctacttcatggagccgaagcctcgtgagggccccatgctttgcggcaataactgcggtttcttcgagagggcggcgaccatgagcatgtgctccaagtgccacagggagatggcgatgaagcaggagcaggccaagctggacgactcctcttttgacaggatcgaagacgggggtgatgccgcgaaagaacattgtgctgctgacaacacgcgggtggcaggtgctcacggagaggggaacacgctgatta

SEQ ID NO: 57868 - DNA, 660 bp, Triticum aestivum
  Clone ID: PAT_TA_57868
tggagctggctggcaacgccagcacggatctcaaggcgaagcgtatcacccctagagacctacagctggccatccgaggagacgaggagctcgacgccctcatcaagggcaccattgctggcggaggtgcgatcccgcacattcacaagaccctgatcatcaagtcttccgaagagtgagaaaatatatagcacaggagcctctttagcttaaactggacattcttctcagtccgactgcgacataagcttatcgtcgcgccgcttagcgtttaactgagcttgctacaaaaacagattccatgcagggagggtgaagtgcaactgcaactgatacagccaggaaaatcacgaggtttggaacaaaggacttaccagctgctggaagaattgtggtggcagcacctatggcagatccctgagcagtcgcagtgccaggccatccacaatggtggtcatgctattattctgcctcaacaacaaaaacaacaacaacaaccatcgagccaggtctccttccaacagcctctgcaacaatatccattaagccagggcttcttgcggccatcttagcaaaacccacaggcccagggcttctgtccagcctcaacaactgccccagttcgaggaaataaggaacctagccctacagacgctacct

SEQ ID NO: 57869 - DNA, 697 bp, Triticum aestivum
  Clone ID: PAT_TA_57869
cgcaactaccatatccgcagccgcaactaccatatccgcagccgcaaccatttcgaccacaacaaccatatccacaatcgcaaccacagtattcgcaaccacaacaaccaatttcgcagcagcagcagcaacaacaacaacaacaacaaaaacaacaacaacaacaacaacaacaacagatccttcaacaaattttgcaacaacaactgattccatgcagggatggtggattggaacaacacagcataacggatggaagctcacaaggtttgcaacaaaggacttaccaactggtgcaacaattggggtggcagcagctgggggagaaccccgaacaggcgcgggggcaagccattcacaatggtggtcatgctattattctggattaacaggaaccaccaccaccaccaccaccaccaaaacaaccattggggcagggcttctttcaacaggctcaacaacaatattcattaaggcaggggttctttcagccatcttaacaaaacccacaaggccaggggtctggtcaggctcaacaactggcccaagttgaggaaataaggaacctaacgctagagacgctacctgcaatgtgcaatggctatatcccttcatattggaccattgcttcaggtggcatcttcgggactaactgagaagaggagaactctagtagtagatatatgatacaccggtt

SEQ ID NO: 57870 - DNA, 500 bp, Triticum aestivum
  Clone ID: PAT_TA_57870
gaacgcttggacagaagaggtacgatggcgctacgacgaccggtccaaccacggatgagactaaacgacgtacacgcacggtagctgatccgtgcgcacggttgaatcgctcacgcagtcttcgtgcgagctaatgctaagagatgagcacctgaatgccactattgcgacgcgaagagacactctgatgacttccatgcgtcaactagcttgtgctaatattactctggcaaactatggccgggataggaaactgaactgagggtcttggtgctaaattgacgattgagagtacttgtacccgcaaaatttttggcataactaaaccggtttatttggcgagactggctgaacatttaactatggcaccggtgtgatctttctttaagtggcccagaaagtcaaaatttgaacaaaaattacctccggcgaaaattcagctcatggaaatatattacccataccggtttgggggccgaatggaaaaagcatttcggggg

SEQ ID NO: 57871 - DNA, 647 bp, Triticum aestivum
  unsure (1)..(647): unsure at all n locations
  Clone ID: PAT_TA_57871
ggccgggctactggccgtggctttgttgtgcagcataagagtttcgctgaaaattacaggctatatgctaggagccacttcataaaggctatagagctcggaataatattgaccgtgtatgccgctcacagtgtgattgccaggaacacacttgtttacatagtcatgatgatatctagctggtttctcgtggtgtcctggatcatggctccatttgcatttaatccttctggctttgattggttgaaaactgtgtatgatttcgaggatttcatgacctggatctggtttccaggaggtatattttctaaggctgagcacagctgggaagtgtggtggtatgaggagcaagatcatctgcggactactggcctttggggaaagattttggagatactgttagatctcagatacttcttttttcagtatgggggtgtataccagctcaaaatcgcagatggaagcagaagtattgccgtgtatctgctttcctggatatgtgtggcagtgatctttggtgntttttgtcctgatgtcctataccagggacacgtatgctgcaaagcaacatctttactaccgagttgtccagactgctatcatcattctgggagtgctggtgctgatattattcctgaaattactga

SEQ ID NO: 57872 - DNA, 512 bp, Triticum aestivum
  Clone ID: PAT_TA_57872
gatcactgacctatcttggtagagatttgaagtttaaaccttcaaattaatcaaaccattttaatttgcctttagattctgagtcactgctgctatggcgctacgcgtactttttgcgttggggatgctgctgatgttgagccttgttaaggtttcatctgatccaaatatacaagaagaaatactggatgcataagaagaactgcagtttcccgataacgagccacttatcgtgagagacgcgaacagaacgctaatgcaagatatggattgggtgggatgcgcaagaccaggtgcagagcacattcgaagcccaacttgtgcactatggcgtgtggcacgtgctctgtgaagggcaagcgtgtcccacctggttcattttggaatacctgactatgtggaacctgctacactgagatgaacacccatggtaacaagaccaagtgcccttatagaaacaaacagcttcattagattggcccatttgcgcttcggtcattatgcatcaaagg

SEQ ID NO: 57873 - DNA, 483 bp, Triticum aestivum
  Clone ID: PAT_TA_57873
cacaacaacaaccttctgtggaggaaaaccaacaattgaacttgtgcaaggagttcctgctgcagcagtgcaacccggaggagaaagtgtcattactgcagtcaatgatcccgttcctccgaccaaagacctcgcaacagaacaactgccagttgaagcggcaacaatgttgtcgacaacttgcacatatcagcgagccgtcccgatgtccggccatccacaacattgtgcacgccatcatcatgcaacaacaacaacaacaacaacaacaacaacaacaacaacaacaacaacaacatgtggatagaggtttcgtccagcctcaaccacaacagttgggccagggaatgcccatgcagcctcaacatcaattgggccagggcttaagcctacctcaacaactagcccagttcaagttggttaggttacttgtgattcagaccttgcctatgttatgcaatgtgcatgtcccatctgattgct

SEQ ID NO: 57874 - DNA, 269 bp, Triticum aestivum
  unsure (1)..(269): unsure at all n locations
  Clone ID: PAT_TA_57874
gcgccaaaacactatgtgcatatcatcatacatacaaataacagttcgattcttcctaacgactactttgatcacgccgctacattttatgcatccttccagctacaaaattttctgctgctgctgttgctgcccaccctgacttccagctacaaaacataatccaggaaaccctttattccacccttccacctntnnttataccccaaggaacatgtaatnagatgtacacaaacaaaagaataatttcgcaaaaagcgcagcattag

SEQ ID NO: 57875 - DNA, 629 bp, Triticum aestivum
  Clone ID: PAT_TA_57875
ggcgaagtctgcgtaagtggaggggttagaggaatatgtcctccccttgaaacatgaataatgactttggaccaacagaacgagataccaaatgtttcatatgctgtggttacagatgacacaagatatcaataacgcacctttccttaaagaaacaatagacacgaccatagataggagtggatatctgcctcttactagtaagcgagatatgaggtaagaaggtaatagaagccttatattacagacggagtgaatacttacgccagtgtgaagctggccatctaatggctacacaactctttgatctgagtcgctaaatggggaaatcaagaagtggaattttcttttcagatgatccgaaaatattggcacaaatccatcagttaattagagaaacctgaccctgatcatcataccttgaaggctaggagaaagggaagtacttaaggaatgataaaatcctaatatgaaagcttaagatgcgaggagcatatctacaataagtagcattgacaggctaacatgaaagctcaggagcatatcatatgctgctctgccgcactggcgaaagattagaagaccgtatttaaattataatgatcaactcgtgtgtaactacattatga

SEQ ID NO: 57876 - DNA, 749 bp, Triticum aestivum
  Clone ID: PAT_TA_57876
tcgtgtggtactctttgattgctgtttcttgcgggtactacccaacctttccacagcaaccaggaccagatcaccaatcaggcacagtcgcaacaatcaggacaatggcaactagtgtactacccaacttctccgcaacagccaggccaattgcaacaaccagaacaagggcagcaaccaaggcaagggcaacaatcagcacaagagccacagccaggacaagcgcaacaatgcggacaatggccactagtggactaaccaacttttccgcaacagccaagacaattgccacaaccagctcaagggcaacaaggggtctacccaacttcttcacaacaggcaagaccagggcgacaagggtactacccaactttttctcaacaatcaggacaagggccacaaggggactaaccaactttttcgcaacagtcaagacaagggcaacagcccggacaaggacaacagcccagaccagggccacaagggtactaccccatttcttcggagcagtcaagacaagggccacaaccaagacaagggccacaaggatactacccaacttcttcgcagcagtcaggacaagggcaacaaccaggacatgagcaacagccacgacaatggctgcaaccaggacaagggcaacaagggtactatccaacttcttcacagcagtcaggacaagggcatcaatcaggacaagggcaacaagggtactacccaacttctctgtggcaaccaggacaagggca

SEQ ID NO: 57877 - DNA, 484 bp, Triticum aestivum
  Clone ID: PAT_TA_57877
ggcctgtttgggacagagccgattgggctagcgactgtcaccgtctgtgaaagagacgcctctacgacaataccgctgcgagcgcgagctacactacagcgcacttgaggcgtgccgactcgccagcgtaccaccaggtgctcgcacgaacgacatgcagcacgctgctactaatgcggagcatgcatcggatccaaaatagtagagccgagcgacgacgcttatgactcaatcgagatccaagacaatgtggacactgcgccgtgctcgacctaagccggagcctgatgccatggtaagaccactcaagggaagcaactacacatggatgattgagtcagaacagtgattcagaacgagacaggggaattacccgagtggaatatcatgatcagcacggggactattataccaggactttgttatgcaccctgaactcagaatgacttgaacgatgacatgcgcaacgatgactgtatgacac

SEQ ID NO: 57878 - DNA, 801 bp, Triticum aestivum
  unsure (1)..(801): unsure at all n locations
  Clone ID: PAT_TA_57878
gacaagggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactacccaacttctctgcaacagccaggacaagggcaacaactgggacaagggcaaccagggtactacccaacttcgcagcagtcggaacaagggcagcagccaggacaaggaaaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggngtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaaacgaccggacaagggcaaccagngtactacccaacctctccacagcagccaggacaaagaggcacatcaggacannngcgcacatcanngacatgggcactagtgtactacccaactttctccgcacagncaggccaattgcgacaaccagcacaaggggcac

SEQ ID NO: 57879 - DNA, 543 bp, Triticum aestivum
  unsure (1)..(543): unsure at all n locations
  Clone ID: PAT_TA_57879
ctgcaccgagttcaagcaggccaagtaccccttcaagtggagaaagtacatgtgtgccaggtgcggggtgcaccgtagcgagcatggtgtcagcaaggccaaggccaaagtggacgacgacatggagaatgtcagggaggagctcctgccgccacgcaagaggctcattctcaggttcaagcggtcacaggcccttgccgctgctgctgttgctgcatccagggagaaggagaacaaggagggggagctagaggaaggggagatcacctggagccccggctcgacgatcaccaagggaaagagagccccaaggagaaagccctaggatgcaccgtgaactgagcaatgcaccattgagaacttgttatatgtgaatctcttcagctatgtgaaacaacttgtgtanctggtccgatgtacacttcttttaactttgaccaagtctaccccatatatatcagatgtgggtggaccatcgtgcttgtttcctaaaaaaaaaaaataaaaaaaaaggncnnaacnnanaaaccttaacaacanaat

SEQ ID NO: 57880 - DNA, 735 bp, Triticum aestivum
  unsure (1)..(735): unsure at all n locations
  Clone ID: PAT_TA_57880
ccacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacagcctcagcaacaatatccattaggccagggctccttccggccatctcagcaaaacccacaggccncagggctctgtccagcctcaacaactggccccagttcgaggaaataaggaacctangcgctacagacgttacctggcatggtgcaatgtctacatccctccatattgcaccatcgcgccatttggncatcttcggtactaattgagaagaaaataactctagtactagataatgaaaca

SEQ ID NO: 57881 - DNA, 397 bp, Triticum aestivum
  Clone ID: PAT_TA_57881
ctgggtggcggcctgtgcgccccatgcctgagcaaacaccccaacgcctactactatgcgcccttggccttgactttaaggagcgcctgtgctcacctcgtgccgccacataacgcaggttcacgtctactgtccgaactactgctcaccatccggggcgtcttgagcgagcgtttatggacgaacacatagagagaacatgtgatgtgggaccgagacaatgcttgtaatgcccggctgcaaggaaacgatgcacatccaaagcggtacgctgcttggggggtcacaaaggtggacgttgactgcctatgagtctcaacagtgcgctcatcagtaagagtaccatgagtaagaagatcctggacataccttctcttaggcgaccgatctaaaggat

SEQ ID NO: 57882 - DNA, 592 bp, Triticum aestivum
  Clone ID: PAT_TA_57882
ctacccaacttctccgcagcagtcaggacaagggcaacaaccaggacatgagcaacagccaggacaatggctgcaaccaggacaagggcaacaagggtactatccaacttcttcacagcagtcaggacaagggcatcaatcaggacaagggcaacaagggtactacccaacttctctgtggcaaccaggacaagggcaacaaggctacgccagccaggacaaggacaacagccaagacaagggcaacaagggtactacccaatttcttcgcagcagtcaagacaagggccacaaccaagacaagggccacaaggatactacagctcataccatggtaacggggagcaccaagcgggccgcctaaaagggggaaaagggcaacaacttgcgggacaactggcggcaatgtgcccgctggaaggcggcgaaccattgtcgggccaccaatgatagaactctctgcagctcgcatggggcttaagcatgcatgcactttaactatacaataaaagggacgtgtggtcacaggttttcatgttactagaggaaagcccagtaataatgccaaatgaaaagcttttctggcttaaaa

SEQ ID NO: 57883 - DNA, 218 bp, Triticum aestivum
  Clone ID: PAT_TA_57883
tacatctgaacatagggcagttcaatctctctgttaaggttaataaatcgagtggttgtgctcttagattgatctggtttgttgggttgacatgtgaaatcaatacctggatcctggagtacatgctctgttgaaaaaaaaaaaagaaccagtttagaaaaaaaaaaaaaaaataaataataaaaaagaaaaaaaaaaaaaaaagatgagatcttttg

SEQ ID NO: 57884 - DNA, 413 bp, Triticum aestivum
  Clone ID: PAT_TA_57884
ccgacaactagcgcggtgcaatggggcatgaagaggcgcctatattgggaacatggaaaggagcgttttctccagcttgactgcagatgattgagaaggaagttggtttccaagcttttgccaattttgtttctttttagatgtggatgcagagatggcaagtgcagaatacaaggagtattcctgcttttatatacagcagtgtcttagtttgtttactcaccaaagttgtgacatattcctggcacttgatcacatactccatgatgtattgtttctgctgaaatgttcagtgaccttagtaatgctgttatgctgccagtttttagatgtgtcattgtcgatgtggaatctatttctcagatatgtcatgtaaatgatggccctgtaacaacgcgggcctgcattactta

SEQ ID NO: 57885 - DNA, 666 bp, Triticum aestivum
  unsure (1)..(666): unsure at all n locations
  Clone ID: PAT_TA_57885
cggggtgaagacgtcgaggtacggtgctactaccatatagttttttttgctggaagcgaacagagaaaaggttgcaacctctattgctcggtgatgcaacgggacggcgtcgagatgtgttttgctggaaccggcaaaaaaaatgctggaacccataagaacttttgctgggaatatacacgagaatttttgcaagtggtcgacgcaatggtggttcttttttgctggattcgatgatttttttgctgcaaccagcatgtgattttgctactactcgcaaactaatgaagtttgtatttttgccgaggacaaggtgcttcgaactgaatgacggtgacgagcggagacgctggcggtgcctcagggatgttgcaaccatggcgactagagctggaaccgaccgatgggcgagctgcaggcgtcaatgtcatgtggcggccgagggatgagtgcaggtggcacgggtggccgacgagcaagagacgagtcctttttggtgccggggccggcggtgcaccgactaatccggtcgaggggcgagcggcgctgcctccggcgaggatgcggtgtcgcggcgggggaccatctgtagatttggtcaacgggcacgagcaggaggaagggtaagggcacggngtgagctgggcgtcgggcggaatctacggc

SEQ ID NO: 57886 - DNA, 714 bp, Triticum aestivum
  unsure (1)..(714): unsure at all n locations
  Clone ID: PAT_TA_57886
cggacgcgtgggcggcggcgggccaggccgggcgaccgcgtgtcgccgcccggcgactggggagagtggcgcgagcgcggcgtcgtcgctcagggtgaccagccggcgtccctggagcgcgtgttcgcggaccagcgcgtgccgtcgtggcgtgagcagctcacggtgcgcgccttcgtggccagcttcttcctggccgtcatgttcaacatcatcgtcatgaagctcaacctcaccatcggcgtcatcccctcgctcaacgtctccgccggcctccttggcttcttcttcgtccgcctctggacgtcggccatcgagaggatggggctcctcaagcagcccttcacgcgccaggagaacaccgtcatccagacctgcgtcgtcgccgcctacggcatcccctacagcgggggctttggtaattacctattggccatgagcggcagaatcgcttcgcaggcaacagaggcaaataaccctcaaaatatcaagaatccgcatcttggatggataattggcttcctcttcctggtcagcttcattgggctcttcggccttgtgccactgagaaagattatgatcattgactacaagctgacctatccaagtggcactgcaactgcctatctcataaacggcttccacacaccccagggtgccaagattgcagagaagcaagtaaagaaactgggtaaatntcttggttctcagctt

SEQ ID NO: 57887 - DNA, 479 bp, Triticum aestivum
  Clone ID: PAT_TA_57887
ccattttcgcagcaacaacaacaaccattatcgcagcaacaacaaccaccattttcacaacaacaaccatcattttcgcagcaacaacaaccaccattttcacagcaacaaccaccattttcgcagcaacaacaaccagcttttccgcagcaaccatcattattgtagcagcaactaccaccagttgtacagcaacaaccatcgttttcgcagcaacaactaccaccattttcacagcaacaaccatcgttgttgcaacaacaacaaccagtgctaccgcaacaaccaccattgttggtacatccacatctaccagagctaccggaacaacaacaagcatttgttcatccatctatgttgcctgaggtaaagccacacaaggcttgttctgcagcagaagtggcagcctgtgggaatgcctcagaggcttgatcagtagggaaagctggaggagaacatctgccatgtgatgcaacaac

SEQ ID NO: 57888 - DNA, 670 bp, Triticum aestivum
  Clone ID: PAT_TA_57888
gtcgccggccgccgcccccagcgtttctcgccggccggcatgtcgctggagctgagcatggccctggcggcgccgccggggggtgggctgctggccccgccccctcccgccccgcccggcaaggagcagcaggtggcgggggtgggaatcctgctgcagatctccatgctcgtgctctccttcgtgctcggccacgtcctccgccgccaccgcttctactacctccccgaggccagcgcttcgctcctcatcggactagttgttggtgggcttgctaatatttcgaacacagagaccaacactaggacatggttcaacttccatgaagaattcttcttcttgttcttattacctcctataatattatatcctttttcttcagtcttcttgtttttaacattgctagtaccttggtgaccaaaataggcttcctaacttgtaacttccccatatacttctctaccctcctaactggaatatttctcttttccaaattgaaacttgtgttccttgacttcggtgaacccaatcaggattcagcttatccccaaaaccattctttgccaactttggggctattgtaacttttgccattcttgggacattcatcgcttccatcgtaacagggatgcttgtttatcttggtggactcacatttctaatgtataaa

SEQ ID NO: 57889 - DNA, 551 bp, Triticum aestivum
  Clone ID: PAT_TA_57889
gagggtctccgcgtcaacatgctacctaggattctgacttacaggcgttgaatcatcatccgatacactgcatgtttgcgccactggcattatcaaccacatcgcgacgaccaatatgacagagatcaacgagcaactctacttaccaggctgaagcactattcgcgacactgagctcctatgggaaatactagcgtggttcacgagccactacatccacactacggttcatactgttagggctgaacaatccaccactacgagaacttctgccatcaatgctaggatgattccacctcgatggatcacaatgtacattaggtctgaactctttgctgccatatgacagttatccattgggccactgctctgaccactctaaacatctggagcaggaagctggaggtgtgagcctagcgctacagacgctacctgcaatgggcagtgcgtacatgactacatattgcaacatacggccatttggcatgttaaatactaactgaaaagaaaactactctagtactagtagatctgaaacacacaacgtctca

SEQ ID NO: 57890 - DNA, 803 bp, Triticum aestivum
  unsure (1)..(803): unsure at all n locations
  Clone ID: PAT_TA_57890
gacccacgcccgtccggaaaaagaaaggctaaagatggtaatgaaggcaaaacgagggagaaaagaagtgctatagatgagcagaaacacagagagcttgacggagatggggcaagcaacaactatattcatgatctaatgtacttggctcatcttaatgggaacaagttcacttctgatgatgtcaagaaaaggaaaggcttaaacgctaacagttctctacatgatcatcatagtatgccattgactaagatgccaaggacgtctcctgcaaatcatctttgtgtgaatggggaaatcttgaagcattctcacggaactgcacctacattaccagtgggcacaaatcctcgtgaggcaggcaggcttgaagatagcaaggactgcaccaaaaatggcatgaccggactcctctacctagaggaacacaattctgcagtctctccatccagctatggcagcagtgaagtctctctggcaccagctcaccctgataccaagtatctgagccaagtgtactccgtaccagcggctgacgaccgctcagagtacattgatcaagactgggntgttttctggagaccgtgttcaccagaaaacaacgatgtttgaggccgcagaagcaccccatgtctgggctgaagcacagctgatcgattctgctgatgtagttgctctgccttatgttgttcctttgcaatgagaaactcctncattatgcgcacatgagacggctttcatagttntgggctatgatcaggaagcgcagaagaacgattcacttatttgttttgctgtcatgc

SEQ ID NO: 57891 - DNA, 574 bp, Triticum aestivum
  Clone ID: PAT_TA_57891
aaaataaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcaacgcggccgcttttttttttcttaatttttttgggccaaatgcctcctccaaacatccttagtttttttttttttgctccggggaaagggggggcctccgccccttttttttttggttcttggggcaggaaaaaccgatttttttggttgcccgccgcccatttcgttccccatcctttgatttcccctcctgttactctgaatcctttttttcccccccccgtttatcggccccccctggccctttggggacggtcccaccccctttgggttttcgccccaccctgtgaaagggccaatgctgtttctttttacccacggcccttcccctaagcctttgtttttactctgccgggccgtttccagcgggctgccccctttccgggttcatggatcgatccccccctgtggacctcttcccgcccggcctggtctgctctaacggttccccccttttttctttttcttgggggg

SEQ ID NO: 57892 - DNA, 573 bp, Triticum aestivum
  Clone ID: PAT_TA_57892
tttctgcacagactgtggagggccctgtctggggtacgtgaatgtagctcctctcttgacctgggactctcatggggagcgggctggacccgcaagacccgtctgactggatgtggcttacactacaccaaacactgagcttgcgaggactcacaccctcgtcaagaatgccatcgtgcaagttgatgctgcccccttcactcagaggtacctgactcattatggagtcctaatcggtctgaagaagaaagctgctgcatctgccactaaggaacctgctgaggggcaagaggctgatgttgctgctgctgccacagaggaagcaaagaacatcatcattgtccagaggaagcttgagaagcgccagcagggacctacactggactcacacattgaggagcagttcagtggtggaaggctgctggcctgcatttctgtctcgtcctgtacagagacgcatagctgatgggtacatcctgtagggcaaggagctggagctctacatgatgaagctcctgaagaagaaggcaatggtgccacagcttacgctgaatagctgctgcatgttactcg

SEQ ID NO: 57893 - DNA, 506 bp, Triticum aestivum
  Clone ID: PAT_TA_57893
ttctagtaccacgcacggagcgtgtactgggcaccttggatgcgctatacgcagctgggcttccatagggcccgcgctccctgactgtgactctttgctgatgctaaaagccaatggcctccagttgcccaaggctggactaaaggacgtgcttacagacattatcccacatcatggaccagagcatgtacgagatccctctacagtgtgtgggacagcatggatgacgagcaaacctcgcacgagagccaggcatagacatgagcgatcacaactgccagacggaggtcatgaagatgacggcgcgtagcatcacatatgtaatgcatgctagacattgctacagaggcgctacgctatggaacgtaaggcttcaaggatgtggacacatacccagtcgcctagctcttcaaatgagtaactactatgttgtgtcatgcacctaccgtctaatttgaggaaatgcgcacaaactgactaactggtgtatgcgcctatgcgaaacg

SEQ ID NO: 57894 - DNA, 801 bp, Triticum aestivum
  unsure (1)..(801): unsure at all n locations
  Clone ID: PAT_TA_57894
tcagcagtgaacattccttttaagggaatcgaggagaaagacagcaacgtcttgaggtgatccccgaagttattccagatgcagaagaagggagtaaagaaactgagattgaatcagcagcaaggagcccttttcaagggagtcgaggtgtgatacagacagtagttgaccctttggaagttggtatagatgaatcactagaaggtgcatctctgcgacatgacgctgcctgtgaagttgtttttgaagctgccggcaaagccctctgtaatggtggcactcctggtcctggattgcacactcaactgaacaaagctgccggcaaagccctctgtagtggtggcactcctggtcctggattgcacacaccattgaacacagctgccggcaaagccctctgtaatggtggcactcctggtcctggattgcacactcaattgaacacagctgccggcaaaaccctctgtaatggtggcactcctgttcctggattgcacactccattgaacgcagttactggagtcattgatatcgacaacgaggatgatggaaatggtcctagtcatcacactgggtggtgacaaggaatatgtcatcgatctggtcagtgatgacgacgaggatgttcacatggagncagcgtgagcgagaacgggcaaaatgtgatggaccagtagccgttaatgggatcgctgcgcatgcacatgatggaccggaagctgtcaatggggtcaccgtacctacagtccatgcttncaatgatctggatggaacacggngcctgcatgcagtacgtcacag

SEQ ID NO: 57895 - DNA, 582 bp, Triticum aestivum
  Clone ID: PAT_TA_57895
gcgtgtgagaaggagaaggtggaggaggccctaaggaggcgctcgagtggctggacgagaaccagacggccgagaaggagtctggtctgtgtccgttgatgcctgaactgtctttgtttgtataccatatactgtgatgcagtgttatcgtttgtatctgcaaacttctgctggtgtgcggaagctttgatgaacttaagaataagtgagccctggagtcggtccataattctgtttgtcttgccagttgtgttgtactgtggtttcttgctatctttctgatgcatttgatggtacatgttttctgggttcacaagtctcgttgtcctcggtgtcctccaatggagtctggtctgtgtccgttgatgcctgaactgtctttgtttgtataccatatactgtgatgcagtgttatcgtttgtatctgcaaacttctgctggtgtgcggaagctttgatgaacttaagaataagtgagccctggagtcggtccataattctgtttgtcttgccagttgtgttgtactgtggtttcttgctatctttctgatgcatttgatggtacatgttttctggttgatgt

SEQ ID NO: 57896 - DNA, 780 bp, Triticum aestivum
  Clone ID: PAT_TA_57896
gggacaagggcaaccagggtactacccaacttcacagcagccaggacaaaagcagcaggcaggacaagggcaacaatcaggacaaggacaacaagggtactacccaacttccccgcaacagtcaggacaagggcaacaaccgggacaagggcaaccagggtactacccaacttctccgcagcagtcaggacaatggcagcaaccaggacaagggcaacaaccaggacaagggcagcaatcaggacaagggcaacaaggtcagcagccaggacaagggcaacgaccaggacaaggacaacaagggtactacccaatttctccgcaacagccgggacaagggcaacaatcaggacaagggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactatccaacttcttcacagcagtcaggacaagggcatcaatcaggacaagggcaacaagggtactacccaacttctctgtggcaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatacaactctctgcagcttgcatggtgcttgggcatgcatgcacc

SEQ ID NO: 57897 - DNA, 168 bp, Triticum aestivum
  Clone ID: PAT_TA_57897
gaccttagcacggttcacacagcagtccttctctttcctcatccacagacagctatgtacactgcagacaacacatcatgtacaagcagcatacaatccacgcacttttgggccagctagcagacacatacatcattcttcatccagcaacacaacttgtacacatca

SEQ ID NO: 57898 - DNA, 420 bp, Triticum aestivum
  Clone ID: PAT_TA_57898
cggacgcgtgggaaacaaaacgagaaggccgaacctagagcaagctcaaaactcacgttactaggaagcactcaaacatgatgacccatgggcaccaaaacgggggcaccatctgaaggcgccaatgttacggcctatctcatcatagatgtaatgatccgtatgaagtatccgaacatcagtcgctggccggaattgaacaactccatgatgggtaaaaccctggcataaccaaaataacatattttgggcacatccccgttgcgccttcgggcagattatctaaaaggcccatacctgcgctcattgccaatacttgcatattctgtgtgtgaaatgctacagccccctgatgcggcacttaaatcgcagaagcatgggggatctcacaccaagggcgaccgattacattttccattc

SEQ ID NO: 57899 - DNA, 610 bp, Triticum aestivum
  unsure (1)..(610): unsure at all n locations
  Clone ID: PAT_TA_57899
aaccggacgaaccaactttatttttctggaaacgaagacgactcactctacccagcagcagctcacgagtgcatcatttaagccaagcaagctgtggtcaatacaaatccaccatgaagacctttctcatccttgccctccttgctatcggggggaccaccgccacaactgcagttagagttccagtgccacaattgcagccacaaaatccatctcagcaacagccacaagagcaagttccattggtacaacaacaacaatttctagggcaggaacaaccattttcaccacaacaaccatattcacaggcggaaccattttcattacaacaaccatatttggaggtggaaccatttttggaggcggaactaccatatttacaggcacaaccattttgaccacaacaaccattttcacaaccacaaccacaggatttgcaagcacaacaaccaatttcacaggaggaggaggaggaggnaccaccaccaccaccacaaccaccacaaccaccacaacaaattctttaacaaattttgcaacaacaactgattccctgcctggatggtggattggagcaacacaacatagcccatggaagatcacaagtttt

SEQ ID NO: 57900 - DNA, 821 bp, Triticum aestivum
  Clone ID: PAT_TA_57900
cccacgcgtccgaaaaatcaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacaaccaatttcacagcagcagcagcaacaacaacaacaacaacaacaacaacaacaacaacaacaacaacaacaacaacaagaacaacaaagccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggttttggtcgt

SEQ ID NO: 57901 - DNA, 579 bp, Triticum aestivum
  Clone ID: PAT_TA_57901
gaacgaatgactagagatcaagatcccctactatcgctatggaggggtgtatgcattggctctagcgctcatatgaactggaaacaacaaatctatccatcagctgctgcttttggctggatcggtacgtcagtgatgatgttcggaggactggactgtgggtcttggattcgtactatacaccgaacgctgagcacgactccaatactcgagtgcctgctctctgaatcgtgcaacccacacgctcgccatggctgcagctctagctggtgggatatcctgcgcatgcacagggtgaagtgaagccatttccttgtaggagcctgtcacctccgacggtggagactgcctgcgccagggggctctaattgctgtggcagtgggcatgatgcatacctatgagtgctttgatctctagtaccggaacattcatgcgtcacctgctttagatcatacttgacaagcactatgacaccatgagtcataatgggcgccatacttgcttgcggcattctagatgcaggagggaggaacgtaacattgaaacctcgctcgaggaacaagcatgacaagctcact

SEQ ID NO: 57902 - DNA, 741 bp, Triticum aestivum
  unsure (1)..(741): unsure at all n locations
  Clone ID: PAT_TA_57902
ggaaaatttgcccgtcggtaataaaaggcaccttatatggtttgggcaattaggttccaattaaacatgagaaagcccgcatgtttccgtgtagatccaacaaggaaaaatttgatgaaagaaatccaagtaactagttgtcttgcataaaaaaaaaaaaaaaaaaaaaagggccgggctggggctgtcgttgggcattgatatccttgaagcacctggagcaactggagattatagaactctcttaacttccaaggcaaaagctatagccaaggcactctctgctcctctggacacaccacctcgcgtttttgtgcctggagaggatgaatataaagccggaagagaaaatggatacgactttggtttcttgcacatcaaggctattgatgatgctggccatgacaaggctgtcaagttaaaggtgcgaggtctggaagctgtcgaccgggctattggtcagcttgcaaggctcctgtgggaagctgagaagtcggggcactaccagtacttcctctgtgtcactggagaccactctactcctgttgagtacggagaccacagctttgaacctgtcccgtttgcgatatgccggctgagagatttcgtgggagcgattggggagggcaatgtgatgaatacccccctcgacgatttcccgctgccttcggttaaatncggagaagatttaactgatgattcagaaccagcgggacacaagcctgaagagcgtaaagcttt

SEQ ID NO: 57903 - DNA, 627 bp, Triticum aestivum
  unsure (1)..(627): unsure at all n locations
  Clone ID: PAT_TA_57903
ggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacctgaagatgaaatccgccatgctggtgatcttggaaatgtgacagctggagtggatggtgttgctagcatcaatattactgactgccatatcccccttactggaccaaattcaattgttggccgtgctgttgtcgtccatggtgacgctgatgatcttggcaagggtggacatgagctgagcaagagcactggaaacgctggtgcacgtgttgcttgcggaatcatcgggctccagggctaagatgtcatcttcgccgaccaacgtcgtacagatatgggaaccttttcagaatgcagatttgcaatctctattctaaataagcacatgatctttgatcacttgttagtgtgcaccagtcgtgtcaattcctatgtgttactctgaactttatcgctgtcatttggctatcgagatgtgtgactggaacagttctgtcaagtgcttgtggatctgctgttaaaaaaaaaaaaannnnnnnnnnng

SEQ ID NO: 57904 - DNA, 701 bp, Triticum aestivum
  unsure (1)..(701): unsure at all n locations
  Clone ID: PAT_TA_57904
caattttactacaacagccatatccgcatcagtcaaccatttccatcacaacaaccatatccgcagccgcaatccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaaacaacaacaaccgtcgagccaggtctcctaccagcagcctcaggaacaatatccatcaggccagggctccttccagtcatctcagcaaaacccacaggcccagggctctgttcagcctcaacaactgccccagttncaggaaataaagaaactagcgctgcagacgctgccagcaatgtgcaatgtctacatccctncatattgctcgaccaccattgcgccattttgcatcttcggtactaactgagaagagaagaactctagtactagatatatg

SEQ ID NO: 57905 - DNA, 438 bp, Triticum aestivum
  Clone ID: PAT_TA_57905
ctgaggcggtcaccgatgccatcgccgggctgcttggccccgtgggcctgctcctcctcccggtggggctcctcctcctcatccacctcctctcctgcgaccgctcccccgacgtgttcgattttgccggctcgcccgacgccgtgcaccacgtcgggggatcacccgtcggcgtggcgctgatgctggtcctcatgcttgccctcctctactaccggtccgcactcttcggtggcggcggaggcgacgacgagtaggcgcctaggcgctcgccagtaggtactaggtagagcctgatctcggtgtggctggttggttgttcagacttgcgagtaggcactccagcaggcagcagtaaataaaaaaagtgagagctttgcgtctaataaaaaaaaaaacaaaaaagacagaacaaaaaaaaagaaaaaaaataaaatg

SEQ ID NO: 57906 - DNA, 424 bp, Triticum aestivum
  Clone ID: PAT_TA_57906
gctatttgtgctagaaaacacaaccgagaccatggaggtgggtcacctccgtgccttcctggttttcctcctcgtgcaggtctgcctgttcttgaagatggccgcatcggcgaaggtgcatggcagggctgtgcccggagttcccgcgtgctgctcctaccgccccgagtgctgcgagtgcctgacggcggatgccccgctcgccgccgccgttactccctgatggcctcgcctgcggcggcctgtgggggtcgttctcctccctagaaatatgtccgtgacgtaggatctggaatctgcatacatgtatgattccgctgcttttcatggctctctctctatatatatggttcagaactttacattccaagcatgttggtgtgatgtggaaccttgtttaataaagtgggaggaggatattgct

SEQ ID NO: 57907 - DNA, 593 bp, Triticum aestivum
  Clone ID: PAT_TA_57907
tcaatctcgcctgctcctggccaacggaccgagcacatgggtgttgcgattgagctgctcggacagatcgagttgcacttcgacagaggcaacttctatgacttcacttgaatggtgcgcgagttccatgctcctgtggaagtatatgaacagacagacctatccatttgcgttctctactgttgagctgccatatgattactacattgggacacatgtgagactgaggcacctgctgaaagtgactagttgcgtagaaacgtgtgaacggcattacttgatggatagctcagtgcatttcttgtgtgcagaaacctatcctcctctcacttcaatcaataacagcatctagatggacgtcggcatcgacgactgcctgcgtatcgacttcgactacagcaacaacaactaccatctcacggatgttactgccagaaagatctattttcttctacatagagtcaagattaacttcctggcatcttgaaattaccccgccggctatcaggcatgagtcacgtcctaacacactggcccgagactgaggacactaggtaacctatgagctacatgacactgcgctgccatgcagc

SEQ ID NO: 57908 - DNA, 521 bp, Triticum aestivum
  Clone ID: PAT_TA_57908
gataaaagctgcaagttgggtagaaagcttgcatgattctcgttttatgatgattagtccatctgatcaaccgaggatcgacatctctgtttctgtttatggtgggcaaggaggaggagcgatctctctaccgtgggcacccactgcagctactgccgaagtatgagcaatccccgatgccaagatcatagagcaatctcttacaattttgcgcttttggccgtgcgtcctctcttcggctctgaggccgatttcgctactctcccactgaggttctcagttcatggaatcattgtttggatcttcttcccggtgccaaaatatgttgatacgccctctgtacaagaatctgcgaggtgttttcctgtagtctgcccattttgcccagtgcaagttctgtttgaaatttcttatcggtgcttaaccaatatatgtagcctgatagtttattgaacatttattccatcttattctgtccctaaaacagttttttgtgaaaaaaatatttttacaggactgat

SEQ ID NO: 57909 - DNA, 665 bp, Triticum aestivum
  unsure (1)..(665): unsure at all n locations
  Clone ID: PAT_TA_57909
ccaggacaaagacacaaggatactacccaacttctccgcaacagccaggacaagggcaacaactgggacaagggcaaccagggtactacccaacttcacagcagccaggacaaaagcagcaggcaggacaagggcaacaatcaggacaaggacaacaagggtactacccaacttccccgcaacagtcaggacaagggcaacaaccgggacaagggcaaccagggtactacccaacttctccgcagcagtcaggacaatggcagcaaccaggacaagggcaacaaccaggacaagggcagcaatcaggacaagggcaacaaccaggacaagggcaacaaggctacgccagcccataccatgttagcgtggagcaccaggcggccagcctaaaggtggcaaaggcgcagcagctcgcggcacagctgccggcaatgtgccggctggagggcggcgacgcattgtcggccagccagtgatagaactctctgcagctcgcatggtgcttatgcatgcatgcactttagctatacaataaatgtgacgtgtgttcacagtttttcatgtaactagagtaaagcccagtaataatgcaaaatgaaaagcttttctggctaaaaaaagaacaaaactggtgctatatagtaaaaaaaaaaaaanaaaannnn

SEQ ID NO: 57910 - DNA, 261 bp, Triticum aestivum
  unsure (1)..(261): unsure at all n locations
  Clone ID: PAT_TA_57910
gattcaaacggtgcataaatggaaacaccataatgatggttggatctgcaccagggtttccccatggtttaattgatcctattgaggaacttggggagttggcttcacaatatggtatttgcttgcatgttgatctatgccttggtggcttcgtattgcctttcgcccgtaagcttgggtaccctattcctccttttgatttttctgtcaaaggnntgttacccgtccattctncnnaacggnnnatgttcattaaagtta

SEQ ID NO: 57911 - DNA, 659 bp, Triticum aestivum
  Clone ID: PAT_TA_57911
caaacagccccctgatttctggttactgttgacatcgaaatctggtacatgtcactcttgattgttcctgggttatgccaagctgcttatacaatcgctgatattattttttatatgcataacttgaagtagttggtgtccttttactttattagcttatataatttatgcgtacaaatagctccagatctttgctcaatttaatatatatcacaatgatgaatttcttgttcacagtacatgtcaccatgttcaggatgttacatactaaatgcctccatcttgacaagttgtaaagataaactttttcctgccatttactctgttatatttatttataatagaaactggtgcagagttagtacgtgtagtgcatggagatttttcctcttaattgcatatggtgcccaacatttggtaatcttataaacctaacaggtttatatgacctcaactactgctgctatattaattagttgtgtggtttgttactttgccatttgacttacagttgacacactttggattaattttcataaacctcatgtttacttttgttttataggggatacaatgttattctcatctgtaggcactataagatataagaataaagattttgcacatgtcattcatttttataattggggctattatat

SEQ ID NO: 57912 - DNA, 671 bp, Triticum aestivum
  Clone ID: PAT_TA_57912
ccgtattttgcacactgcatttgctgatcgagctgatgtagtggaaatggttgccgaattgtctcagagtcttgaatccttatataagacagaggtttgttatccctttctgtatcaatctatctcacgcgatttagtcaacctatctcatgcgattccataatttcatttcgcatgcgtttatgatcaagatgatattgcaactagaaaataaaataaatgggtcaccgagtcagctttatacaatcttgttgggattacctatgctgatttgagtatatattagcttactgttaaattttctgtttacgaagttatattaccagggattttaataaaccttttggctttctcttctttttacatggctggtgcaggtgctcgaccttgttcagaaatttgattgtcacctgtctaatgagaatactgattcagaaatccatgaggagctacatgatattctgactgcagcaaccaaattacctaaagctccatgggaggagggtgtttgcaaagtatgtggccttgatagagacgatgaaagtgttctcttatgtgatgagtgtgactcggaataccatacttactgcttgaatccaccactagctcgtataccacaaggagactggttctgcccatcgtgcatattaaagccaaagaaaaatcacgtc

SEQ ID NO: 57913 - DNA, 753 bp, Triticum aestivum
  Clone ID: PAT_TA_57913
caagtgcagttgattgtgaaaggtgccagtgagaggggagcaaaaagaattcgccttcacattcttactgatgggcgtgatgttttggatggcagtagtgttggtttcgtagagacaattgagaaagatcttgctcagcttcgtgagcagggtgttgatgcacggattgcatctggtggtggaaggatgtatgttaccatggaccgctacgagaatgactggagtgtggtcaagcgtgggtgggatgcccaggtacttggagaagcaccatacaaattcccaaatgcacttgaagctgtgaagactctaagggcagagcccaaggccaatgatcagtatttgcccccctttgtgatagttgatgagagtggcaaatcggttggtcctatagtagacggtgatgcagtcgtgactttcaatttcagagctgatcgcatggttatgcttgcgaaagcacttgagtttcctgatttcgataaatttgaccgtgttcgtgtaccaaaaattaagtacgctgggatgcttcagtatgatggtgagttgaagcttccaagcaagtaccttgtttccccacctttgattgagaggacatctggtgaatacttggtgaagaatggtgtccgcaccttcgcttgcagtgagacagttaagtttggccatgtcacatttttctggatggaaaccgttcgggatactttgacgagaccagggaagagatgtagaaattccagtgacagtggtatcacattcatg

SEQ ID NO: 57914 - DNA, 466 bp, Triticum aestivum
  Clone ID: PAT_TA_57914
gcgctgcgtggacattttggccgaccttgaaagagaacaggaaggcttacggttatccttggacgagatgctgttggcgacgtagcgggctatgcaagactccttgatttgatgagtaatctttcactaacatgaatgtatatgcggggaggatcttgaactctattgatgcatcctatgagatgatgaggtcctatcatatcaacaatcgtgggaatccaccccagattcgacttggaccgtactacgagaggcccttatatgtatagaggatcttgatccaatgaagaaagcgggggaacatgcctatgactatgaccatggcgcatatgctgattaccaggatcgtgactgagagccttcagcctgccataacatggtgagggctccttccatgaataactcgttgtgtcttgccttgggtcactgagatgcctgacttctcacctcaggctcgaatgatgga

SEQ ID NO: 57915 - DNA, 688 bp, Triticum aestivum
  unsure (1)..(688): unsure at all n locations
  Clone ID: PAT_TA_57915
ggactttttaaccgagtcagtgagcaggatttgagggatcagttttatgcacatggtgagatcgaatccatcaggatggtaatccagcgtgcttgtgcatttgtgacatacacaacaagagaaggtgctgagagagctgcagaggagcttgctaacaagctagtcatcaagggtgtgcgcctgaagctcatgtggggcaagcctcaagccccaaggcaagatgatgacgaggctgggaggcaaggccatgtatcccatggaggattgctccctagggctgtcatatcccagcagcatagcagcgaccagcctcagccacctgggatggagggccaacagcaagtggcaccacaaggatcgggctacttcaacatcccaccaccgccagcggtggatcagcggatgtacccttcaatggacccacagaggatgggtgctgtagtcaggtcgcaggaaggcgatggcagcaaggcagggccacagcatgccgggcaagctcaggcgtcaagcagctcangacagggctatcctatgcgtccgccgctgccgccttactaccagggtgctcagtaccctccatactacccacccccaccatatggcggcggttacatggccccgcctcgcatgccgtacccaccccagtatccgccataccggccaatgctggccgcccccagcgcagcag

SEQ ID NO: 57916 - DNA, 667 bp, Triticum aestivum
  Clone ID: PAT_TA_57916
tttggcagtgatggtacttcaaggttgtaccacctggatccaatatcgcttgaagtaacaaagacagtaactgtgaaatatcaagacaatgacgtttcctatattaatgaactggaatatataaatggtgaagtatgggcaaatgtctggcagacagattgcatagctagagtttctcatgaagatggccaagtggcgagctggatctttcttcatgagctgaggcagcaattatggaaatctggcaacacggatattgatgttctaaatggtatagcttgggatgaagaaaatgacagactgttcgtgaccgggaaactgtggccaaagctttacgagatcaagctgcgccaggtggatgggccgccggatgggtccgtggagaaactgtgcccaagggcaagcttttatcgctgacaagtgtcgacgcctcggcgaggatatgtacatgtattatgtgcctcctggtcgattcgaggcaattggtagtatgaagataggttttttgttgctgtgacttggtggtgaactggcaggacctagctgctcatcagtttcatgctggaggcgtgtactgtagttgtatgtataatcatgcatgatctcccatgagtagtgtaaaagatttgtgttgtaaagatgggttcgctgcgaacataccaaaata

SEQ ID NO: 57917 - DNA, 585 bp, Triticum aestivum
  Clone ID: PAT_TA_57917
cagacgacaaagcaatgtacagcaaggtgcaaatccttctggagtggagcaaggcgcaaatgcttctggagtggtgcaaggagcaaaccctgctggaatggcgcaaggtgcaaatcctgctggaatggtgcaaggcagcaaatcaagctggaatggtgcaaggtccaaacccttctggaatggtgcaagatcaactttacaaagggagtctaacacttgttcatcaaactgctatagcgactatgtcaacattttatgatgcaatacatcttattgaccaacaatgggatatggggctagaaatagacggcatgacctatgaggagcttctatcattgcaagaacacattggagatgtcaataccggcttgtcagaaaagtacatctgtcaaaatatgagggtacattggtatgttgttcccaccggcaatcgcgggtccgatcagtctgtggagaaagatgcctgcattatatgccaagaggaggttgaggcgagagaccttgtaagaaccctcgactgcggtcacaagtgccatgaagtgtgcatcaggcagaggctgatggagaaaaacttataccccatct

SEQ ID NO: 57918 - DNA, 598 bp, Triticum aestivum
  Clone ID: PAT_TA_57918
ctcgactttcgaggctgtcagacgagaggaatagttatctagttgttattgaagagataaggcaaactctcgaggaaagattggttgctgcacaacaggaatatgaagcagctgtgaaggaaaaagacgaaaaggaagcttctgctcaggcactacttagtgaacaggaaaaggagatgaattccattgttgaagaatcaagaaagttgcagaaagaagcggaggagaatttgaagctgaaggagttcttggttgagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaaccg

SEQ ID NO: 57919 - DNA, 272 bp, Triticum aestivum
  unsure (1)..(272): unsure at all n locations
  Clone ID: PAT_TA_57919
gacccagcgnnccgactattcccnnacgagganccaggggagggcaagncnggngccagcagccgcggnaannccagcnccaanagcgnacannnaagnngnngcagnnaaaaagcncgnagnnggaccctgggccgggncggccggnccgccncacggcgagcaccgacctacncgacccttcggccggcagggggcggcgagccnnaanttggccgggncgngnnnccggcancgnnaccccgaagaaannagagngcncaaagcaagcc

SEQ ID NO: 57920 - DNA, 681 bp, Triticum aestivum
  Clone ID: PAT_TA_57920
gtgtttctgaacacatccaacctcttcgactactctacggctagcaggatgtgcacgcatgcgaatccaaattcatgatcctccccggcctgttatgtccaccctaatcggatacagcttcatccgatctccggacaacgaacagaataacttgaaggattcgcgcattctacgcaaagatgtagcgatgagccggcaatgttctctgatgacacaatgtacatcatatgatccaaagtcaaaggctgataggaacaatgactaaaaccatacacgggtaaacaccgagcctgatatagtatatttagcgataacgctttctacaatcgagaagacagcgctatgaaactatttagtctggtgctcactagcctatatcatagtaccaatgatctcaatatgaactaagttgtcatgcactgccctgtcctgaccatggactataacgtgaattctgtggaccaaattggatacaatgaatgtgtcaattcattcatgatgaatgtcggggtcaacaaatatgccggtcattataatggaaacgaagctaacggcacacacatgcgaggtaacaacatcattgtaggcaacagctacaacaactctgtggacaagcgcttcaaaacattgccaacaagaaaaatgctaccgacgaatgaatatcttggtggatacatattt

SEQ ID NO: 57921 - DNA, 604 bp, Triticum aestivum
  Clone ID: PAT_TA_57921
ggagaccgtcctgctgaccctgctcgccggcgcgcaggagaagggagcagtgtgcctggatgggaccccgccgggttaccacctgcagagaggctccggcgacggatccaaccgctggctcatccatctagagggtggtggctggtgcagcacaatcaaggactgttccaaccgcagaatgtacgcgctcggttcatccaacttcatgaaaccgatgcggttcgccggcgctgggatcctcggcagtgaccagctgcaaaatcctgatttctacaactggaacaaagtgtttgtgcggtattgtgatggggcgtcgttttctggggacgcggaaggtcgagcacaggatggaagcacacttcactttagaggattgcgcatctaccaagcggttattgacgaactcatggaaaaaggacttaacaatgctacacaggccctcctcacaggctgttctgctggtggtctagccacgatactacattgcgatgatttcagtgcacggttttctcgcgatgtttcagttaaatgccttgctgatgctgggttttttcttgacgtaaaggatatttcagggaaaaggtccttttggtctgtctatgat

SEQ ID NO: 57922 - DNA, 327 bp, Triticum aestivum
  Clone ID: PAT_TA_57922
ctcctattttgccaggcctttactgcgcgcgcaggtctggtagatgtagaccaactgggacgagtggttgcttcatgggtgcttggaaggattatgactctgtagacggtgcctctcactgggaccggagcgagacaggtggccatttcgaacctaacactcttggattgctatagactgttgctgatgtggacgtctatggtgctcttcagtgtgcaattcctggctattgaaacatgcgaccttttttagcactgtgattgttgactagtgttgtgacatatgaaagttgctacactgctaatgcacatattggtgcatatcatg

SEQ ID NO: 57923 - DNA, 539 bp, Triticum aestivum
  Clone ID: PAT_TA_57923
gctgaaggtaagacctggttacgaacacttggatgatcccctgcatatcttgattgaagcagagtttcctgccaatgtcattgatgcaagactctcaaaagcacaagagatcctagaagagttgttgaaaccagtggatgaatcacaagactactacaagaggcagcaactccgtgagcttgccatgctgaactcaccgctccgagaggagagccctcgtctaagcccgcatccaagtccgcacccaagcccgcatcaaggcggcgcttcacccttcagtaacggtgggatgaaacgaagcaaacaatgactgcagaggcctgctcctcccaactttgacccttccagaaacctgctctcaatcggtgccctcacaacctaatttttcatgagcaagctttcatgatggtgttggcatccgtgcgaaacctgtgttactagtagaattttgatgagtctcccttgtgacattagcctgtgatgactgactgagaatgatctatgatagcgaatcctccgcctttataattgatttattt

SEQ ID NO: 57924 - DNA, 317 bp, Triticum aestivum
  Clone ID: PAT_TA_57924
gtgatggtcctccccaagggaaggggaagctctggatcaggatggacaggtgctgggtttgagacatgatgctgggatccgtagttatatatacttgaaataattggcatggttgtcttggtataaaacgatggcttggttggaactggaaggctgaaagtgtaatggaatgtcgatcctttttggatgtatatgttgtgcaacaatagaacatgttattcttgagagctgtaagttgtaaaacacctgtagtgtaactgccaatgcagtcacttcattattagtactagcaaagagcccgtgcgttgcaacgggag

SEQ ID NO: 57925 - DNA, 710 bp, Triticum aestivum
  Clone ID: PAT_TA_57925
cgggctgcctcccagtcgcagattgctccgcttggtgcacggtcgatctcaacacaaattgtgaggaaccgcatgaaaagtgtcaagaacatccaaaagattacgaaagcaatgaagatggttgcagcatcaaagcttcgtgctgttcaaacaagaactgataattcacgtggtctatggcatccattcacagctcttcttggggatgctcctagtgtaaatgtcaagaagaatgttattgtagccattacatctgacaagggtctctgtggtggtatcaattctacatctgttaaagtcagcaaagcactccagaaaatgacttctggtaatttggctcatggttatattttgctattatatggctatggcttataactctagtaatcaagtccagagaaagaaagcaagtatgtcatattaggagaaaaggggaaagttcaactcatccgtgactccaggaagcatattgaaatgacagtatctgagttgcagaaaaaccctatcaattacacacaggtctgctgtgctggcagatgatatcttgaagaatgttgaatatgatgctataagagttagttgtgtacaagtttcagtctgtcatttcatttaggcctacactggccacaatactgtccccagatgttatgggagaaagaatcagaatctggcgggaagggttggtcagctggattcgtatgaaattgaag

SEQ ID NO: 57926 - DNA, 361 bp, Triticum aestivum
  Clone ID: PAT_TA_57926
gcaggttcgggggtccatggaaactgagggaaaggtccgcagcaggtgagcacatgtgtttcccacccggaacaccattcacggaggcatgtcgggcaagaaactgaacaacaacatttggcacagggtacctttttgtatggcacaccatatagctgaggttgaggtgatgacttccattgagcggcgtgctctaccaatgatgcgccgcgctaatgagccgatggatagaaccactactagcgtgccattattggttggcactggagtgggcgcctactggtagggataggggtctagaaatatatacccaggatcactcgttgatgaccgtgatggatatgctgcatgcaagcggtga

SEQ ID NO: 57927 - DNA, 345 bp, Triticum aestivum
  Clone ID: PAT_TA_57927
ctgcggctccgttggcctcgcggggggagcacttatccaggacactacatacagaaggatagagcgacttgacagctttccctagcacctatgggagctgatgctcggctcctccctagttcaaggcgccatgggagtgcttgcttcctctaacgaacgatgacctggactccgctgactactgatgcagaaacatccctccgcagtcaagattcttacaaccacagtcgaaattaatgccaacgaacttggatgcaacaacaagatcgcgaagaccacacatgtagagcaccaggaccacgctgcactcatggatccaacgagtgcttagctgatgctcgacac

SEQ ID NO: 57928 - DNA, 454 bp, Triticum aestivum
  Clone ID: PAT_TA_57928
acgattatattaccgtcctaacattaaccatttacgacaacagcacacgagatcagacggatggtgcataaacgaatccgtggggaccatacgagaatatagaagctttgaaacccatgcggagtatggctgcaggggtgaagcttacctgaggcgacggaagggcaccacgatacgtggaaactgtggctgaatatgactcaacatgggaaaaatcaccaaggccagacgtagcaaggagtagacagcactggcagttctgttttgatgctatgggtgctgtcgtatagtcgatcttactggaggaaaacatcaggctgaggaattcatccaacacatcgaaacctcaacctgctaacttggtataatgagccatccatccgcaactagcttcttagaaggactatcggcgacaacgtgaacgacagcagatgcaacaacatacctgtgagga

SEQ ID NO: 57929 - DNA, 144 bp, Triticum aestivum
  Clone ID: PAT_TA_57929
gtgactccggcgagaggagagcggctggcgaaccgagatttagagcctggggcgcagctgcagaatcaacttaccctggacacgctgcagcaggaggtggctcggctaatgggccagaacacgcacatgctggcgagcgccaac

SEQ ID NO: 57930 - DNA, 370 bp, Triticum aestivum
  Clone ID: PAT_TA_57930
tggccgttgaggagctgccgtctttcttgatggtgccgcctacttatctggttggttctggggcatccaaggaggtgtctcttgacgttcgcattgacaagatgtgatcctgatcgtaacagactgattgtcctatgttgtcctcttaagtcagtttgaactggactagtacgtttttgccaaggaatgatggttttcagttgcaatgccaatgggcgtacgcagcaatttactgtagtagtattttgttgcagctagctagcactccaaatatatatgttgcttgattgatcaggatttggggtaagtttgcccaatctaattgtgatctctagctagcactcgaaatatatatgttgcttgattgacc

SEQ ID NO: 57931 - DNA, 684 bp, Triticum aestivum
  unsure (1)..(684): unsure at all n locations
  Clone ID: PAT_TA_57931
caacaacaacaacaacaacaacaagaacaacaaatccttaacaaattttgcacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagggctccttccggccatctcagcaaaactcacaggcccagggctctgtccagcctcaacaactgccccagttcgaggaaataaggaacctagcgctacagaccctacctgcaatgtgcaatgtctacatccctccatattgcaccatcgcgccatttggcatcttcggtactaaatgagaagaaaataactctagtactagatatatgaaacaccgttttcttagtccatggtatggtcgttgtagcggtgaaaaaataatgtgacatgcactatcatgtaagaacccgaactatactagttcaaacttgggaataaaagacaaacacaggtcttgtctncnnnnnanaannnnnnnnnnnnnnnnnnn

SEQ ID NO: 57932 - DNA, 562 bp, Triticum aestivum
  unsure (1)..(562): unsure at all n locations
  Clone ID: PAT_TA_57932
cggtcccgacttccccggtccgccccgcgtccgggttgcgttngcgcctagtgcgagtggttctgagacttgcgaggaagagccgcccaaggtagactcttgtagcgacttctggagtagatgatnnnncnnnttgncnnnnntnccccnncnntcccnctnnnnnncnnncccccccctcctccccccccccttccctccccccccccctccttccgcgggggggggcccccctttttttttttcncccnccccnncnccnncccnncgcnnccccccccgccccccccgcccccccccccccgcccccccccccccccccncccccccccccccccccccccccccgcccccccccccccccgccccccccccccccccccccccccccccccccccccccccccccccgccccccccccccccggccgcccccgccccccnnccccccccccccccccccccccccccgcccccgcccgcccgcccgcccccccccccccccccccccccgcccgcccccccccccccccccccncgcncccccccccccccccccccc

SEQ ID NO: 57933 - DNA, 612 bp, Triticum aestivum
  unsure (1)..(612): unsure at all n locations
  Clone ID: PAT_TA_57933
ggcttttcttcggtgtttgcggtggctttgcttgcaggagtattcctcgcttgccttgattgaggcgtgcaatgcattggcgtgtgctccggagtcttcgcatacaatctaccaccgtcgagggaagtggagcagctctacaggtgcaagggcattaccatcatgcgtatctactgcgtccagctccaggcgctcgacgcgctccgaggctgcggtatcagactcatgctcggtaccaccaataacgacgtcggcgtacttggcgggagcctgtacggcgacacctgctgggtgcatgtccacgtaaagccctaccacagcaccggggagaccatccggtaattgcggacggaatcgatgtcacgggcggcgccgtgcagaacatgctggcggccatgcggaacctcaacaagggcctggcggtggccggactaggaggcgccatcaaggtgtgcactgcggtagaggttcgacgtgctcaccaactcctacccaccctgcgncgccagtgttagctgagccatacatggtcgacatcgtccggaaactggccagcagcagcgcgccgctggtaggcaacgtgtaccggtactttgcctaagtagcaacccg

SEQ ID NO: 57934 - DNA, 748 bp, Triticum aestivum
  unsure (1)..(748): unsure at all n locations
  Clone ID: PAT_TA_57934
cggacgcgtgggtctcggtcggctgcttcttcgcgacctacaacttcctgaaatggtgggccacagccgaagcggagacgggccacgcaaattgctcggcggcggcgatcagggcggtgccgtcgccttcgggtctggttcggacccgtcgaagaggttccacgtcgcccttacggcgacggatgcgctgtacagccagtggcagtcgcggataatgtactactggtacaagcagatgagagtcaggcctgactcggatatgggcggcttcacgcggatccttcactctggaaagccggacggtttgatggatgagatacccaccttagttgttgaccccctccctgaaggcgctgacaggggttacattgtcctcaatagaccctgggcatttgtccaatggttgcagaaggcgaacatcaaggaggattatatacttatggctgagccagatcatatctttgtgaagcctttgccaaacttagctcacggtgaagaacctgccgcatttccctttttctacatcaaaccaactgacaatgagaagatactaaggaagttttttccagaagaaaaaggtcctgtctcaaatattgatcctattggcaactcccctgtgattatccagaaggtacatctcttctcttgtgagaagattagtagtagaatacttagctgtgctaagctntatacttctgttaccatgactggttcagctatactagatgccaagatggcataatgtgcc

SEQ ID NO: 57935 - DNA, 508 bp, Triticum aestivum
  unsure (1)..(508): unsure at all n locations
  Clone ID: PAT_TA_57935
gttctgttcagcctcaacaactgccccagttcgaggaaataaggaaccttgggcctctgggttttgctgagatggctggaaggagccctggcctaatggatattgttgcagaggctgttggaaggagacctggctcgatggttgttgttgttgtttttgttgttgatgcagaataatagcatgaacaacattgtggatggcctggcactgcgactgctcagggatctgccataggtgctgacaacacaattcttgcaacagctggtaagtactttgttgcaaaacttgtgatcttccatgcgctatgttgtgttgctgcaatacaacatccatgcatggaatcagttgttgttgcaaaatttgttgaaggatttgttgtttgcgccgtgtgtttcagtgtttgtgtcgtgtcgctagtgtgtgttgtgttctagtacctgtttgttcatgtgagttctggcgtcgtcaataaataaagatgcatatcaaattcanngnnnnaaaannt

SEQ ID NO: 57936 - DNA, 832 bp, Triticum aestivum
  unsure (1)..(832): unsure at all n locations
  Clone ID: PAT_TA_57936
gggaatgggaaaacaatgcttgccaaagctgttgcttcagaatctgaagcaacattttttaatgtttcagcttcttcgttgacatcaaagtgggtaggggaagctgaaaagcttgttcggacacttttcatggttgctgtcgagaggcaaccgtctgttattttcatggatgagatcgacagtgtgatgtcaacaaggttagctagcgagaatgatgcaagcaggcgactgaaatctgaattccttatccagtttgatggggtgacatcaaacccagatgatttagtaattgtgataggagctacgaataaaccacaagagttggatgacgctgttcttcgaagattggtaaaaagaatatatgtgccactgcctgatccaaatgtacggaggttacttctgaaaaatcagctcaaaggacaagcattcaaattgtccaatcatgatctggagaggcttgctgtggagactgaagggtattctgggagtgacctgagagccttgtgcgaggaagctgcaatgatgccgatcagagagctcggtccacagaatattctcaccattaaagcaaaccagctgcgaccattgagatatgaggatttcaggagcgcgatgacggcgataaggccgagcctgcagaagagcaagtgggacgaactggagaaatggaacgaggagttcggcgcaagctgacaagagtaacgctcccttctgttcaccagacaggtttacctactttggtctgtatataaaatcctcgccgtaattaaatggccctcgggcacccgatttggtacaacaatgtanatggcgtacaaggaaaattcctctg

SEQ ID NO: 57937 - DNA, 169 bp, Triticum aestivum
  unsure (1)..(169): unsure at all n locations
  Clone ID: PAT_TA_57937
ccgccggaggccggagcgccgccgcccgaggagacggggaacagcgcagccgcgacaaccgncgccccaacggcacacgaaaaaaccgggcaagcgccagcgcccgacacgaagccgaacaacaaaaactggggcggggagccccnacacaaacaggcngaggcaccag

SEQ ID NO: 57938 - DNA, 206 bp, Triticum aestivum
  Clone ID: PAT_TA_57938
cacgcgcccgcgtcacgccatggcgaacttgcaaccctagccgtagtgcagagtgagatggatggataggccgtcgagcatgatgacggcagcacgcgaccaggatcaacaggatgtgccgcccttctgcggtactagccagggcgacaagtatagttaccacgacgccgccatcgacctccccaaccatctcgtgggcggaggca

SEQ ID NO: 57939 - DNA, 385 bp, Triticum aestivum
  Clone ID: PAT_TA_57939
cggaaaatcccgggatcgacgccatcgcgtctcgccgttcgcagccgtcggcgccggtcgcttcgtcttcctcgagcaccacgagaataagcaggaccacatgttgccaaggatgccattgtcgatgaataagcaccaccacattggttaggtcgacgttgacgtgcggaggcctgcctcgccgacggccgtgcgtgtgcctacgttacgtgcattccttatgtgatgagatgctggaacgtgggcctggcatagtgcttgcctgtgcgtgattttatatgcgtgctatcttccgcgtgcttactaactgggcttggtgttcttgcagtatatcacaccttttgcgtcggtgtgtgtgtcatgtgtatggtgtgatgctatcata

SEQ ID NO: 57940 - DNA, 223 bp, Triticum aestivum
  Clone ID: PAT_TA_57940
aaggaaaagaaccactcgttcgtagggaagggagcaggcagggggccgaacgaagcactccggccggaccggctcagtcatgaggccgccccttgcaggcgcacgcccccgtaacgaggaacgcggcgcccaccacccgcagacggaacaagctacatcggtacctgacctagacgcggtcactcctaatagagcgcacggtaccttagagcccctggctttt

SEQ ID NO: 57941 - DNA, 210 bp, Triticum aestivum
  Clone ID: PAT_TA_57941
ggcacgcgagaaagctgccctgcaaatctcgggcaatctctgacgcgaagctttgttcctacatgaagtaaccgttaatgggtgctgaagaaagtcgagaacaattgaaagactacttacttaacgaccccaagaagtgactaagcaggcccgagcagagggctaatgcagctgtgcccatacaacagaaggaccgaattcgacatgagg

SEQ ID NO: 57942 - DNA, 406 bp, Triticum aestivum
  unsure (1)..(406): unsure at all n locations
  Clone ID: PAT_TA_57942
ggcgtgggcgtccacgacgacgaggtaggtgtttgtgaccggtgggaacagtgtcctgaagcatgtggacgaggcggctaggcgctgtcgctccaccatcatgctagggagctggggtacagggtcattcgtgcgcatccggagtccgtgttcttcgccggcccgtagcagcagcggcgcgttttcgacatgtgagcgagcatctcgagcgagccatgtgcagttcgtggagctgcatgcatgagtgtacatgttactggaataaatagctagcacgtacggctgtgactactacagtactacgtgcgtgtagcanatgagaggagagactattctctgtgtacggnatgctcatgcttgtgttcgtgtgcgtctatgcatgcatgcacgtgaggtttctatgtat

SEQ ID NO: 57943 - DNA, 301 bp, Triticum aestivum
  Clone ID: PAT_TA_57943
cggacgcgtgggcgaaactcctcctactcgcccctgcccgtcctgaataccaccttcttcttcccaacgtcggcctgaccaccggctgcatagagaaggacacgccgcaggtctctggcaccaccacgaaagaggagtggagaggcttgctctagccacaccttgcacggacgaggaagagctgatccaggcgcacacggaggccgaggggggggcaagctctgctgatggggactttgctgatggcatcaacaaggttctattttttcatgcatgagcgcctcccgtcgagggatatggc

SEQ ID NO: 57944 - DNA, 586 bp, Triticum aestivum
  unsure (1)..(586): unsure at all n locations
  Clone ID: PAT_TA_57944
gacttcgaagacttgttacgagcagaccgcgagcaatggcacagcaggtgaagaaggcgccggagccggaggtgcaggactcggagatccagacacagcaggtgaagaaggcgccggagctgcaggacccggagatccgggcagagctggaccgccgcgcccgcgaggagggcgagaccgtcatcaagagcggcgccggcggcaagaccctcgaggcgcaggagcgcctcgcagaagggcgtaagaagggcgggctgagccgtgcgaccggctccggcaacgagcgcgccgagggtgagggcggngtggtgatcgagccggacgagaagaagctcgaggaggtcaagaaggatctcgggcgcgaatgatcgagcgtggtagacgatgtaaggcctcacaggccggtcctcctatatatcgtacgtgtgtatgtactgcactgtagttagtacgtagtgctatggatgtacgcggtagtaggctaggttgaaggatgtagagtacgtagtagcgttgatgcatgtnctcgtgttcgcacggacatgcgcgcgggacgtacgtctggctacaaattttggtcccccgg

SEQ ID NO: 57945 - DNA, 354 bp, Triticum aestivum
  Clone ID: PAT_TA_57945
gtgtagaggataggcatacatcgcccgccggcaagggaggttagagagactccgagcggctgacatagcaccggaccgaggaaccactttgtcgagcgccctaggggacgacaggccccaataacgtcgatgcagtgcgtacaatcggccgccagcgaggccagctagcgtggattgtgacttaggaggcgtactactgcgtataaccgtacacacctgagatatgccccagtacctctgactgcaacaacatgaccatatcgagggcaaaaggcggaccgtcagactacctggacgtagtaaacggacactgcgatcacgtgggtcattttaacctgaccggagacggactga

SEQ ID NO: 57946 - DNA, 514 bp, Triticum aestivum
  unsure (1)..(514): unsure at all n locations
  Clone ID: PAT_TA_57946
gaaacggaaaggaaacccggaaaagaaaacagagcaggactccactccacactccactctcctccccctcctcactctttttggatcgtaaggaaacgcggaagaaaaatccatacgcgatcgtggaggggaggacattttgatcggtgttggtttcccaaggcggagacgagggtacatggtggccgtcatggatcgcggcggcggctgcgggggaggggagaagaagcggcggctgagcgcggagcaggtgcgcgccctggagcggagcttcgaggtggagaacaagctggagccggagcgcaaggcgcggctggcgcgcgaccttggcctgcagccgcgccaggtcgccgtctggttccagaaaccgccggcgcgctggaagaccaagcagctcgagcgcgactacaacgcgctgcgccactcgtacgacgcgctccgcgtcgaccacgacgccctccgncgcgacaaggaggcccntnctcgccgagatcaaagatctgaaggganagct

SEQ ID NO: 57947 - DNA, 366 bp, Triticum aestivum
  Clone ID: PAT_TA_57947
gagaaagagagagcagaacctacacttgtgaaggaagcgatggcgactgactcgagaacgccgagagggtagggatacgtctatcctgggaaagaatgaccccgggatagagatttctgaaggcgctagacacgacactataagccgttgtttttaaccttaagggcgatctgcgtcgtcgtacaccaggcaatcggctacggagtactgcagcacagaacatcttgtttggaccaacgcgaatgccaccgtccgctctaacgatcgaaccgcagacgcacgacgatgtgacaatgcttccatacgagactgggaaagcttctcgcggtgacacataggatggatcacccaaatgacagctatgct

SEQ ID NO: 57948 - DNA, 454 bp, Triticum aestivum
  Clone ID: PAT_TA_57948
gcgaacatgcgtacatcttcccaggatttggcttaggtgtagtgatctccggggcgataagggtgaaagacgatatggtccttgctgctggtaattctacaagaacctgagtattgtttgtttcaaatcaatggtagcgtgctactctgttgaactgctctaagcctgcatgattatttgtttcatctttggtgttgagcagctgaggccttagccgaacaggtcacggcagagcatttcgacaaaggtctgatctatccacccttctccagcatcaggaagatatcagctaatatcgcggctcgtgtcgctgcgaaagcctatgaccttggtaaaatcttctttcctagacctctaggtctctttctctttagtagcactagaaagacacgatcaccaaacccttatgcttgtctgtacgagcaggactggcaagccatcttcctcgcccaaa

SEQ ID NO: 57949 - DNA, 394 bp, Triticum aestivum
  unsure (1)..(394): unsure at all n locations
  Clone ID: PAT_TA_57949
gcctgcaggtactctggtccggnnaattcccgnnggtcgacnccacgcccgtccgagtcaggacgcattcagaggtaccaggacggtgccgaagcgcaggctgtcagcgcggccgaggcgtgtcgtgtgtgcgcccgccaccgcactcaggtggatgggagactgcgcctctgtggcgcggcggcaaagacgcaaccttaacagtgtggtcgtgcgttgggacgatcagaccgcagagcagtgaacatagctgagctgtggattcgtgacttaggaacaactagatctacaagctggaacagcacgttcacgagcttggcttttgaacgaaccgcaaggaccaactggaggagttaacggcccctgttcaactagactaaatcactgtggcgat

SEQ ID NO: 57950 - DNA, 585 bp, Triticum aestivum
  Clone ID: PAT_TA_57950
agcccaggcgggcggcgggggtcaggttcagtgacagggaggaggcgccgctcggtacggcgacgtgttccctgcgcgtgaccgtcggcctcgcggagaaaacctgtggcgctcgcaggatcgtgtgccacatgcgcgcggaccgagaacctcgggttcggccagaccatcaagcggcggtccgtttgctctcatgcagtgcttggacatgcgcaacgagcgcatgggcgttgtggggcacgaccaggccacggactccaccacctggcaggacgctctacgtgtacataacccactttcctgtcaggagcatcttgaacgagtttgtcgacggctaggccgagagacgaagctcgttcagatgatgccgacttggcgcgcctggtgggtgtcttctagacgaaatacagatcgttgagagcatgaataggaagatcacacgacaagatgcagatgttgcagcgcatatattgagacgcacctcatgagagccccgtaccaaccacagcagttacctcaacaatggcagcggccaccacaggatatacaaatgcaacaaatgttgttacaaagagcccgcacaca

SEQ ID NO: 57951 - DNA, 427 bp, Triticum aestivum
  unsure (1)..(427): unsure at all n locations
  Clone ID: PAT_TA_57951
cctgccaacgcgcgagaagcgatgtcctccagtgatcagaacccagcgcccacgcccgcttcgggcaccggcgggacggccgccgccgggcaggccgaccacggtctcctcgcaggcgatcgacatgggcgctcaggtgctgcagccgttgaagccggtgcgccagatgaagcagcacgcgtgcagcttcgcgctgtacgcgcatgacatgcaccggcagctcgaggcccaccacttcgtgtcccgcctcaaccaggacgtcctccagtgcgccgtctacgactccgacaagccctcggcccgcctcatcggcgtggagtacatcgtgtcggacaaaatcttcnaggacctggccgccgaggagcagaggctgtggcactcgcatgcctacnaggtcaaggccgggctgtggactgacgtgggcgtg

SEQ ID NO: 57952 - DNA, 588 bp, Triticum aestivum
  Clone ID: PAT_TA_57952
caaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctgctggaggcgcttcctggtgacaacgtcggcttcaatgtcaagaacgttgctgttaaggatctgaagcgtgggtttgttgcatccaactccaaggatgaccctgccaaggaggcggccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggagctggaggcgctgcccaagttcct

SEQ ID NO: 57953 - DNA, 316 bp, Triticum aestivum
  Clone ID: PAT_TA_57953
ggacggtctcttactagaagaggccgtcctaaatattgtatgacacacgagggaatgtatccacatactagcctgagggccatgctgtatgtctcggcttggagcaggtacgcacggcagtgacggtagagaatcgacagatctttctgtccacatccgtatcatcccagaggtgttcctccttgcgctgagcatcccttcgcttgcaataaggctggcttcctctgcgaatctggagctggtgccccaggcctacacactgtgttatctctacttggagatctggaggacgctctcctttacctcgtgcgtaagc

SEQ ID NO: 57954 - DNA, 266 bp, Triticum aestivum
  Clone ID: PAT_TA_57954
ggcaatcctttgccatagattggtgctgtagaaatctacagctagttaggttgaggtgaagtagactttgactgccatagggctgagggtgtttttggttaggatgatacatcatggaatttcaatacatcaaagttcactttcattacttgtgactattcacaaaataaagagtttctgccaaaaaaaaaaacaaaaaagaaaaaaataaagaagaaaaaaaaacaaaaataacaaaaaaaaaaataaaaaaaaacaaattaacg

SEQ ID NO: 57955 - DNA, 429 bp, Triticum aestivum
  Clone ID: PAT_TA_57955
ccccgtctctcctcctcgtcgcagagctgccaccgggccgggcgaaataaaccattggaacaaggggaaaaaacttgccaaaaccctagatctcccgctcgcattgcccttctatgaccctcggcccccactgagggcacggccatggcctccgcggccgtcatcccctcccccgccggcggcgccgtgcccgtgcacggggccgccgagcccgccggctggctcatggacgagcgcgacggcttcatctcctggctgcggggcgagttcgccgccgccaacgccatcatcgacctcctcgtcgtgcacctccgcgccgtcggcgacccgggcgagtacgaccacgtcttcgccgacgtgcagcagcgccgccaccactgggcgcccggcatccacatgcagcagctcttccccgtggccgacgtctac

SEQ ID NO: 57956 - DNA, 467 bp, Triticum aestivum
  unsure (1)..(467): unsure at all n locations
  Clone ID: PAT_TA_57956
atttccggcagcttcctctccgaatccctcgccatcgcccgcttctctttacccacgcacgcaacctcctcccctgcctcaatggccgccgctctcgtctcctcttttcctctctccctctcgtttcctctcccatgtgaccagccgccacgggcgtcgccagcgggagaggagacggctccgttctcccacgcagccacacaaacggcgtcgcctcgagggaggagtgggtgggaggagaaggccgcggcggcgttttcgatctgtgatttgcctcgcacgtgaggcggtggatcgatccggttgcccgccgccgttgtcgcctgctctccccactcgcgtcacccgaccttagaaagctcacggcctcacggngacaaggtccgcgttggcgggcgcggaggagggggagatctcggacgacggagaccgctccgccgctgcggggcgcggcagccggagcgggt

SEQ ID NO: 57957 - DNA, 357 bp, Triticum aestivum
  Clone ID: PAT_TA_57957
gcacgccgacatccttgcccccctctctaccccatcggccccctcctcttcctctctagttcgagctcaaaagctccgcggtgatcgagctcattgctgtcgttaccgcggccaccatcgatgccgctactcgggagcacgtggcagaaggtcctccacggtggtattcgtccgttccgggcgccgcttgaagctggggcaccgcgtacacatcgcacatggacagcttccccgcctcggacggcactggctcggcgaggtcgtcgccgatctacgcaaccacgcagctactcagttctatccaaccacgccgaggcgctagcaacttcgagacggccacggatgccgctataatgg

SEQ ID NO: 57958 - DNA, 529 bp, Triticum aestivum
  Clone ID: PAT_TA_57958
cggacgcgtgggtccggggttggcttctcctccccttccggttcgggttctggttcggttcgggtccgagagtagctagcctagtctagggtttccgtagagaggaagggagagggagatccatccatggcggagacggagtaccgctgcttcgtgggcggcctcgcctgggccaccgacgacaacaagcctccagcaggccttcagccagtacggcgagatcctcgacgccaagatcatcaacgaccgcgagaacggtgaggtcccagcgggttcggcttcgtcacgttcggcagcgaggagtcgatgcgccaagcgcagttcacctggagcaaagaaaggtcgatcaccttcacccactctcagaaaagggtcaccatcaaggaaaggccgctcatcatcttctccaccgaagaaagcttcacctgctaggaaagcatcttctcctactcagtcggttgttctacatgttgatcatccatccagagatgtgaatgaggctcatttgaatgagatatttgaaaatttt

SEQ ID NO: 57959 - DNA, 372 bp, Triticum aestivum
  Clone ID: PAT_TA_57959
gttacgcgcgggtccgaccgctcggaagcccgtcttcgcggcccaagtcgggctggcgctcgacctcatctccttcctagtcttcctccgcaagccgcgcgacatcgacagacactccgcctgggccatcctcaccgaacgggacatcttcgaggacagcatagacgcaacattgagcaaaggtcacaataggggtttaggaactcttactgcaggagggcttgctctagcagttgccgaattggccaaaaacttgggtgcatcgtaagaagcgatccttattataagcatctttactggaggttatatcacaaacttggcgaagctacacccaacgatgaagccgtatgaatatggacttagagtattctt

SEQ ID NO: 57960 - DNA, 588 bp, Triticum aestivum
  unsure (1)..(588): unsure at all n locations
  Clone ID: PAT_TA_57960
ggatatcgcttgcacctccttttagttcatggtcttctgtggtatgcctcagggggcatccttagagcatctacaactaggctcctcaaacccctgctaaacgttcggggggacaacccgatcattgtctggtcacgaattcgccacccaaccactcgcctatacccagcccatacctagtccaaatgtggggcggtccggacgcggcccccacgtcggactggcctagtctgaccccacaaataccccaccctggacaaaaccctagtctagtcttgactactccgctccactgcttgtctccttccgtagttccgtccacttcgtgtcccctcccctccccacaccatgtccaactccagcaacggatccggcaacgagtcgtactccatcgtctggggggcgctcaaggaggaatctagctccttcgccccggacgacgaggagcacatcctccgcattgcccttcgccgttcatggatggataggagncggaactcaagctccgcgatcgaaggggcagnctcgcattggcctgaagccgcacatcgctgtccgtgccctcccctttcatgtggtggggcgact

SEQ ID NO: 57961 - DNA, 350 bp, Triticum aestivum
  Clone ID: PAT_TA_57961
cggacgcgtgggttttttttttttttttttttttttttttttttgaaggaaaagaaaacgctagattctttcgctattaatacttagctgtaaaagaaaaaggtacaagccctgcttgacgagaaatcatttggtctgagcacatgaacactttaagaggggattcaagcccggaagaagcacgcacgcgcacacacacacaatgggaaacagccaaacattcaggccgcatttgctccgtagtatatgatcgacgatgatgattgatgcctcgttgagccgcgccagcgacaccagccacccgcggaggtgggctctgggaaaaagccccccccggcttccccttttac

SEQ ID NO: 57962 - DNA, 345 bp, Triticum aestivum
  unsure (1)..(345): unsure at all n locations
  Clone ID: PAT_TA_57962
cgcctgcaggtactcgggtccggnnaattcccgggggtcgacnccacgcccgtccggtccgtggatgaaacaaatgcggccccagcaggcttcggagaggagggcagggccctgccgacgattaatgtgggtacgtcctccccggcgatccgtgactgggccataccgtctgatcttgaagaagcgctagatcttttccggcggcagagggcggagtttgtgatgtaaggctagagaatgcctctgaaagaccgggcgtacgaacaaggactctttactgttggaatagtacttgtggccatggttagcagatgtaaaagagaaggcctcatgctgtcatgggct

SEQ ID NO: 57963 - DNA, 316 bp, Triticum aestivum
  Clone ID: PAT_TA_57963
gtatatttaagtggtactccctccgtccggaaatacttgcataaacatcttgcaatcgatacctcggcgagtactgaggacattttacacactgcctttcttgttactttggccgacggctacgatcgtacgaccggcatgtttatatgttagactgtggggggcggcacacagcgctacttggaccccgctgagcttttagaccaagcgcgggacgtggtcgacgtctcgacgcaccattatatgagcatgccgcggcctgatctttcggaggaggaagggaggaaaggccgtgccgtagagcctctgtcgcacg

SEQ ID NO: 57964 - DNA, 408 bp, Triticum aestivum
  Clone ID: PAT_TA_57964
cacgggcacacatctaatactgggcttacggaccaccggataaacccttactgctttgcctattgggcgcacatctaatacgggcttgaggacttctgctcaacttcgagcttgagcaccagtgtcttgcgatgctacctgcacctcttattcaacgctctgattccccacatgagaagaccagtgcctaagtatttcacggcttcgcttcctgcaaaggttggtccatgaacaaccatggaacctatagcgcgctacttgcttgtgcttgctattatccaacaagctcttaagataagtccccaccatatttgtgccacttttgagaggatggttttacaaattatgtccctttgtagcaatgtgccagagcatacactcatcccttatgagaaggacttgctacct

SEQ ID NO: 57965 - DNA, 381 bp, Triticum aestivum
  Clone ID: PAT_TA_57965
ggaaatcaccatcattccaacgttctcgctggagagtctctgctcttatccatgtccacagggacagagcgtgcatcgtgcagcatgacctgccaaggctagacctgactctgcacaggcaactaaacaagcactataatcacagtatgctgccaaggatggtgatttgagtcaacgcctttgaatgcgtgaggcacaacctcaagatcagggctccttggtatggagcaagtgctctcgagggtgtagcacactcaacaaacatggatgtggcttgctatcgcaagattctactagagatggtgctaacagggcacctaatgaagaattcgcgaacggcacaaccgcgaagatgatgctgtgaacctttgacctctgata

SEQ ID NO: 57966 - DNA, 323 bp, Triticum aestivum
  Clone ID: PAT_TA_57966
aacaacccactcggcggaggagacggcagtggatgacggagcacgcgaagatgtgaaattcctgaagccgagcaaggaggcgatccttctgcagggactgatcgccggcacgaaaggcggtcattgtgcgcgttatcgaggagggctcgcgagaccgcccctatggcacattgctcatggtaaccggcctatccaatgacccaaagaaggtgattcgtatggactcggctaataagacggcaaagaatgagcacgagaagtgctttctgaagctggccaacttcacccacatgatgcccacgcgctacaccctggatgtagac

SEQ ID NO: 57967 - DNA, 332 bp, Triticum aestivum
  Clone ID: PAT_TA_57967
ggtcgccgtctcatctaaggcagacacagtccctcttgatctgaagtatatggtccttatcgaagaaatagccacttacatacctgaggcacatatgtaaatgcctaaaggtagctcatttctaccgcccttgatccttggacgggctgatataaagccacactcaacaacatgaggctctacaagtactcagaaggctagtactgcatcatgcacgatattcgcacactgtacaggctctatgccagactgtgctgcacttgaagacgctatagatgatcgatgctccggttaaactaagactaatcataccacagcgtcctgataaacta

SEQ ID NO: 57968 - DNA, 429 bp, Triticum aestivum
  Clone ID: PAT_TA_57968
agcagaacatggaggtggtgccggacgagtgaagcgtccgccctcgggcctccggtcatggcggcgtccggccgcggtcaggtcgacggttccctgtattttggaacgctttagtggtagtggtagtggtagtgaccgtttaacggtcgtgtgatcggcgcggtgatgtagttcggcgatgatgtcggtggcctgtgtcccattttgggctgcctccaggtttcgcccccgttgccgccggttagtaggcgttgttgggtaacatggaggtaggaggaacgcttgtggttgtagtagctgaacatgttgtgcctgtatatatgtctgtagcagaatgtgtgtatgtatgtatgtatctgccagctggggtcctggtgccgtggtgcacgtagcagggatgcatgtggatgttggtttgctgtgcactac

SEQ ID NO: 57969 - DNA, 452 bp, Triticum aestivum
  unsure (1)..(452): unsure at all n locations
  Clone ID: PAT_TA_57969
cagagaatgaacggacttgccatgcaaaacaacggcttgtatggcacacccgcgtcttcttcccttcagcaagctaataggccagcaagacccgaagattcactctttggtgatctggtcagcattgccaaaacaaagcccagcaaaactgcagctaataaggctggtggcttgtaaagacgaatggaatccttgttagtaccatttctgtcacagcgatagcttctgctcatagtacataagttctttggaaagtccccctattggggagtagtaggcgagttatagattttgaaattcatagcaagtgtggttcggtatagttctattttgtttactcggaagcaattatattttgttcacttgttgcaagcgcagagttcggaagcaattatattttgttcacttgntgcaaaaacgcagagttctcctgaatcatcagaagttctttt

SEQ ID NO: 57970 - DNA, 434 bp, Triticum aestivum
  Clone ID: PAT_TA_57970
ccatgaatgaattttgacagtttacaaacatctccacgaatacatggaaagaaaagtttacaaattatcttcagcaattatcttgcaggttcatcagcagcttgaaaaaacagccatagtaaattcagagtttggagtactagcaaattaactgaaccctgaaacctgaaattttaactgaattttaccatcttattcttcctgaggaacacgagctctgggctctggcggcagcacaaggagcagggcagaggagcaggacctcgtcagcgtgcttcttgctgcgcgccagtccccggcgccgggggcaaggggcggggtggggtcgggatcctcgatgccgcaggtggcgctggtgctggaggtgacgctgttccccccgctcgccggcgtagccgctgctgctggggctgggcggaccggcgtcgccggca

SEQ ID NO: 57971 - DNA, 693 bp, Triticum aestivum
  unsure (1)..(693): unsure at all n locations
  Clone ID: PAT_TA_57971
gnagcccgggcggancnnnnnnncannnnnnnnnnnnnnnnnnnctgcagcgacacacgctctcgccgccgccatgactgagcagatgacccttcgtggcaccctcaagggccacaacggctgggtaacccagaatcgctactaccccgcagttccccggacatgatcctctccgcctctcgagatcagngggggaccatgtggaaactgaccagggatgagaccaactatggaattccacagcgtgctctgcggggtcactcccactttgttagtgatgtggctatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgcgacaagctggtcaaggtatggaacctggctaactgcaagctgaagaccaaccacattggccccacagggctatctgaacacgggtgactggctctccagaagggatcc

SEQ ID NO: 57972 - DNA, 391 bp, Triticum aestivum
  Clone ID: PAT_TA_57972
aaaggattacactgaccgaccggtgccatagcagctcagaggagggcgggcggagacctactgacgcacgcgggttagccagtgtgacgccactccttgagggcgcaagacgccccgtacctcgccctcaaggccctcagggaccacaaccgtcacaagctcccttgcatcatgaccgagatgcgccgaatcttcaaccgtgacacacaaaactgcgccccagtgtattcacaaccaagctcgatgaccaaatgccagaatcatcctgtactatattactaaggcgaactactatatcgacactgccctcctcccgtcaaacctacactgactcaccacggtttaattccgggtcacgtacactattgacgagcgaacaatccaacacttg

SEQ ID NO: 57973 - DNA, 463 bp, Triticum aestivum
  Clone ID: PAT_TA_57973
tgaggagcccaccctggtcatagccctaccgcggtggccgtgtgcagaagatgagaggtcgaggatggccgacagttcatggaggagacgctcgacacatataaggttagcgaggaagaggttgtggtgggcggcaccaccagcgcctccccatcctcgcgaaaaggcagcgtgaggccgtcggacgggaccaggcggcggaaccaccagagcctccccatccccacgaaaaggcaacgtgaggccggtggacgggaccaagcgggccgaacgaccattaggctaccggcgtggccaggcaacaacgtggccgcacaagttcaaatgagaggaagctgccaaatctttggcagatcttgctgagtaacccaacttgtttgaagaatagcggatttctgtaccaaaagattgattaatgctttgcagaccaacactgctttatggcggtgctatttctgaacca

SEQ ID NO: 57974 - DNA, 348 bp, Triticum aestivum
  Clone ID: PAT_TA_57974
gaccaggctggggggaggctaagaaatggcaacggcacagcgacgggccgagcctgccgaggcgcatgctatgagagctccaatgattgacgagcactagggaagtggaatgccgctggacaggctgatggaaggcctgattctgaggcgcacacgccctatgctatagatcaggtgtctgaacagatgtagaactatgttcctgggaccaaccgaaataatgtgcgcctgatgttagctgaacactgaacacgcggatgactctagacgtatagtggagaacaatactatcgatggcgatgtctcgacacccacaccattggtggccgagatcaaggatgaagcgtc

SEQ ID NO: 57975 - DNA, 449 bp, Triticum aestivum
  Clone ID: PAT_TA_57975
cccactactgccggctaactattgtattgattcgtgctacatgtcgcattaacttgcatcactatctgagagcatcttgagggtaagattcatttcctcttaacaatgaacgtgataagaaactgctttcttcaactcactaggagcaacatatgacatgcttagtaaaccccatacagaatgcacacttatactgatgaaaaccttgctgatgttataaccttgagcgactggtacttaccctagggcgctctccgcactgacagacatttcagaccaatcattatctgacaaatatgaacgtaaagtgctggttgtattcttgcacattcatgcttgtgcttactgacacttgcctcgcacataatgtatgaccttcacgccatacacacttagctgagcatttatgagggtataataccaacatagcctacaacctttactctttc

SEQ ID NO: 57976 - DNA, 601 bp, Triticum aestivum
  Clone ID: PAT_TA_57976
ctcagatcgagctccgccccgatgtggaagaaggcctcgccgcccagatgtggaggaaggcctcgccgccccgtcgatttgcatgcgagctccaccccgaagtagaggacatggtacgcggacttctatctgtgcgcatctagccatggagatggagggctcgcccctctcgcgcatctcctccgcacagagcgctagcagcccacatggcgtagatccgccatctcgtcagtcccacgcgccggccaccggtggctaccgcactgttctgttcatcccccgcccgccgcacgcgacggcccacactgccatgttgttttgctgcagccagaccgccgcccctgccctcgcgcaccgggcagaggctcgttcttctggtgggtgttcactcttggcgactacgcgttccttccggtgggtggcgctctgcacactgcttcgcctttctcccagaggcttgccgttcggcccctacctctaaccaattgattcagcaacacagacagacgtgggattctagtacaatgtctgggaaaaaagctggtacacctctaaactttgaatatctgggagaggatgactaatctatattatccacata

SEQ ID NO: 57977 - DNA, 572 bp, Triticum aestivum
  Clone ID: PAT_TA_57977
cccgctagtactactagtccagcaagaacacaagtaataatacagactgatgctcctctgctccttgcccagatcggcgccgccgccagcgacgggaaagatgccgctgctagatcctacacactctctctcccctgatgtgaatcctcatattatccccatgaatttcagcctcaactctctaatcccccctatgtgttttctttttggcttgcagatcaaaccctattagggatgtgattcccctgctccagattgaagtggtcggcgttggtggtcgccgtgctgctggatggtgcagacctcagtcccagtgcgtgtccgtggagcagatccaccataggtgcaggggaatggaaatgctactgagaagaagaagagagcttggtctggctatttggaagcaaggtggagacgatgaaacccgggcaatgcttactctgcttcctctcccactaatatctaatatccatctcccttggctggtatggctgcccatccctggtgtactatgtagccctttgtggagtcactctattggctagaaagtgtagcccatgcctagaccaact

SEQ ID NO: 57978 - DNA, 659 bp, Triticum aestivum
  unsure (1)..(659): unsure at all n locations
  Clone ID: PAT_TA_57978
gtatagcccatgatactggtacattatagtaagggatgcgatgattactaaatttgcgaggatatgacagcctgctctattgagatggcaatgaacccaatatggtcgtgatccttattagggcaacgatgatgaacaaagagcaacgatgctatgacatggctgctgctgcctgcataacatgcatgatgggagacgtatagttcagacattacacatacagctactctctgctcaatgtaggcatactctttatgatgattcactctgcagagaaaccaacgcatacgtggaccacagttctgggcatagataggcttagcagacgcatgagaacctgctgaggagcactcgataaataatgtgcgctatactgatgctgtgcatttagtcactggtgttaatagatacaccatatgaccttacatgatatgccacactataggtagaatatgagagcatgccctctcttcagaaatttcagctgttgttcctaacataccttcccctgtcagggagtctccaatccttcaagaagttcctgtgctaccgcatgaagaacctgctattttggcagaatctcctccccctctaaaagacgaatctnctncccctctaaacatgaatctccttcctatataaggatacgtctgcgggta

SEQ ID NO: 57979 - DNA, 138 bp, Triticum aestivum
  Clone ID: PAT_TA_57979
tggcttcgcgacaatcagtaggctcctctctagtcggagcacactcgtaggactacaaattttgttcggaccagtgcgtgtgtagcacacgctcacacgacctggcaaggaacccgtggacgcctactccaacaggag

SEQ ID NO: 57980 - DNA, 353 bp, Triticum aestivum
  Clone ID: PAT_TA_57980
ttcgatcgcgaggttgtcaaaggatgatgctgacatcggcccctacgagcgcctagcatcggagttgctccgcaactccaaggacgagcgtgcccgtcagctcactgagatgatattcaggactcttcgagccgtgccaaggacaaggtcgacgagctccatgcgagtgagtcggtgagtctgcgccgcggctgggcactagatcccttaatatagtatttctgtgaatctggaaccgaaagggtatccatggatcgcgcgtgaccagcagccctgatctaagatcatacacggctctgatgctccgagccagagaagctgcgggtcacaggaataccaacacttctgagcaa

SEQ ID NO: 57981 - DNA, 230 bp, Triticum aestivum
  unsure (1)..(230): unsure at all n locations
  Clone ID: PAT_TA_57981
cccgggtncgaacccactgccgtccgccccacgccgtccgctactgcagatcaccaactcatcggcgcgtccgaggaagaagcaatggcggaggtgaacaacagaaggtgatcctgaagcgctacgtgacggggttcccccttccgagggaaagaaatggaaactcgtccnccccgaaagggcccccccttgggcccctgcccccgccggggggttccgccccccccccg

SEQ ID NO: 57982 - DNA, 273 bp, Triticum aestivum
  Clone ID: PAT_TA_57982
tggctgagcttaccgtgcatacgcacatagctacaagcctgagcctccccatcaccaacgatagcatgctctgcctctacatgatctacacccaggccgctcattgttctctccgatgcgcgctgcctcgatattgttcactctcaggggctaggtcctttgctaccccgtggaagcccgtcttagcaagagctagatcagcagccactcgtctgactactccacgctatgtgaaggcttctgctttgggaagtagccgcttcatcctgcgac

SEQ ID NO: 57983 - DNA, 330 bp, Triticum aestivum
  unsure (1)..(330): unsure at all n locations
  Clone ID: PAT_TA_57983
cccccgggaaccccgacgcgggcgccaagaccaacaagaccaagngcgcccagggccacaccgacgacgccggcgccgaccacaagcaaggaccaaccacgcacggccggaaagcgaggcaaacgcgaaccacggaggggggggccnaccccgcnacaaacaagaacaaggcngcggagagagaggagaacacncggaangaccaccagcggaaccccaacaagcacagacccggaaccaagaggggcagccccgggcggaaaaagccggaggaccgagcagaacacaccgcgcaccagaagaaagccacacgccgcccgaacgggcacg

SEQ ID NO: 57984 - DNA, 429 bp, Triticum aestivum
  Clone ID: PAT_TA_57984
ttaaggcagagttgctgcatgagcaccctaggaagaaactgctacaacctttgccgagctcgtggtgctcataatgtatgcacatacgtttgtaggtgtgaactaacgagtggcgctaagctttcctaaagacttccctaaattggtccttgagtccaactaatatgaaccagacacgcatggagtgctgtagctcggcatgtacgtcttccctatgtgactacatgggcaacgcagctgctgacgatgaagagatgaaactctatgccggaacagagtggtcgatgcttgagttaatttctgtaacactgatgctggcctcacatacattgttgcataatgatgcgtagccatggtctgagatttcagagggcacggtcatgtctcacctttgcggtaatataatagcatcccattgagagtattcaa

SEQ ID NO: 57985 - DNA, 211 bp, Triticum aestivum
  Clone ID: PAT_TA_57985
gaggcgctgcgcaacagctcccgatccccgccgaaagccgcccccgtggcggcgccgggggaggctaagcacgcccctccggccgacgagggcgccgcggcggaggaatctgcccggaagcagtactaccagctgagggaccggaggggcggccgggacggcgcggaggacgcgcacgagcacaagaagctctggaacatggacggggggg

SEQ ID NO: 57986 - DNA, 123 bp, Triticum aestivum
  Clone ID: PAT_TA_57986
ctttggacctgttacacactccagtgaatgatgaagtgcaatgatcaatcacatgggaaatagacattgattcagcttttcatatgtttgcttgtgcttaatttgaaacgatgcaggtttgtg

SEQ ID NO: 57987 - DNA, 624 bp, Triticum aestivum
  Clone ID: PAT_TA_57987
gggtgaatgtgcttatcaacaactatgtgggaatgttacagcggaatttaatgattgctcaacacagattcttgaaatggtgttcctcctctcaaagccaattttttgtcgtggagatcttgccaacttattgaaggatgtgcaagcatgtgagagagataagttgcagctgacagctaggattcaggtgttgaagaaggctggccgtccttcggaacgcctggtaaaccatgagcactgcaggtcaagcagcacgtcccagcatgtgtgtgcaaaccttacggagatcaccgaggacgcagaggcggacgcagagtacgatgccgctctgaaggaggcaatacagggcattcaagaggcagtgactagcataaacgagcatatggaggaagtgcggtacgagatcgacgccctcgaggctgacacggttgacagcaggctgagtgaagtcgaggaagcgttcccggatgctctgttgatagagtagaagagtgctgaagtcttaggccagggaagggtttctatttggggagttagagctgttttcttattggttattttcgcgacaagtgaaattggatagcctgtttctactaacaacaaacaaatttagcgtgctagcta

SEQ ID NO: 57988 - DNA, 451 bp, Triticum aestivum
  unsure (1)..(451): unsure at all n locations
  Clone ID: PAT_TA_57988
caaaaacactaatttcactgcatgcaaggataccttccgtgggcgggtttgcgaatgcccggtcgtcaatggtgtaaagtttggtcggcgatggggtacacccactggtgaagcttctgggntgtttgggnnncccccnnnatatatgggccccccccccacaaaattccaaaccaaaaccccggggaaggggccctttttctttcttggggaaaaaggggggggaaaaaccccccccgggggaaaaccccggcgcggcaaaaaaagatttttctttttttgttttttcccccccggggggggggggcctcccccccgaatataggggggggccccccccccccccccttctttaagagaggggggcgcccttcccccaaaaaataaatgatggtccccccccccccccccccggggggggggggtttttttttcccgggggggggggggg

SEQ ID NO: 57989 - DNA, 453 bp, Triticum aestivum
  Clone ID: PAT_TA_57989
cgaccgtccaagaagcaagatgaaacgggaacggggaagcctggttgcgcgcacaccacacaaatttgacacaaagaataaacacaagatacaaaaatagtacatgaatcattctctctcttttttactgagagggactacagtaatcattcggtgtagatgtactccctccgtccggaaatacttgtcatcaagatgaataaaaaatgatgtatctagatgtattttaattctagatacatccattttaatttattttgataacaagtatttccggatgaagggagtattctttaagggtcttcacttttgttctataatctcttgaagcataaggttagaagttagtctcgtggtctgcggtgggcggccggcgcgatgctaataggccgatgtctagggtgcacttttgtttgatcttggtttctagaggagtttgatcattttgttttg

SEQ ID NO: 57990 - DNA, 412 bp, Triticum aestivum
  unsure (1)..(412): unsure at all n locations
  Clone ID: PAT_TA_57990
cctctcctaacataccttgatgctaaccgatgcagatacacggctcgtgagatgtcaccagctacatggtcgtgcttcacactctacgctcaataacaaatgcctcccatcgagagtattcaaaccagcagagtgacgccggtggtatcgtgtgcgtgatgtacatgaccttgataagaataaagagcctatcaatgtgtggatgccatgcatgaattgttagctgtcctgatggactaccatgactgcatatattatggaactcatgttgtatcaaaccctgccatgatgcanatgatgcaggccgttcgttcttagatgatccaaccatacatacgctggtcagcaagaacctaaatgtacgtataatgaagcaatcaaatacccactggacagaaatgtaccacaatcc

SEQ ID NO: 57991 - DNA, 463 bp, Triticum aestivum
  Clone ID: PAT_TA_57991
gacgatcatgcgatgcttctgcatcagcaacaacaacaacgacaacaacgacaacacgaccatcgagccagggttcctacccgcagcactagcaacaatatctatcatggccagggctccttcgagccatgctagcaaaacccacaggcccagggctctgtccagcctcaacaactgccccagttcgaggaaataaggaacctagctgcgtacagacgctaccagcaacctgcaatgtctacatccctccatatcgctcgaccaccattgcgccattaggcatcttcggtactaactgagaagagaagaactctagtactagatatatcaagacatcgtgttcttagtccatggtttggtcgttgtactggtgaaaatataaagtgacatgcactaccatgtaagaacccgaactatactagttcaaacttgggaataaaagacaaagccaggtcttgtctgc

SEQ ID NO: 57992 - DNA, 467 bp, Triticum aestivum
  Clone ID: PAT_TA_57992
gctagttttgaactgaatatagagcttttggaagtgatccctccagacctgggttatgggaaaaaggggcagggcgagataccggctgatgctagttttgaactgaatatagagcttttggaagtgatccctcctacagaaagctgaccatttttgcttacacatggaaaagactgatgaggtacttgtgaagcttcacaaatttaggagggatgtagacattgcacattgcaggtagggtctgtagcgctaggttccttatttcctcgtactggggcagttgttgaggctggacagagccctgggcctgtgggttttgctgagatggccggaaggagccctggcctaatggatattgatgcagaggctgttggaaggagaccttgctagatggcaggtgtcagcacctatggccgatcccttatcagtccactggcccgctcagccagtatgccctccaggctgtt

SEQ ID NO: 57993 - DNA, 528 bp, Triticum aestivum
  Clone ID: PAT_TA_57993
gaacagacattcttccagcaaccactattgtgacgcatcaacgactattgggctaacaaccatgattgtcgcagcaacgaccatgagtttgggaggaacaacgcaccatgtttctcagcaacaaccacttctaccacagcaaccaccattttcgcaggagcaacaactagtgtctaccgcaacaaccaccattttcacagcaacatcagccagtgttacctccacaacaatgacgcttttccacaacaacaacaacaccaacagctggtgcaacgacaaatgcatgcggatcagacatgcattttgcagcagctaaacccatgcgagctatacctccagcaacagagcagacctgtggtaatgccacaacgtcttgctaggacgcaaatggtgcagccgagcaggtgccatgtgatgcaacaacaatggtgccagcagttgacgcaaatgccccaagaatcccgctatgagggaattcgtgctatcatctactccatcatcctgcgagaacaacaacaggttcagggg

SEQ ID NO: 57994 - DNA, 591 bp, Triticum aestivum
  Clone ID: PAT_TA_57994
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggtcccaggtttcctccccggggcttgcccgggcttactttttttttgggggggggggggtaaatttctggggccccgtttttacacggcctgggacgggaaacccccgggggctcccccctttatccccttgggggcccatccccttttcccccctgggggtattcccaaaaagccccccccggatcgcccttcccaccggggcccccccttgatggggaattgggccccccccttgagggggccttttaccccggggggggggggggttccccccctggggacccttacctttcccagggccctagggcccctttttttggcttttttccttttttttttggccctttttcggggttttccccgttaggttttaaagggggggccccctttagggtcccataatggggtttttgggggccctggccccccaaaaaattggattagggg

SEQ ID NO: 57995 - DNA, 664 bp, Triticum aestivum
  unsure (1)..(664): unsure at all n locations
  Clone ID: PAT_TA_57995
gcgaaagccgtgatcaagaggaagtcaatctgaagcagaactggaaccggggaagtaatctcgcgctctcccagccagcctactgacttggtctctggatcaattactgcctcatgctcgacaactgaaaaatatgcggctcccatcagttgagttcctcggctcgctgacacgtgggccccgaccagacatgagagcggcgtgttctgaaggtcagcttacatgactggcatattttttagacaatgcttatttatcctgccactgttgtttgataagctgatgatgacccacactatatgcatgttgaactggagtgatgttgttgcactattgttaatcagggcaaccaaccatgtagctagaggttagaggagtagtgtaggaccccacccaaaggccatacacgcacgccgcccacgtggattatatccgcagtatcaagtgcagtgcagagtgttggttgccaagccaaccgaaggacanaagtacagtactgaagaagattcaactcattattctatagagagatcgaccttcaatattataatccccctaaagaaaagnggaatngnagttntcctttcctgcctccagggttcagccactacacatgggagttcctgcgtgggcccctttgctatcaaaaatcacaaattcggca

SEQ ID NO: 57996 - DNA, 184 bp, Triticum aestivum
  Clone ID: PAT_TA_57996
cggatcccggtcgaccacgcgtccgctggccacatatggtggaagagcggctgtgagcatgaggttcgggagaagtgctgcaagcagctgagccagatagcaccacaatgtcgttgtgattctatccggttagtgatcctagggaagttgggaggattcttggacatatggccctttgaagcat

SEQ ID NO: 57997 - DNA, 293 bp, Triticum aestivum
  Clone ID: PAT_TA_57997
caattccaaagggtattataatagagatagatagatagataacaaagtactagcagcacctcgagcattcggtgtaaaaaacacacaaacaacatacgcccaacactaacagctcaacggtttctacctagcctgatcccgagggaagggaagggagaaaccgttgagctgttagtgttgatgcgtttgttgttgaatcgaacaaaaaagccgctgtgattcggaattggaattggttggtggaatgctatggtcatcatggttttgaatgaatgaatcctgtgtggtttggg

SEQ ID NO: 57998 - DNA, 422 bp, Triticum aestivum
  Clone ID: PAT_TA_57998
caccgatagtggtgaccatcacaaccagaagacggagtggccagagttgttggggaagtcggtggaggaggccaagaaggtgattttgcaagacaagacagaggcacagatcgtagttctgtcggtggggacagttgtgaccatggaatatcgaatcgaccgtgtccgcctctttgttgacagtctcgacaaaattgcgcaggtcagtaattgccctatcgttcgacctgctgctgctgctgctgtaccctgtgtcgcctttgttcaagtgatgtctcgtttgtgtgaagtcgtactgtgtctgctgctttaatggaccatcgagtcctgtggtttggtgcaaacagttgcaggtacatctgtaccgttaagtatgaataagtcaactttgaagtaatgtgcctgtgctcatttgcctttgc

SEQ ID NO: 57999 - DNA, 428 bp, Triticum aestivum
  Clone ID: PAT_TA_57999
gggccacgccgcggaagacgatctcgcggatgccggtccagaggccgagccaccggcgggagaggacttcggtgcgggcggcggcggcggcgcaggggaggcgggcgaggacgaggaggagcatctcgtcggggagggcgctgatgcggtccggtccgtcgccagggccatctggctcctggctggaactccggcgaggacccgagctcgcctccatcgacgcccggatctcacctctccgacgggagagagtgacacacacaaccctagaattatgggtggggagtggggactgacgcagtacactgaccagtgacgaccagtcgaccactactctgagtaagtagtacgaggttccaccaacaccccttccggtcttttcttattgtttcaagtatataaaacacagaccagcgttgatgtgtggt

SEQ ID NO: 58000 - DNA, 404 bp, Triticum aestivum
  Clone ID: PAT_TA_58000
gtcctaaagagcagccccatcttgtaacaacagcctcaacaccattttaacacaccatcactgcatattctcaacatccaccttatccacaccaccatccacagcatccacatcaacgaatacatggtgtacaaccataccttatgcttcacttaaacccatgcaaggggtcactacaacatcagggctttcatgaggcactgcttccacaacactgctaggtcacatatgtggtgacagcagtagctgccatagaacgcatcgacgatgctagccaacaagctccacaagatcccgaacgatgccgatctgaggcaagccgtgccgtttgctactgcatactactgcgagaacaacaacggggtttttgccgatctcataaccaacaaccccggcatacactc

SEQ ID NO: 58001 - DNA, 385 bp, Triticum aestivum
  unsure (1)..(385): unsure at all n locations
  Clone ID: PAT_TA_58001
gtctcncttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgtctacat

SEQ ID NO: 58002 - DNA, 784 bp, Triticum aestivum
  unsure (1)..(784): unsure at all n locations
  Clone ID: PAT_TA_58002
gggacaagcacaagcatcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggccaatccgtgctatcatctactccatcatcctgcaagaacacaacagggttcaggggtttcatccaatctcagcagcagcaacccccacagttggcccaatgtgnttttcccaccccaacagcagtcgcagcagcaactcggg

SEQ ID NO: 58003 - DNA, 354 bp, Triticum aestivum
  Clone ID: PAT_TA_58003
gttagagaaccattgcgagggcaggcgctactacacgaacagcggatctcatgatgctatgtgccgtacatgaccacactgacatgccatgaacttacactgtcttaaccaggcccgaccagactcagctttagaaatgcgtgctactcacatttaggccctgtggcgttacagtgcgaacctattgaacgcgttcactgaggattaaggcgaccataatctaaagggcaatgtcgattaccttttattgtaagaaccatgtgactgctcgatggatagctatatacgggatgtgtgatggctatcttgcgtgatatgagctagaacgacctacaccggcatcctgtcgttata

SEQ ID NO: 58004 - DNA, 499 bp, Triticum aestivum
  Clone ID: PAT_TA_58004
cagatccgcgtgacggcgtctggagatatgaggacgaaagattacctcttcgtatccggagaccgaagacggattcatcgtgctggcttggctggactgctctctggatggacggccaatgtccacgagagatctcgacaatatgcacatagctttctgtcagtctactttgggtcttacatctgatggctgagcccgcactgtgttacttatccggtgccttctagagtactccttccgctccaactatatgactcatatagtgtgatgtagccaatcgctctctcggcccagaatactactccctacgctcctaactatttgtctttttggacatacacatggcctaccacatacatatggctatagacatctctcaaaatgatcattcactcttcttactccgcatgtacccactggctacgctctatacaaagacctgcttttaagaccggagagagctctattgtatttcacatttgctaaattccgtgggtgt

SEQ ID NO: 58005 - DNA, 635 bp, Triticum aestivum
  Clone ID: PAT_TA_58005
ccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacacctgattccatgcatggatggtgtattgcagcaacacaacatagtgcatggaaaatcacaaggtttggaacaaaatacttaccagctgctgcgagaaatgtggtgtcagcacctatggcagatccctgagcagtcgcagtgccaggccatccacaaaggtgtgcatgctattattctgcgtcaacaacaaaaacaacaacaacaaccatcgagccaggtgtcctttccacaacctctgtgacaatatacattaagccagggctccttccggccatctcagcaaaacccacacgcccagggctctgtccaacctcaacaactgccccagttcgaggaaataaggaacctagccctacagacgctacctgcgat

SEQ ID NO: 58006 - DNA, 308 bp, Triticum aestivum
  unsure (1)..(308): unsure at all n locations
  Clone ID: PAT_TA_58006
gtggtgttctggaagtacaaaacccatgctggggccaatgtatggcattggtacacatcttgctccagcgaactgcgccaaaacttgtgctagctactcagatattgacgaaaatggcatcatgaggatgatgctgtgccgtgtcataatggggaatgttgaggttgtacttcctggatcaaagcaattccagccaactaatggaacatttgatagtggcgtggatgatcttcaaaagccaaagcactatgtcatatgggatgnctaatgtgcantagacacantctatgctggaatatgcctggttg

SEQ ID NO: 58007 - DNA, 553 bp, Triticum aestivum
  Clone ID: PAT_TA_58007
ggcgcagttcggcgccttgcacaccaacggcctatccatactcatacacgccgtcctctagctgcgagctggactccatatgcctcataggcgtgctcgtccatgaatacaccgactggccgtgcgcgcccgtccgtggtcgggtcgatcgaacccagctcgtccgctggacttactttaagatcagagtgtctgcacagactataatgatggccgtgagaacgaggactgcgattcggtggcccagattgagactgtacatgcattgttgccgtagttaaagatccatgctgtaaacggtgttgctgctttatcatactttgatatatgggctatagtggcaatctactgtcagttccagtagcaaattcttaatctatgttattaatggaggacctgacgtgatgagcaacaagctgtggcacattgtagacgtccgtgaggtcgcggatgccttggtgcttgtgtacgagaaggccgaatcggatgggagatacatttgatcgccgaatagagtttgcacaaagggctcggtggactagctgaggaagat

SEQ ID NO: 58008 - DNA, 637 bp, Triticum aestivum
  Clone ID: PAT_TA_58008
gcatctgcccaccatttatcatatgaacaaccaatgatgccacagcgaccatacactctgcgcaacgctaccaactatgtgctaccggatacaaccactatatatagagagaccaccaccgggccaaccggcacaacaatcaccttctgcacaggaacaacactctccaactgcaggtgcgacaccccgtccctgtagaccatgcatccattgtggagcaggtgaacccatgcagggtattgctcacagcaatggagcagccctagcgtgtactgccacaacagtcgtgatatggacgacaaagatgcggcatagcagctgccatgtgatgcaacaacaatgttgccagcagttgccggcgatccctcagcagtaccgatatgaagcaacccgtgctatcatctactccatcattctgtaagaacaacaacaggttcagggctgcatgcaatctcaccagcagcaacctgaacagatggggcaatgtgcttcccaaccccaacagcagtcgcagcagcatctcgggcaacaacctcaacaacaacaagtggcacagggtacctttttgcagccacaccagatagcgtatgttgaggtgatgactcccattgcgctccgtatcctgcaacgatgggca

SEQ ID NO: 58009 - DNA, 214 bp, Triticum aestivum
  Clone ID: PAT_TA_58009
cgggtccaccccgcgtgcggcctcactgtcgatcttggtcgcgactcggccaggcctcgagtttgcatttgtcagaaccgacgacgccccgccgtcccgtgctaccggagtctgcgccccgcgtcgtcgtcgtgaggagatgccgtgccggttaggctaggactaagtggacgcgagacgtcgccctcagctatctccccattccgcgacaacc

SEQ ID NO: 58010 - DNA, 625 bp, Triticum aestivum
  Clone ID: PAT_TA_58010
ccactatctttcacaacaacaacaactgatgtgctcaacaaccatgattttcgcagcaacaaccaccattgtggcagcaacaaccaccattttctcagcaacaaccaattctaccacagcaaccaccattgtcgcaggaacaacaactaggtctaccggaacaaccaccattttcacaggaacaacaaccaggtttacctccacaacaatcacctttttcacagacaacaacaacaccaacagctggtggaacaacaaatccctggtgatcagccatccattttgcagcagcttaacccatgcaagctattcctccagcagcagtgcagccctgtggcaatgccacaacgtcttgctaggtcgcaaatgttgcagcagagcagttgccatgtgatgcaacaacaaagttgccagcagttgccgcaaatcccccagcaatcccgctatgaggcaaaccgtgctatcatctactccatcatcctgcaagaacaacaacaggttcagggttccatccaatctcagcagcagcaaccccaacagttgggccaatgtgttttccaaccccacagcagtcgcagcagcaactcgggcaacaacctcaacaacaacaattggggcagggtac

SEQ ID NO: 58011 - DNA, 537 bp, Triticum aestivum
  Clone ID: PAT_TA_58011
gcttgggatgcttactatctctgagcatctgatgaagctgattgagtggttctgtcagactggtcgctgcgccataactggcggcctgtatgccgatctcccaccgtccttgtccccgccaactatttgaagtgggcttgtcagagaataatgcagatggcaagtgcgatgccatgttacggaggataaatgcaagagcacttgacagcaatttgcagctgatagacaatgcctctttcaaccattgaagaacaagagccatgcaattgatgtccgccgcatctgcctccttttcgctgtcgaagatttcgtatcgttaaatcgtttctgctatttgtgcagtgcttgcttggcaagagactagatttagggataagcgaatggactgattggcttgcatacctgtagtgtccagcttcagtagtggcttttgcttgcttgaacggagtggcaagtaagttttgcagctttacttgtaaccctggaatagtttgcttttgctgatatatgattctagtactatgtatttatggcatt

SEQ ID NO: 58012 - DNA, 425 bp, Triticum aestivum
  unsure (1)..(425): unsure at all n locations
  Clone ID: PAT_TA_58012
gggtattctggacatggcggaggcggcgccggcggataccctggacacggcgggtgcggcggcagcggcggctgcagtcccggagcccaagtatcgggcggaggtccgcaactaagtgccggatgcggcagcgtgcatgcgtagtatagacgtactaccgttgctagttgcacgcacgtagtaactactcgtatgcatggtcaataagaaggtactgcatgtgtatgtatacgtacacattgcacagttatcttgatccaataccaggactccgttctggtcaatggtgttcatgtttacccctgtaagacttgtctttcttgctcaatatgcaggaaactctcgttcaaaaaaaaaaaaaaaaaaaaaaaaaaaaaaaaaaaaaaaaaaaaaaaaaaaaaaaannnnnnnaaggggcaggcggt

SEQ ID NO: 58013 - DNA, 478 bp, Triticum aestivum
  Clone ID: PAT_TA_58013
gcatatattgttcattttatctcaggccctactattcccttctcagccatattgccttctttctctttgtttatctccaggccatgaaattaatcaagatttaatttatagtgtggtcatggtattgctactgattagatctaaatgctgttcctaactagtgctactcatccttgaacaccatatagaagtaaacagtggcagtgaaactccaaaaataataattacttgtgagtagattataaacatcaatctctcagtttgctacagattggcagggattaataaataggacaaggtagtatacacaggaaggttgatcttttggatacatacatacatgtcttagcaagttactagtacctaggatttgattcttggcatgttagatctagtacataccacggatgtcattcacataaacttttacaagctttttgcaattgatctaattagttttgactaacttggggtggtt

SEQ ID NO: 58014 - DNA, 621 bp, Triticum aestivum
  unsure (1)..(621): unsure at all n locations
  Clone ID: PAT_TA_58014
ggcaagactgttgtgtcaccggctcggtctggttcagtggaaaatggcacctaccgtgatgaccaccaccaggcattacctgaggcgcatgcgaatggttcttctgttgagaagctcatacctaagctatcccaggcagattacttcacggagcctagtttagaggagcttgccgccaaagaacgtgctgaatcaggctactgcagtcgggtgagagactttgttgttggacgtcaaggctatggcagcatcaaattcttgggagaaactgatgtaaggggccttgatctggaatcgatcgtggaattcaataaccgtgaggtgattgtgtacaaggacgataacgaaaagcccctggttggtgagggcctgaacaaagctgccgtggtgactcttttgaacatcaagtgtgttaacaggaagacaggcgaggcgtacacggagggtccaagggtagacaagtacaaggagatgctggtgaaaaaggctgaggagcanggcgtggagttcatctcgtttgacgctgcaaagggtgagtggaagttcaaggtgaaggagcgagggtaaacggngcactcagatctgaagagctgtgccggctagtgggccttggtggggcac

SEQ ID NO: 58015 - DNA, 568 bp, Triticum aestivum
  Clone ID: PAT_TA_58015
caacaacaacaacaacaacaacaacaacaacaaccaacaacaacaacaacaactacaacaacaaatccttcaacaaattctgcaacaacaactgattccatgcagggatgtcatcgtcttgcaacaacacaacatagtgcgtgaaatctcacaagtattgcagcaaagtagttaccaagtgttgcaacaattatgttgtcagcagctgtggcagatccccgagcagtcgcggtgtcaagccatccacaatgttgttcatgctattattctgcatcatcatcatcaacaacaacaacaagaagaagaacaacaacaaccgtcgagccaggtctcctaccagcagcctcaacaacaatatccatcaggctagggctccttccagccatctcagcaaaatccataggcccaaggctttgtccaacctcaacatctgccccacctcgaggaaataaggaacctagcgctgcagacgctaccagcaatgtgcaatgtctacatccctccatattgctcgaccaccattgtgccatttggcatcttcggtccacataaagaagattatgcatgg

SEQ ID NO: 58016 - DNA, 482 bp, Triticum aestivum
  Clone ID: PAT_TA_58016
gagtgacagacgagactgagcatatcgcataagctgtgcatatgcgaaacagaaccaccttggcagaggagctatccaacctggccaggcgtgctgtggatatgagcatacactatcattacaggaagctgatgacgctaggatacacgccataggctcaaacaccactgatcatcccactgaacacaatcctactgatgccaggggagggcactcaaagggagacataacaaaccaattgagcatgtcgtggttgacacacataactagatgttgcttagcgaactgactactatgaccgtgagctgcgcgcatgcatgcatgatgccattacagtgctttatacctgatgcatacttggaatgccgcagcctttgaggctgactgagggcctgcctgagctttgatgccatacaagctgatccaagaactactactatcaaagtggcctacggtggtgacctatgccatagatcaagtta

SEQ ID NO: 58017 - DNA, 548 bp, Triticum aestivum
  unsure (1)..(548): unsure at all n locations
  Clone ID: PAT_TA_58017
gatgatcaccggctgcctgatgctcgcactatgagctggtgactgttaaaataagaacaccgtgattaaccaccgatattagcatcgccacagccatgagtggatcgatactcggaggatgtatcgggatcggtaggagtattctctatgatgactgctctctggatggtaatccgtgtcgttcacagcgattaccatgctgaatgcccatggaagcatagcagcatcatgtcttacctgaggacagcaccctatcttctttgttgggcgtacgtggcctcgatgtggatgaggccgacatagatggtacctacgtacttgtcaaacactctcaacgacgttgaggccagaacgtgcgtgatggtcttgagcagggaccccgatgactcactaacactgatctgcgaatgaccactacctganaatggtctaccccagcagcgatcggcgcgtgtgactctatcagcgtgaccaccactacccgccgctacagatggaccgagacgtgattcaaatgcagtccacaatgcgcacagggccagagcacg

SEQ ID NO: 58018 - DNA, 353 bp, Triticum aestivum
  Clone ID: PAT_TA_58018
cacacttctccttgctgcgcattgatgcgtatgcatggaccgcacatttcaccggacccggttactgcatcacctttgcgctcaatagacgcggcttccatcgagagcatacaaaccaccgagtctgtctgcactatatcagccgatttccattccttgttcgaaccataggccgtaatgactgctgccccagagaaacccagaagcgggcgtgcggtttatacgatcccagctgacgcaccctagcatgcgacggcatatgtgttatctgtggtgcctaaactaatagacatgcccgagcatttacaacgtgaggactggcacaacgctgtgcgcacccttattatgcgaca

SEQ ID NO: 58019 - DNA, 498 bp, Triticum aestivum
  unsure (1)..(498): unsure at all n locations
  Clone ID: PAT_TA_58019
cctagggtgctcttgcagcaactcttgccttctacttgcacctgttccagaaccaaccccagtatgagtaaacacaccatcacacccttgaggcccttgcttcccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaatagctctagtactagatatatgaaacaccgttttctcagtccatggtttggtcgttgtagcagtgaaaaaataatgtgacatgcactatcatgtaagaacccgaactatactagttcaaacttgggaataaaagacaaacacaggtcnttgtctac

SEQ ID NO: 58020 - DNA, 376 bp, Triticum aestivum
  Clone ID: PAT_TA_58020
ggctattactggtgatgatatagcctctattcgtgccaataaaatgtcacatatcatagcaagtggcaaataagagtgctgagtgatgatctatgaataaaatcacccttgtataaaaaaaaaaaaaaaaaaaaaaaaaaaaaaaaaaaaaaaaaaaaaaaaaaaaaaaaaaaaaaaaaaaaaaaaaaaaaaaaaaggggcacgcgcacaaaaaaatcaattctaaggtacccaaaaataaaaccactggccacttcaatacaccaccctaaatggaaaaacacggccgagacacaaaacatttgcgttgggaaaaatcctgctttttccaaattatatgaaatagaaaagaagccgacttagcgcccttcccaaa

SEQ ID NO: 58021 - DNA, 692 bp, Triticum aestivum
  unsure (1)..(692): unsure at all n locations
  Clone ID: PAT_TA_58021
ggatgaactaccagcggcggctgtgctcgacatccttcctctctgacgattgcggaggtcgcggcaacgaagacaatggcgccggtgccggaaggatgacccggaggcaaggtatactcccctctctcgtacgtcgagtgctccccctttctctcttgatgcggtggcgaccagggggcaaattgggcagtgtaaaggtacggcgcgagctcggtgacggcaatgacttcttcggcgtccctctccacgtctggtggtttgctcgcatggaacggggcaaagaaagaggtagaagaccaagaaaggagatggaagaaaagaggggagcttgcatactgaatgggatgacggagtagaacttcgctcgaatgtgggatcaattcggagatcatacatgaggagaagaagaggaggagctcaacgctgcagcagagaaataacactagagtatcgccttagatccagcctttggtgatagcgttgtttctagattttcttctctgtttggatgaactgttccttctttcttctttggagctccactgcttanaattaaaaaaaggaaccatgttcagctgttttcacttggagtggagtagggatgcttctactatatcaggagggtcatcccatcattgcgaatctgctctgctgcaaaagatgaaacacatggaaaccagaaagcgtaaagc

SEQ ID NO: 58022 - DNA, 587 bp, Triticum aestivum
  unsure (1)..(587): unsure at all n locations
  Clone ID: PAT_TA_58022
cggacgcgtgggcgcccctctgttctttttgcgtgcggatggccaaggaactgaacagctcacacaaggcatgcctgaggagaagatccaactcaaattgtgctcattgaccatggccattctggcacgtcttcctccactcgtcagctctgctacaagcttgcaggcattgacaaccgtataactgagaggatgacgaaggaagccgctgcgataaacacgaggtctttgacgtatgcctgactgcttgacaagctcaaaggtgagcgtgacaggggcatcaccattgatattgctgtgtggaaattcgacaccaccaagcactcctgcactgttattgatgctactgggcaccgagaattgatcaagaacatgatcaccgggacctcccacgctgactgcgctgtgcttatcattgactccaccactggtggttttgaggctggtatcttcaaggatggccagacccgtgagcacgctctccttgctttcactcttggtgtgaagcanatgatctgctgctgcaacaagatggatgccaccactcccaagtactcgaaggcccgttatgaagaaattgtcaagga

SEQ ID NO: 58023 - DNA, 246 bp, Triticum aestivum
  unsure (1)..(246): unsure at all n locations
  Clone ID: PAT_TA_58023
ggcggttattaatatnaatatcataggggagaaaagcctngaaataaaattagagaaggggatgaaaggatcaacaaaaggagcattgcacatgacaagtatagacagaaaaccagaattaaagtaaaaggnctatgaaagcatacagagatgggagatagaggaggacgnggaggaagattagggggggggaggggaaagaaataaaagtgaatggtgaattgntagaaaaataggagatgaagg

SEQ ID NO: 58024 - DNA, 474 bp, Triticum aestivum
  Clone ID: PAT_TA_58024
aaaacaaaaaaagaaaggggcctttttgttttggccagttaacccccaaaaaatgggggtaaaccaacacaaaaaacggggttttggaaagggattttaaacccatttaacccccccccaaaagggggtttttaattaggaggccaaaaccttaaaaaaaaatagttgggattaagaataaggggcccaaaaaaaaaccccacaaaaaaaggggtaaaaagaaaagagggccttggcccccagggatttaaaattaaggccggcacccttttggcgggaaaaaggaattgccccctcgttcaggggcaattgggggggggggccacccggaagggccccctaccggaagctttttcggttcccagcaaatttttttggggcaaaaaaaaaaacaaaaaaaatttttttttggaaaagggctccttgcaccaaaagggggggggggttcccatttttggaccccccacccggggg

SEQ ID NO: 58025 - DNA, 446 bp, Triticum aestivum
  Clone ID: PAT_TA_58025
gtacgctatagtcgtgccttcgtccactggtacgtgagtgagggcatggaggagggagagttctctgaggctccgtagaggatcttgctgccctgaagaaggactacgaagaagttggtgctgagttcgacgagggtgaggactgtgacgagggcgatgagtactagagcctgcctcctggagctttcccaagggatgctgctgcaatcctatgatctgcccgagtggctgtatctgatatctgtctgattgaacatttgctttgtggcgattgatttacaacctgatgggttggaagaaccttgtatgtttgaacctgacatgcaccttggcttatatgcatgctatctgggtatgtacacctgatgaccgaagagccgcttcgatccctgcctgaccgctgtttggaatgaagggagctctggggcgggcgcttttgaggagcc

SEQ ID NO: 58026 - DNA, 821 bp, Triticum aestivum
  unsure (1)..(821): unsure at all n locations
  Clone ID: PAT_TA_58026
gaaagaccggagagaaacagaagagcagagcgagtagaaatacagacgagcgccgaccgagaagagaatttttttcactttgtggatctgaaatatactacatactagctagattcgttgttgaatttgctcgtcgttgctttgcttccgctgccatggtgaagaaggaggggccgtgctgccactgcggaatcatgggtaagcatctgcatctggtttcttcccttttgtgtttctctgcatctggtttccaaggaagcggatgaaaccccaaatcaaatcttgcccaattcttgtacttcttcttcaagggtttgttgcttattctaatctagttcgagggtttgccgaattctccccaaacgcccgctctcaagcctgtactaatttctcaacattcagacagatccgtgtcactgaaactgaaactgctgcagttattcagagttgacactcgcagcaactaatgtttgtaggtaggacagcaccttgctaacagttattcagagactgtcatctgaaactactgtatgcagtatgttactgatacagttattcagagactgtcatctgaaactactgtctgcagtatgttactgatacagttattcagagactgtcatctgaaactactgtctgtagtatgttactgatacagttattcaggtactgtcatctgaaactactgtctgtagtatgttactgatacagtttcagatactgtcatcatcatctgtatgcacattgctaacagtagctactaacagttatcccgcagcaactaatggtttgtaggacaacacantctgaaatgctgaatg

SEQ ID NO: 58027 - DNA, 402 bp, Triticum aestivum
  unsure (1)..(402): unsure at all n locations
  Clone ID: PAT_TA_58027
cggacgcgtgggcgggcagcagcaaaggctgtctgctacaaggagatacccgtgaacgtgaagatgcgacgaccttagcgaacagccagtaacattttgtgatggggtcacttgcgtttgctttttgtggagtagaatatcatgtttgttgtatgattgtagaggtctgttgcttgcccgcataaaatgtagtatcatgttattttgccatactcgcgatggactctacagcggccccttttgttctagaactgataatagccatttgtcgtggacatgtctgaatgacagtgccaattccaacagttatttttttcttccaattccaacagctgacaattggtactggtattttgctaanaaaaaaaaaaaaaaaaaaaaaaaaannnnnnnannnannaa

SEQ ID NO: 58028 - DNA, 678 bp, Triticum aestivum
  Clone ID: PAT_TA_58028
ggcaagctctgtttgactgaatccatccatgcgtgaatttgtgattttccatggcctcctggccgaaccgaacaggaggaagttggattggacggccaccgccagaacctgggaaagcgtagaaggaacgaaagatccgcaaccgttagcccgacttgaaatcgatcaacggactgcttgccatgcatcaggcacaagaacaagatgatgctggtgccaccggactggctgtctgactctgaagaaactgaaaatgattgtgcgccggcggagatgcgaacctgaagggtgtcatcgactcaggctgattcacccaccacttcggggaagctggcggcgtcgtgcaggcccagtctggcagtgtgctgtgcagctgccgatccagtatatgttgtaaccggaccatttttaccgcttgatcatccatccatgtcgttgttcatcctaggaccccagcttgcatgctgaattgtttgcatattactagtacttaattactcccactatgcagtaaggggtcattccattctgatcacacatgccataggatcgggcagtttttcggactttctcttggtgccggttccataggaccaaggaatatattttttttcccctgtaaaagaacagcgactgaagtcttgttaagcagcatcttaagctccctggacttctcct

SEQ ID NO: 58029 - DNA, 314 bp, Triticum aestivum
  Clone ID: PAT_TA_58029
gtgcggatgaagctcgccgacgcccgggccgccgtcgaggagaagctgcgggaggtcgccgacgccgggcagcgtgctgccgatgccaccgccgctgccgaaggctgcagctgcaggagcggcagcccgatcggcggcaaggcaagcccggccagtgttgggcagcaaagcccagcgagcagtcggcacggccaacaaagcccggcgagcggtcagcactcccaatcgcaccggcgagaagtcactggcggcgagaaccctcacatcaggagggggatcaaggggtccgtggagttcccgagggccgtccgtgt

SEQ ID NO: 58030 - DNA, 670 bp, Triticum aestivum
  unsure (1)..(670): unsure at all n locations
  Clone ID: PAT_TA_58030
ggtcggtcgtgatcgatggacgtggacgcggcgccggcgctgaagaggaaggacgcgccggaggtttgggtggacgatgacgtcggccctgggttccccgtcgcctcccgcgccaccaagatccgccgcctgaacgcggatgtgctgcctgtcgtgcccggcgcggtcgtgcccccgccgcagacgctcccacagacgcagccggtggcgggcttcggggtggtggaggaggcgccgatgtgcggcgacgtgccggtggacgtggcgccgccggaggtggcggccaacgaggagagggcgatcgtcttgtaccggcccgcggacgccgagcgcaggctcctgctgggcccgctccggcccggcggccatctccgcgtcagccccgagtggatccaagcgctcaacggcacgacgctgcaagaggcgagcaaccgccgcgcgctgttcgaggggctcgccggaacggagacctcgaacatggcgatggtcccctgggcgccgccccgcgcgcagngcggcgtccacggcggcggagatgatggaggccgaggacggcgagggcgcgtcatgggagtcgagcaggacagggtcgaccagcagctttcatgccccagtggccgccgcagcagcagcagcagcactacaactacatggtgcagcagcagccgat

SEQ ID NO: 58031 - DNA, 631 bp, Triticum aestivum
  Clone ID: PAT_TA_58031
aaaatagcaactttcttggatatagttaatcaactcagttaaggatgattcacaatctggttcaagatagtcacttgaactgaaacagcatcagccaaggagtatctggttctcagcaatttcattcttcattttagatagggctatggctggcaagctacttgttttcctggttcagactcagctaaagtacactcaataactaaacttgattgtgaggtttcttatctcaactgttctacatatttaaaaaaaaaatcttccttgctcgtattgaacaaaatatgtctttgcataaacagtgatacataaaacaaaaggcacattccattttatattttcttgtaattatgtgtatcagctcgtgccattgacgacgcctaacattaagatttggagaaagcggtggctcagttaggctaatagagcattgttggactgtgacctgttttgcccctttaatcactcattttaacttgcgtcttgcaggacatgaagtacgaatcggttgagtcagtgtacaacacaaagcatgccgtaccacggagagaatcaccatggaaggtggatgtggaatcgtcaggagatcctgcaaagcttcggcagcttgagcaggagttaattaatctgg

SEQ ID NO: 58032 - DNA, 481 bp, Triticum aestivum
  Clone ID: PAT_TA_58032
aggagtagctcccaggcatgttgatggacaaagagactgacggcgcactgacgtcttctctgcttagaggccatgcgagcagtccgtagacgcactgactattatttattcgatgtaaagcttactaacagaccattttatcgctatatccttatagaatgaggatacgtactgttgccacgaacctgagtaccgacgtggcttctgcaatgaagaccactgcctcaaggcccaaaagatgacaaccaatcactcgagacgaaatatgttaggcctgtcatccacgccatgtggtccaaaacattaaattacttacaggagttgcgcaccgctgacgggtgaagggaaaacatcttttcttttgttcaaaggcctcatggcatggcaaagcacttggttgtgaacccattttgcattacctggagaggcatgctgtttttatagagagggacacaagcagttccacaggctcttctaggtt

SEQ ID NO: 58033 - DNA, 622 bp, Triticum aestivum
  Clone ID: PAT_TA_58033
cacgcaggcgctaccaatctgcataacactgttgagcacctagaaaatgacggtgtactacttgcttagctagagcatggcgtggacctttacatgtggccgtcagtgtcgagcgcaaaccagaagcatcatcaaccaggcgacaccaatgcctaaggtgtgaggaaaggggttatggaacggcggaaccacggaagggcatctagagagacagatacacagagaacagctcttggtggtggcaacggtgcattgaaccttacgcataggtgattgagcgaataaaccacaatgtgtttgagaattacatgatgaaccaccatgtggctcttcaatacgcgtccatgggaacgtaaatgacatccatccagcgggacaacatagacaacagatgcaggagacattgctagagctgacagttgactgcatcgagaagaaataactatgcttctgcaaggaagagattaggtataactgatttgaggactaatcaactagctctaatgcaggaagataatgagctgcggatatggcatgtgcggacactaagacctgatgcatcaaagctcggtgtgcacaactcttcttacatgacatgtgtgggtacaacttatccgagctt

SEQ ID NO: 58034 - DNA, 499 bp, Triticum aestivum
  unsure (1)..(499): unsure at all n locations
  Clone ID: PAT_TA_58034
aaccaccgccccagggggggcagctnggaaaccacaacccgcgacactggaggacccccaagccagccaacggcgcccaaccgcgcgctaaccaacaccccacaacagggggcggggcgagcaagacagcacaaccgnggcaagcgaaannggaaanccganaaagagggggnaacagagaacccgncccaaggaaccagccccgcacaaggatggcgacccaagcgcgcgaaccacacccgggcancagggggagcgccaggcccagangagaagaagagcgcgacacccgcacaagaggagccaaacnaaccnacgcgagcacgcgacaacacaaccccacgaaagcgacagcnaaangaacaacccagcccgnggngaaacaacggcgacacggagaaaaccagggcgcaacccaacgaaaaagaccagcagcacaancaacgnncggcagccgccggaaaagcaaagagggccgaaccgancggccaccccaaca

SEQ ID NO: 58035 - DNA, 657 bp, Triticum aestivum
  unsure (1)..(657): unsure at all n locations
  Clone ID: PAT_TA_58035
gacgaagagcagaggtgagggtcagatatctgaggggtcggaggagcagatacgggagctgagcaggtcgtgctccaggggaggacgcggcggtggcggcgggtcgggttccgagaaggaggacatccagccgcgcagcctcaccggcgagaagccccgctactcgaacaagcacggcaggttccaccagatcaccggcgaccagtgccaccacctccgcaagcgacatggatgtcaccctcgtcaacattacccgggtaaagcatccgcgccgcacatacagatagttttgtagcatcatgcaacgggacggattggtgctggacctaagcgcctaagccaatgtgtgtgtttcgtcgtgcgtgcatgcatgcagggctcgatgacggcgctgaggtacaccacccggtcgaccaggatctacatcgtcgtggaggggcgcgacggctacttcgagatggcgtgcccgcacgtctccgcttcggccgttctgaacgccgggagcacgagcaggagcgcgagcgcgaacacggacacggcaggagaagcgaggagcgcgggcaggagcacggcaggaggagcgagggaggaggagcacggncacggcggcgagcaggagaaatcgaggggctacaggcagggtgagggcccagatca

SEQ ID NO: 58036 - DNA, 603 bp, Triticum aestivum
  Clone ID: PAT_TA_58036
ccaattccggcgaacccctcccaccggcgacgactaggacgaggcaccgccggcaatcatgtgcggcggcgcgatcctcaagggcctcaaggtccccgcgccggcgcggaaggtgacggcggctgtgctgtggcccgagaagaacaagcccaagcgggccgacggcggcgcccggcgcctcgcggggctcggccggcgtggggggctcgggctggacgacggcgaggcggacttcgaggccgacttcgaggagttcgaggccgactccggggactccggccaggagctcgggcgcggcggggtggctgagaaggacggcgacgacgaggtcgtcgagaccaagcccttcgccgccgtcaagaggtccctctcccaagatgacttaagcaccatgaccactgctggttttgatggtcctgcacaaaggtcagtaaaaaggaagagaaagaacgaattcaggggtatccgccagcgcccctggggtaagtgggctgctgaaatcagagatcctagcaagggtgtccgtgtttggcttggtaccttcaacagtgctgaagaagctgcaagagcttatgatgttgaagcacgaaggatccgtggcaa

SEQ ID NO: 58037 - DNA, 422 bp, Triticum aestivum
  Clone ID: PAT_TA_58037
atgagaagccgattgtcgaaaactcgacgattaaagcattgcttccaaacaaactagctcgaacacgggaacatacagaattacactctacattacaatgtgccctgtacccatgtggcaaggattgccgaggtatccaaccagcatagattcagcttgagtgcatcggcttttcccgggtaacagctggagggcgatgctttaaatcaggcacgataatgggcacaagcggtagtctggcctcctggtcaggcaggcctgattgtaagttcatttctcgctgcacacgtaaaaacaatttagccggcattgtgggaaccctttctaatatgcacggagaggttatcaggatgaacttctatttcaaggagataggcaccccactactgctatggaatgagattgccaacatcctggcgtat

SEQ ID NO: 58038 - DNA, 644 bp, Triticum aestivum
  Clone ID: PAT_TA_58038
accgtgtcttaagcgtcccgtgcaaagctggacgctgagaagctttagacggacacgccactcgccgggcagggagtagctctcgcccctaaatgtattataacagtcgtaacggtagggggctggacatatagtagcacgagagcgctaaagatgctattattgagtacaactctcatatgttatcctgtgcgctggagactctgctcataagcattaagcaacgctcattaatagaaggtctttccttgggccaaattattgcctgcaggttacatctctagattggagaaactcattatgaatgacatgtgtggattgcttgttgctcctatttgcaacggtggtcgccctgtacatgcacacacttgaattctgctatgatgcagagcacgtgaattgctttctactggaggcagcactgagataagacgctacagggtcctcactttcctccagaatctaagggaaaaacgctgctgttatctagcattaccttcctcaagggatacatcccttttcttgtctgaaggagttacgagaagttgggtgtcgagaaattctgccaatgtccaaggagggtaattgcggattgtctgacaccctagagatgaattttagccgcgctgagatagatgatctaa

SEQ ID NO: 58039 - DNA, 565 bp, Triticum aestivum
  Clone ID: PAT_TA_58039
cagagctgattgagtgacacatgacaggagattgagtgatagaagcctacggcgaacgcgcgctacgtgattcgcgaaggaaatggcgaccatgaaagccaaggtcaaggacgccatcttcttcgacaagggcggcatcgatatggcgaaggtcaccgccggcgagaaggtaaagaaggccacgaccacggaccccctgaacaagcacgaggcggacgagaaaaaggaggaccgcctgtacaaggtccacttcaaccagcgcgatgagaagggggaccactccgactacagggacgggaggggccccctcatcaccggggcctaaatagcttctgggtagatggtccactgactgcctgtactagtagtaaagctagggaactcggttgcgcacgaaatcaagaatgaaaataaggcgaaccccgtgatacaaagaaggttgattaaagccttcatcttctacacttataaaactgatctttcgaaaaatgccacccggctctatgatcctctaggaacatatatacttaaacaatccttctctcatggagacgccccaagggga

SEQ ID NO: 58040 - DNA, 469 bp, Triticum aestivum
  Clone ID: PAT_TA_58040
gctagacgaagcggctactcagatacttgggaagacgtggaatatctcagcgacgatttccgcaggctccgacttggggtcaagtcggttctgaagaaggacggggtgtcaacgacctgacgagggaaccagcagcaacccaagacacggagacgggaagcacacgacccatacggcccagaagagagagacggcccaaccacaagttcagcgggccgcagtgggtctcatatatgttcgagcccaaggctgtgtgagtacttagtcacacctgttgttgttgagtagggtccaggggatcaggactgaacccggcggcggcggcgtgtatgtgttgcgtgtgtgtctggagagctcgtcttccgcctctagctgtgtacctccatcgctacaattcgccttagatcgagagtaatatcagagtgggttgctatcaaaccagaagaaggatcattgtcgtgaccctgac

SEQ ID NO: 58041 - DNA, 836 bp, Triticum aestivum
  Clone ID: PAT_TA_58041
gatccctatgcacgtatgacgaacgtcgcgtagcaagaggccttatcttggcgactgtgctagcgtggaatgaggacgtactaccgaagacatgaccccactcttactcagatactactctatagctggaaagacatcggcgaagaaactacactggccccacgcgctcgtgctgcggctcgtggtgctgagggtcccccagccaatcatcggtgtagagcccttggtgccgctgaaaagggactcgtccttggatgttcttacaacatcacacttggagaagcatctagacggttgatgattgggcaggcaaggcacatacagaatgcgacatagcttggtctacctgatgaacaagctctgcgcttaggctctacgagagagagggctggtatagaatgggagcagaagactgcatgaccagggactcttaaccttgaccaacaaggcactctattttgaggccattggactggcaggtatgaagaaaccattgaggcttgaccttacagatcataattcaaagattgaaaaagcaaaggttggaccatttgggtccaggttatttgactctgctgtatctgtttcatctggttcagtgtcaaatgagtggacattagagtttgttgattttggtggagagatgagacgagatgtatggcttgcgttcatcaatgaaattatttctgtttataagttcattcgtgaatatggaccaagcgatgatgatccaaccattcatcatgtatatggtgcccgcagaggcaagaaaagagctgttagtagtgcaacaaacagtattgcagggcttcagtctctgcattcatacgtagata

SEQ ID NO: 58042 - DNA, 492 bp, Triticum aestivum
  Clone ID: PAT_TA_58042
atgcggcgtccgtctacttatgaggataaggaccggctggccaaagagcgagcgggggaccgactggacatatgcgtggagaagggcgtgtaagggtgcagccggatactgctgcgcccaccggacgggcaaagagtgagcgtgcgggcgtaccacgtgaccgaccagggacgcgtcctctgtgcgacgagcacacgtatcgcgttattgtgccatgcatgaccatcactcctcagcatgttaggcgtacattaactataactgctagatggagtccagcccagccttcggtttcaagtgttttttactagcaccttactgtctaacgtagatgtatagctgtgcagcgtccgcttacgcacgaatatcatgatgtgtatcttgcgagtttcaaagcctgattgttagctaccacgcttactgttctagggtggcgatgcgttgcgatccttagtttggtgaatccgtaaatgctctactgctttgttttag

SEQ ID NO: 58043 - DNA, 616 bp, Triticum aestivum
  Clone ID: PAT_TA_58043
aggccggggacgatgtcagggacacgcgcgacgcccggaaggcggaggtgaagctcgtggattcggcggtggaccggcgaagcaaggacgaccttacttgcgtcgactcgcgcatccactgacctgcaacgatgctaggagcatctccaacgggcgcaagaacactccgcgcccaatgaacattatagagcgtcactgtagcgtttttaatgcgccgagactaactttgctttagcaggcgctcaaaaacactcgtctaataagcagaccgtgcaaattgtgaagcgcgcgcaaccggcgctcagatatgctgcccgtgatagcggtttccaacgcgcgcccacaagctatcatgcgttcttcaacgcgcgcccaaaagcttttagcgcaacaacttctgctggagctgtccggtgttaaaaaatatattcttagtgcgcgtagctctttttgtgcttttgttgaagatgctctaaccgtcatgtaggagtatttgttgggagactgttgatgactctgatgtccggcgcgtaggaacagattgtacaagggaggtgagctgaagtgattgctgtaaacttctcgcacaaaggaagtgcactggactgtacgatgt

SEQ ID NO: 58044 - DNA, 469 bp, Triticum aestivum
  Clone ID: PAT_TA_58044
aggacgcgtgggcggacgcgtggggttcggttcgggttcggtatcgagagagaggccgagtagctagcctagtctagggtttcggtagagaggaagggagatccatggcggagactgagtaccgctgcttcgtgggcggcctcgcctgggccaccgacgacaacaacctcccttcttcaccccttccccatccccctcgccttgctctacgccggcgatcatatagcctactcctcctccttcgccttccttttctttctatttcccttccccccaggaccttgctccgtacccttctcccgtccatgacggcggcggtggttggagtgaccagggacgatgaacttacggatacggcgccgtcgatgaccggcgccgccgcttcgtcacctacgtcctctgcgccgccgtggcgctcgcgtttctctctctcatccttctctttgcctcgatcgtcggccgttttccg

SEQ ID NO: 58045 - DNA, 532 bp, Triticum aestivum
  Clone ID: PAT_TA_58045
cccacgcgtccgctccatcggcacctggttcttcatccacacgcatcatttcgccagatttgctgccggcgaaggtggccgggtgagtgcgtgaacgcgtttgatgcggtcttcagggtgcagatgctcgcccacctcggcgagtccggcagcgaggccatcaggaggtccggcgactagcgacggtgatggatgtgctggaggttggtggcgttgagggggcagtaaggaagctcacggagaagggtgtggatttcctagatgagttcgtgcaatggataatggtcggatctgaggagcggggcagagacttgcactgcggctatgcttcatgagagctatggggttatgtagacaaatgtgagatcgtgccataagcaaatgacatcaagatctgagcaccgttgcagacggcctcgagttattttcctcttcatctcctacaaaatgttgcttgcatggtcaatttgggcatcggtttgttaagcagcaaaagctcgcatgttgaatctagtcaactcaagtgttgaga

SEQ ID NO: 58046 - DNA, 525 bp, Triticum aestivum
  unsure (1)..(525): unsure at all n locations
  Clone ID: PAT_TA_58046
ggcacttgctgacgatgcctcctccnacatgctgcaagagtcccaattggagctgccctgggtgttgcagctgccagctgtacatttggggcactagcttgcttctggagaactcagcagaagaacagaaagtactcgtaccgtttacactctttaaagaaaatatgattagacaattttaggcaaagaaagaactggaactgaaaaacagcccaccagttgctcactgtgcacttcatcagaggtggcctccgtgaatgtatatttcttggatgggttaaaaatcttggtaagtagctcacagagagtgcacagaatccaatggtggagctgtcatttacagatgaaatacttacagaagcatgatgacctaacctgcaccttggtataggctcaaatgtagttctgtttttaccatataattgtgatctgattgctggacatggatgagctgttgctgcccatttgatccgtaaaattttgaactcaatggtaatcctgaagtattgcgacttttatcgggng

SEQ ID NO: 58047 - DNA, 630 bp, Triticum aestivum
  Clone ID: PAT_TA_58047
gccgtgcctgtcacgtagaagaaccgtgtacaagggtgacaccaacaccattgaagcggtagcatactgcgactaaacccgttagcgacgatgcaggagcatcaagcattgctgctgatctgagctacggctaagcgtgcctggccatacatctaatgaactctcgataataccctgcatctgccgacccacgctaaagctatcactgattgcaacatatacctacgtaattctattgaaaggacaaataaccgcttatcaaacagttgttttatcttcttcggctgagacactgtcagtctgacgcattactcttatttaaatatacgatacggtacacttgttacacttcctagatgcacaatatttttatttttttgttgtaaattccttatgattattgatcacatctggggagaagaaaatgtgaatatttgcaaaaaattctttgtagttgaataatcataacataacatacaagattactatcttggaagcatatcactatttctgtgatagcataatccataagaaacctcttttaaataagactgtcaaataatcctctatagaaaatatatcgtaatgagaacatatgctcacatgaattacataacaatcgagagctat

SEQ ID NO: 58048 - DNA, 401 bp, Triticum aestivum
  Clone ID: PAT_TA_58048
agctcgtcaggaggatgaactaggtttatcatcgatgatcccttgtattcggaagatgttttgtttgttaagcctgctttacattaggaagtggatggtggatgcagttttgatatttcggaaccatgacgcatgtttggaagaatctgactctgtatgtggaggttttgagaccgtgtttaatgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggaccaaattttacttcccggggcttgcaaggaaaaattttttttttggggccccca

SEQ ID NO: 58049 - DNA, 600 bp, Triticum aestivum
  Clone ID: PAT_TA_58049
gtgagtgcaagcagccagcgtacatatgcccggcggatgactggatggacagctagcaccatacatgctcacgtgcttgatgtagattcactacttaattttcttagttcatatttgtgtgtggggacctcctcttacaggtaaggagctatgaagaagcatactcccttgtgaagaccttacatacagggctggctaccaagctgaaagccttattatggagggaaacaagaaggggctctaccttatacttcttaatgtgacccgagtgcatcttgatcttgacactgcaggaagactgatgaatgggctgatcaccccaaacatctttatgcttaccatgaaggaggaagaattttccaactactacgacgacccgcctgcagcgctcatttagattcttcactgtcatagggctggtatcccattcacctcactcattgcgaagggccattactcaagcgcacacattgcacctgggacacgattatgaaactaatgcgccttatttaaatgaggataaacctgtaactgacagccgttcactggtgcagaacaatggtgcagatacttcatcgaaaccacctgctcatatagctg

SEQ ID NO: 58050 - DNA, 525 bp, Triticum aestivum
  Clone ID: PAT_TA_58050
gagagcttcaaggtgaccgaccgcggaacttagtggcggaccggcttattcaatgtcacgagacccttgggggcgcaagcgcccctaacgtgggtaggggctgacgcggttcgcaagcagcggatgctaagcttggattctgacttataggcaacgagtcataatccggcacacgggcagctttacgccactggttttctcaccaacctcgatgaccaatcgcgtgaatcaccgggtcctctggcactacgttgatttactatggcaagactggcatgagtagggcaaaactaacctgactaacgacggcataaccccagttcactttgactattggaggatgaacaatgcctcactcggtgacatctgcttgaccgtgatacgaggagccgacttagaaggaacagacagcaacgacactatgaacgcttggctggcacacgccggctatccctgtggcaacttttatgacagctcttacttcgaactccaaagatctagaggatcgataggccacgctttcac

SEQ ID NO: 58051 - DNA, 628 bp, Triticum aestivum
  Clone ID: PAT_TA_58051
caaccctagtagatcaaataatgcagtctgctgcgttgcaggtttgacagtattgtagatagtttgtgtcgagctaaatagcgagtacagtccggatgaagcaggtacatagacttcacgctagatcatgtgtatagataagctggctgtaagtgttcatggcaaaccctgtaaatgcttgttaggctgcagcatgatccgagttttctgaaggcttgatgattctgccgccaaaaaaccctggaaagggaggatggtctgtgactgtgaacaagaagaatctatctgatgctggaaactgcatgctgtttaaccgggttcagattattctttttcaagggttaagcgaaaaagaaacatctatggctgtagaggcatgtctcagtcatggctgtataaagaacacgacctctatttgatttgatttgatagcagcctaactagccggtggtttccatgccacttataaatgttggagtataatgttcggccctcttctatagtttagacttttggagcaactggctggtgcatgaatttaataacaaatgcacatgttttttaaaaaaaaaaaaggccataccgattggcctttccaatatttttggcaccctgaaaggggaatggg

SEQ ID NO: 58052 - DNA, 568 bp, Triticum aestivum
  unsure (1)..(568): unsure at all n locations
  Clone ID: PAT_TA_58052
gcagctgtagcgagcgatacctaacccgcgtctcccccacgacccccgcctcctctcctgccgccgccgcgccctccccacccgcacgcgtcccatcctcctcctcgacctccctcgctgcctctccttctcttcctcctctctctcctgtgccgccgtcctgccccatccacccatgctgcactccgacggcgacgatgacctgtaagcgaagggcgacgacgcagaggagagggaggtgcggcagcatacgggagagggtcaccagctagcgtcggcctgtgctggtgaggtcgggctccaccgttcctgtccctcgtcctcacgcggcctctcttggtcaccggcgctgcagttgcgcggggcgtgagaatagcaaggagatgttggccctcgtccaggaacgcggcgtccatggccgctcctctcctcccgatttgcctcctcttctttgtgcgcgccggccgctgcagctcctcgcgccgcctccgtccatcccacctctcttgttttcctcctctctcagatcgggcgcccttcgctcgccgtggntccagatcgggcggat

SEQ ID NO: 58053 - DNA, 678 bp, Triticum aestivum
  Clone ID: PAT_TA_58053
gaaggggcactcgagcggaggaggaggagaccaggcgattcgtgttgttcatgtcgattctgagaccctcctccccccacctgtcgagtttgatttctctcccccttcctcttcgattcatgacgtcttcggttggtcggcctcgtcattctccctcccgcgcatgatttttgattgtttctgggtgtgtggctttccagatctaggtgaattgctgccgtgatttctttgtgggttcgtgattggtgtttgtagccgccgtgttgttgtagattcgtggtaggtgcttgtagttttagcggttggctctgcttcctggcatgcgtaatcctccattgttccccatctactcttgtgtaggcgctggtagttgtctcgattttttgttagatgtagatgtatggattagatgcagggtttcagatgagtgtttttgtggttagagtttggtgacttgcgctggcaggtggtctttatgttcatggatcctgttggttttttgttgtagatacatgaattttggtaggtttagttgtagttagttgttaccagtggcctctactgcatgcagtgcacagggtccatgacttctgagtgttatcaatggcctctgggtgtatcagacttaccccagcctccagttagctctgtttttggtgtattttccaggttatattt

SEQ ID NO: 58054 - DNA, 617 bp, Triticum aestivum
  Clone ID: PAT_TA_58054
gtcaccgacatggaggggagcaacatggacggggccccgagaatgggcgccgagcttcagcgccatgatggatctccggggatgaagcggcggggcagcctcgtggcttcaaggcgcctcaggctctggcgcgagactggaattcgacagcggaccactcgaagtaacgtgaggccccgttgcgtgcgacccgacagaatgagccctggcgtcgaccaacacctgagaaactacggacgcctcatcatagaagtgaaccacggccaccaaggcgtgcctacactgacggtcgcagacgcaggatcattcatatgtcacggcgaagcggaggatgcttagagacgaagccttgactttgggatctagcccactcgggattaatatcgaagcgtggctttaacggggtccatcatgcacctggccaacaccgacggccggaggaagctggtcatcgccaagattctccacaccatctccgtccccggcaagttccagtatttctcggccaagcctctcctcgctagtttgagcatacgcgtgctcacagcgtcgttaaagacctctgatgagcggatgtttattctcttgggcagccgactaggcaaggaggaggagga

SEQ ID NO: 58055 - DNA, 530 bp, Triticum aestivum
  Clone ID: PAT_TA_58055
gtatgacattgatgacaccttcacgcattcatgagcaacctcgcttttgactggatgcaggggagctctcacatgaggcgctacatcaagaacctctctgtcaagtctggaaggggatgacctagatgttttcaagaagaatggtgagactgccacatagtatcgtcttagcatgctcactgaccttcagtatgtttgctggcgagagcatgcattgaggacggagggggggcgatcggctactacagggagggagctgctgatccaactttcctgcactttggacatgggctgatagaggacaagcgctaatcgcactgaatgctaagatctatgcgggcgacaggatttctgctctggtctatggatgtcagacgactcttccatgtagggtcggaaactatcacatgtagagggtcttgaatactctctgataattgagggatatgctttgtagtggtaatcgggataatggtgcggttaatgcttgtgaatcataaccagtttgctgtgaagaggaaagctgttgg

SEQ ID NO: 58056 - DNA, 279 bp, Triticum aestivum
  unsure (1)..(279): unsure at all n locations
  Clone ID: PAT_TA_58056
gagaggtcgcgcccagctatctcttcctggccagcgagcacgactcctactacatgtacggagcagatcctccaccccaagatggtaccatacgacaatagctaaactcgagatggagaagctctgcgaataagagagtgaagtgtgcccgcggtgcgtggcctgtactaccaagtgtggcgcgcttagtcctcgagtgacagctggaagaagctcggtacgggcttctggcgctatacccacttgtaagtgtcgaccgctgtgtagtgntgatccctg

SEQ ID NO: 58057 - DNA, 483 bp, Triticum aestivum
  Clone ID: PAT_TA_58057
gccacctttcaagcccccggcgacgccggggctagacctcgccgacgctccagcccacgggtcgcggctccccggccgccggcgccggattcgcctactacgacgacgggtgaagacagtgaaccctcggataaagcgcttcgcataggccgagccccctcggtgttggctcggacccaggccgttgggggggtggtcaaaaccctagagtacggcgagccacgcgcggcgcgatggagcggaccgcggacttcgcgaggcccatataaggaggaatcctctgccgcctgaggatactgaaaaaccgcacttacgctctaggggatgcgcggacgccggcacgaggacaaagagacgcatggagggttttgacgatgaaaaggaagaatacatttaggacgaggaagaggacgaggagagggcgacggggatggacaaggatgatgtttaggagcaggacgaggattaggatgaggaggagga

SEQ ID NO: 58058 - DNA, 666 bp, Triticum aestivum
  Clone ID: PAT_TA_58058
cagacccgaaaaccaaatcatctgagttacagggttttacccgttcctctcctccgccatcccccgtccggccccggcgagcgctcgggcggcgaggcccccctccgtcccgccggcagtctttgcccattgggctccaaaggccaagaaatggtgttccggaagaagtccgagggaggatccgtcgtgcggcgacctcgcaagccacgggacacgactctggctccggtgaagcgctccgcgaggttaaagaaaaagcagatgtatgctcttgatctgctcgccacagttgcagaatccttgtcctcagatgaggatgattattccaccgaaagcgaccaagatggagcggaagcaagtcataattcatacagaatagctgttaaatcagaacaatttgatgaagccccgcagctcaatagcacagcattggagaatgattgctccagaggatatacagtgggctgtgatggtatctgtgcctctcttggacaaactagcatacgcaagacagaggacttatcgacccagaatgttgctgatacagtagaggggtcactgatagaaaaggcagatgcagacaacttattgacccaaaacattgctgatgcagcagcagagccactgatagaaaagaagccagatgtgtttgctgaaggctcattg

SEQ ID NO: 58059 - DNA, 727 bp, Triticum aestivum
  unsure (1)..(727): unsure at all n locations
  Clone ID: PAT_TA_58059
attctttccaaattttatgaatttattagaagtacatatttcctattcctgacattactttgatttttataagatgtaatgctaaaattgcatggaaaagtctacaccgtgcgcaattttctcgacgatcaccgctttgtgaaaacagggttgtacaggaggacaatctttgtgaagttcagcttggccagactccacctttatttcttttagaatgttggatgattgaaactagaacactgattcgatgcaataaagctccctttaacccattaataaatggaatagttgttgagcttattttcggaccataatttgacatatagctcttctgaaataaaccctccatttcctactatacttgctactatacatgtgtctaagagaataatacagttcggtagtgctgcattgccacattttatgtctccgatatagctggtaacttgcacactatgtaacgtttacttctttctggcagtacattactaaaatcgataatatgtgtactatcaaccagatcttgcttgacttagtatgtagctctatccttgacatagcattggttctctatgctttctctacaattgaagatgttcttgctagaagcaatctaaaagaagaaccaattcattgtatgtgttgaaaactcaacattaattccttcatttggctcatgnttatgttctttatatggaagctttcggagtgccgatggctcatgtct

SEQ ID NO: 58060 - DNA, 814 bp, Triticum aestivum
  unsure (1)..(814): unsure at all n locations
  Clone ID: PAT_TA_58060
ataggaatgcaagtgcttatgctatttcagtgacaattgtataattcactagaacttgaagtggtctggtttctgcacatcaaagcatatttttttggaggatatgaagaatgaagataccagaacttagaccaactgagcattgagaagagtggtttatgcactgatatatgtacccgtgtctcttctgaatctatttaattaagctgcaactcatgtgtgagagacttggtttgtgcagatatcgtagaagcttaatgctgccaattaggtgttttagaagtatgtcgtttaattttcataagcactgtacttatatctgattgttgacatgcctacggaagtgcctaattctctgttaggctttgattcttatgttactttcttactgggcttgttttattttattttgggaaaacccatggttttatcctaacccaaaattgctgaggtaggataagagtaatgggaatccaagcctaattctccatttcaatgtacacaaaattactgatgcatctccatttcaatgtacacaaaattcagttggagtagactccaaatctatgaatcattcttcctacaaagagtagaaacagagcctatccacacaaccagaacacttttttaactcttaaacttagcaagcagtaactcatgcangagtagttcttcagagctctatccagcctgacatcaaagggaagtcgagtacggcttttcagttttctatcctgcaacacataattaaagggaaagtacatcgttcgagaatattgcttcattgacatgcatgntttattgggcctgccat

SEQ ID NO: 58061 - DNA, 352 bp, Triticum aestivum
  unsure (1)..(352): unsure at all n locations
  Clone ID: PAT_TA_58061
ctctcgcttgttctccatcccctccagatcccgccgcccccaaccctcccacccttcccctccacagcaagccacctctaccatcccggtgagtcgcacagccccaaccctctcccaccctcatctcggtgctccacatctcctcatcatgctacccaacaggctccctccctcttctgccgcacaaatatcggcgagatccagggagacggggacgtcgatatcggcatcaacctcgccaagcttgatccggggataccggggccccgggctgccgtagtgttggatgttgtggccgtctctcccactggcggagacgcgngcctgtcgcggcttacccgggaggtcgaca

SEQ ID NO: 58062 - DNA, 822 bp, Triticum aestivum
  unsure (1)..(822): unsure at all n locations
  Clone ID: PAT_TA_58062
ctttctttgggacatgggtattgatgttagtattttgtatcatcatcttaaccttggtagactgatggttagcatcaggcaactgcagagatttattgatttttatagtccccttctatataaatcttatatttgttctgttcgtcatcagtgaaaacttacctaactattgttaatctgagtttgtattttcatatgtgttcaccaattcggcttctgggtggcaagattagctgatttaaagcattctctttgggcaaacattagtcactgctatccaaatatctgcagaacgagcttgttgtatacttgttttaactcacacataaggggcaaataagcacgaatggaaaaggaacacatatgctttctttagttgtgctcactttacattagtggacaaagttacataagtttgcctgtagcactactaatattagcgattaaatttagctgctttttagttctataggctgaaaatgatactgaggttctaagcatactatttgagtggngttttcttcttgatgtgcagctaaattagtcttccagtttgtcaacttagatgataagaattataaattcgtgtgtaattttcatttgtttgcgctgaacacatgnatgggtgttttgcgtcctttnttctttatccaattagacagtgttagtgcttgtgtaaagatacaactagaattgctccgttcgctagataaatggattctgttctggacggtggcaccttttattgatccaaattttgttacctctttccgatttgttgcatgacttcgnttatttgtactctttccgtctgaaaaagct

SEQ ID NO: 58063 - DNA, 396 bp, Triticum aestivum
  Clone ID: PAT_TA_58063
actcctctgcctccgccaaatgtagatgagggctatctattttttttagggagaaatcataggagggggagccatgctccagtaccacgacaagctttccggccacaagcttatgtttgagtcgttgccttacaaggagctggagaacggccttgtctcggaaggggctggccatttggtcgttaaaagagcactagttgtggacattggcggcaatccccttgttgacgttggtggccatgatgagggtgctgaataccaacccttgaaagaggatgacactgttaacacccccccgctttggattatctctcacgggaagaagctcatacgaaacctctcctactagcttggacggggggacctaaatgctttttaaaagaaagaggagggcgc

SEQ ID NO: 58064 - DNA, 766 bp, Triticum aestivum
  unsure (1)..(766): unsure at all n locations
  Clone ID: PAT_TA_58064
cgagaacaagtggtacaactccggcgatcaatttctttggcgattaacaattttgatcaattcaaacagcaacacaggcagcgctagtgctgctgttggtcagtgcggggaggagcacgggcggaggtcaattggccggatccggagctccagtgcctgaatcgaggagctggaaggctgaggcaggaggaggagcacaggctgcgctgctgctgctgttggtcagtgcggggaggagcacggacggaggtcaattggccggatccggagctccagtgcctgaatcgaggagctggaaggctcaggcatgaggaggagcacgggcggcgctgctgctggtcggtgcggggaggagcacgggcggcgcgaaggccaggagtcgcgggcggctggaggctgtggcggacggcgagggagctgcgtacgagtttgggctcttgattgaagtggaggaaggcggccgacgagggagctgcgaccggcgcggacggacgccggagctgcagcagtgggatggagcctggcggaggggaggagcgatggagtaagacgaagatccccggcgataaaaatttcaaattgangggtagtttggtactttatcctgttttcacctggtcggnagaagtttcccaacgacaactatttcggaacagagggagtatatcggagagagattntattcttccatgccacgtacgtactgctgctcaggatctccagccaatacgtagtacggcatacgtatatgcatgggcagagtacg

SEQ ID NO: 58065 - DNA, 709 bp, Triticum aestivum
  unsure (1)..(709): unsure at all n locations
  Clone ID: PAT_TA_58065
gcagaagatgctgctgctgctgctgccagtgagagtgaaccgccaccgccaccgccacctccaagcaaaccagcaaagcctaggaggcacataatggccaggcctcccaatgggttgggaaagaagggccagcccatccagctgcttgccaaccactacaaagtctctgtcaagccttcagaggagttcttcaaccactactatgttaatctcaagtatgaggatgatacgccagtcgacagcaagggcatcggcagaaaggtccttgataagctgcagcacacctaccgttctgagctcgcggacaaggactttgcatatgatggtgaaaagagcctcttcaccatcggggctcttccacagatcaacacactgcttcaaattgaagcagcccgtgcaatacccattgtggggaaggtgcctactatcatcctgggcatggatgtctcgcatggtcaacctggccaatctgacaggccttccattgctgcggtggtgagttctcgtgagtggcctctcatctctaaatacagagcaacagtgcacactcagtcacccaaacaggagatgatggcttccctgtttaaaccacggngaactgaagatgatggcctcattcgggaatctcttattgacttctacactagctctgggaagcgaaagccagaccaagttattattttcagggaatggagttagcgaaagccag

SEQ ID NO: 58066 - DNA, 584 bp, Triticum aestivum
  unsure (1)..(584): unsure at all n locations
  Clone ID: PAT_TA_58066
ggccgatctcgcagtctcagcttcggttcggcatggccacggcggcgcctcacgtcatggtgctgccgctcgcggcgcagggccacgtgaccccgctcatggagctgtcgcaccgcctcgtggagcacggcgtcgaggtcaccttcgtctgcaccgagcccacccacgcgctcgttctcggcgccctgcgagtgcgacaggccacggtggacgggatccacctggtctccatgccggacggcctggccgacggggacgaccgccgggacctcggcaaggtcctggacgcgctcgcccggtgcatgccgggctacctggaggagctcatcaaggagaagaaggtgacgtggctcgtcgccgacgccaacctggggtccttgtgcttcgaggtcgccaagaagctcggcgttcgggtcgcctccttcttcccggcgtccgctgcatgccttgggaccttgtccaggattccccagctcatagaggatggcttcttcgacgacaaaggcgtcccgaatcgacgagaggcggtcgagctggcccccgagatgccgncggtctacacgtcgcacatgctgtggagcgtc

SEQ ID NO: 58067 - DNA, 410 bp, Triticum aestivum
  Clone ID: PAT_TA_58067
ggtactcgtgcccacaggtcacccccctgcagatatcgacttcaccaatgttgcatcactctacaggcggtgtgctcagagatcaacgccaagcgcaacgacagaccgtggctcctacgtacgaacaccgtaatcgcaaagctggacaacgcccccacaggagctcacattcggccggccccccaatgaggtacacgatgagttccatgccacagaacaacaggacgagggcttcgtaggcgctcacgagcagcacgatcatgaccgtgggcaccctcctcgtggtgatctccggcctggcgactaaggccaccagggtgtggttaggatggtgcacgccccgctctctgatgttctgcccatggtgtgcccgagctggatcaccatccgtctgagagctagacttttat

SEQ ID NO: 58068 - DNA, 326 bp, Triticum aestivum
  Clone ID: PAT_TA_58068
ctgagatgctacaccttatgatgtactagtatgacattctgttctgcagaatttcagaatgctgagggctatgacttcaatcttggctgggtgttgctggacggtggtggtcatcgaagatctcaggtacgacacgaaagagtacttgccagcttggtgtgatgcatgtatgcccccaggaagaccttacgtccaagctggagtgcttttctggtacttgaaagtgaacatgctgctgtgattattttaattcgcaatatgacacagattgtgattattttttatggcgaaaaggatctgatacattataaagattcacttgaagt

SEQ ID NO: 58069 - DNA, 798 bp, Triticum aestivum
  unsure (1)..(798): unsure at all n locations
  Clone ID: PAT_TA_58069
atatatttctctgtgtcttgacttttcaggttgccatgaccaagcttccttaaaaactttgcttaaatcctttctttgacattcttgttcacctataatataatatttttttttgaggaggattttcgaaagaactgctgctgtgtatgttgtgtcatttagcaataaaagtagatgttctacataatactgatttatcaacatctatgaactgcaaggcaatcttttattgctattcaatatgtatatatatatttgtctagctgcccaatcttcattatctcccatagttttgcacatgggagacgctagatgggcatcagcaatgttgcttgagaatcttgctcggtgagttgacccctccattttttcttggtggttctgtaatttctgtatattacgttgctttggttttggatatgttttgtctggtttgcacttgttctgcatggtacattgcatgttttgttctagtcatatacagatgtgcaaactatatttttgcagaatcgtgccagaaatccaatgtcaggtggctattctcagcagggctaccgccctcctcgtcctcaggcaactggggtgcgcctggtgcaccaacaacacaacagcctggttatggttacatgcagcctggagcttatcctggtgcgccaccacagtatggccagcaaccttatggcagctaccctccagcatcttggtggttatcagacagggtggggatcagtcttcaaaccagncatcacagcaagcccccccctggcactggctatgactactattaccaacagcagc

SEQ ID NO: 58070 - DNA, 695 bp, Triticum aestivum
  Clone ID: PAT_TA_58070
ggcagtttgcttgcctgactcctgccactgggtatgcgcgcagtgtggggatacctaacccgcccggactgctcctgtgccctgctgcccgtcacgcaccagtcggggcgcgccgtcaacttactgctgacgttgggcacgaacaatgtgcacaccaccaccgaccgaaagcacatccaagtacagcaagaacgcgcacagtgtgtactacgactaggacgcgcagagggaactcctggtttcccgtaccaactacctgaaaatacaataatgtcttgctctaataaaccaagaactttgcaggcggccgagcgagcaccttatcttgtgtacacatgcgagattcaggaacgggcaacctttggaacacggaagaggttctccactggtctcaaggtaatgaagtggctaacttctgagctcttcatgatgctgtccccctggaaatgagaggaagggcaaggatgaatgtacgcttctgccgaatgcaagttctcaggagtatctcacaaatgagccatcatagagaagaagacaattccacagaagcatagccagctcattgctagggagctaaattagcaggcatgctacctgtactaaatacatgttgtgcttcctgtcccttctgtacttctatatattgaactcattgacatatgatgcaacctgttaatattcttaatgaaatcacc

SEQ ID NO: 58071 - DNA, 749 bp, Triticum aestivum
  Clone ID: PAT_TA_58071
ctctcgatcccatccgcaagccgccgccgccgcactctctctctctcgctcccatccgcaagccgccgtcgccgcccaccgtcccatccccgtcgccgcaagctgccggatccccggaccgctatcctcacgggccacaggatccccgccgcctccatcctcacgggacgcgggatccccaccgcaggccacctccgtcctcgtcggctgctggatcccctgccaagcaccgccgctgccgtcttcagcaagcactgccgccgtcgtctccatctcgttcttcctccaaggcttcaccgccgccgtctccagcaagcactaccgccgtcgtctccatctcgtattcctccaaggcttgaccgccaccgtctccagcaagcagtaccgccgtcgtctccatctcgtattcctccaaggcttcacgtcaccggagcagcaccgccgccatcaccacgccggagcagcaccgccgccatcctctgtctctgcaagtttggaggtatcaagtatcctacattgcgaagaatggctcatgatatactagccattcctgtaacaaccgtggcatcggaatctgccttcagtactagtgggagaatactaagtgcacatagatgttcacctgcaccaaacatgaccgaagctcttatgtgcatgcaagcttggtcccgtgcagacatgttagggggattgcaattctactctctttgcggactttgaaactgttcttaaggatgacacagaaatga

SEQ ID NO: 58072 - DNA, 460 bp, Triticum aestivum
  Clone ID: PAT_TA_58072
cccccgcctcctggcatgaataatatcagagagatgcgctgatacacgacagcaagcaacgtgactaatctcatacaaatgacgatataccttagtggataatcgactggatagagaccggccactagatcaaagaagaacgcataccgaacatcgctccttttataacacacagcccacttaccaagcgggaagacatccggtagatgagttcactaactgagaacacagagagagtgctttttaagaaccagtgaactactacaacagctcaaggccctgaataggctataagaaagagaaccatattatttgcaacatggaaagaatggccgaaaaacccatgcttaccctcaatggacagacccaaccattaccgcagagtggctcttctgatggggaagatgacaaacatgtgccttactatcagatgaagcctaaagcacctactactccatac

SEQ ID NO: 58073 - DNA, 443 bp, Triticum aestivum
  Clone ID: PAT_TA_58073
agtccgcgaggtggatggccagccgctcgatgtggagcagggacgcaccactgccctgtaccgaaggtccgagctgaatcccgcgccaccttggagctcctgtagcaggggcccatgatcaccatccgccatgggcgtctctacgaggccgaggggcagcaggttccacgcaataatgcaactcgccgtccttccttgtacgaccacatatcacgccgtgcatgatatgacacgcacggtcagctgagacctcttttcggtctagctgctcgccatgctggaaggctagggctacgtggagatcctctgtccagacctttgacgccacagcgagcgccgtgagcaagaacactgcttggccaagtggaggagcgaggaacatgatggaccaccggcgtcagcaacatcgacccgggtgccgctgctaatctgcggaggagcat

SEQ ID NO: 58074 - DNA, 731 bp, Triticum aestivum
  unsure (1)..(731): unsure at all n locations
  Clone ID: PAT_TA_58074
gctcgatccaactcctccctctccctcggtcttgcctctcctatcactcgatgtcgctcgatcctctctagggttcgccgcccgccgtcgtccctcgccgtcttgctccattgtcgcccctccctccacctacctcgcccctgctctagggttcgcctcccgccaccgccgccgccgccccccgccgccctgctccgctgttgcccatccctccgcctgcctcgccccctcccctacactcacccctgcccgatctggatctggatgaggcgttgcctcccgttcctctcatcgcgtcccctgtgccagccatggaagaggggaggaagaaggggagggagagcaaagaggaccgcggtggcgatgtgccaacgttggcaggacgaagatttgtgaatcaaggagtccctgcatctacccgcgaccctagaatagccgctaccgctgtgacctttctccataccgtgagcttcgaggagtctggcggcgccatcacgccggcctctgtccaagaggtcatcgcgctcaacaggccctcactcctcggctccgcctgcggaggccgtcgacgccatcacagggtgccgctttgaggccggngttgaagctgccaccgaggaggccatcttgacgcagatgttgcaagcactcctgacgtgcatgcactcccctgcgatttgtgaccaacacatctgctctgtggtgagcatgtgcttcgtgtcatacaggtc

SEQ ID NO: 58075 - DNA, 662 bp, Triticum aestivum
  unsure (1)..(662): unsure at all n locations
  Clone ID: PAT_TA_58075
gtacgacctcgcaggtattccggtccggnaatgtcccggnngtcgacgccacgnncgtccggnaaaatatgtactctggtgtaaacacttattcgctcatgtacgccgatcggcagatgcgccagcttagacgagacggcgcgcaccagaagaacagataccagaagatttcgaccacaggcctctcatccctttcatcttgacaccgtncgacccaggcaagcaaggatagcaggatacgaatatcaggacatggtngagaaggtgcgagtggtatacagtgcggaggcgtccagcgtggtggcggctcgaagcgctgatcatggtgacatacataggtccattggccttcgcacaggtgggagctgagacgattattaaacggtgctgaacagccggccggggcgaatacggtgacaggcgcctgctgctacttcgtcctctttgacgtgactagcggtagttaggaggctgcggactgaagactaggaggaggacaccacgagagatcctggtgtgcagacagtctggggaggtccgaatattgtgaagttgtgggctgttgcaagggagcagctgttcttaagcatcgagctggatggttgaatacatcagtggcacagattggagagtgctatatgctgctttgagagattatgaca

SEQ ID NO: 58076 - DNA, 728 bp, Triticum aestivum
  Clone ID: PAT_TA_58076
tagtccgcctactttcatttttatttgcgttgcttttccatacgcagcaatctctaccataatccaatccagtccaatccaccctgttcacgtccctgatggtgaggtggatgattctcctcgtaacggatccagccgagggcttgttcttaatccgctgcccatgaggatcacagggggttgaaaatccacgccaaactgaacaaggtgaggatgtcaacatcttcgaaagtggatcagaggagattagagagcatcgaggggattttgagttgcggcggacttgatccccttcggtcctctttaatccacacgaaacagaaggcctagaggatatccacgtctctgaatcagcatatgcaaattcaaccgcccaagaattaccagggcaccaagtacgtccgagctggttgttccacgttttatccggagtttccagatgactggtataacatcgaggaccctcccatgcccaaggacacttcccgcaagaagcgcaatcagacttacagggcgcataaaccgactcgcaaattgctgtttgttctcagtaagaaggtgaatgtgaaggcatgtggtactgatagcaggaacacgcaggccaaggggaaagcagccaggcgtgctgctgcagcaagttctgagtttgcaaactattctactgataagctctttgcaagatgtgatgtcgagggtaagtcagaagagtagctacttgctcgtcaagg

SEQ ID NO: 58077 - DNA, 442 bp, Triticum aestivum
  unsure (1)..(442): unsure at all n locations
  Clone ID: PAT_TA_58077
ctcctctcgccgcagcctccaccgaagggaagagaggagcagggcgaaaggaggccgncggagatgtcggagaagaagcgcgcccccggcccgcgcaaggacgaggtggtgacacgcgagtacaccgtcaacctgcacaagcgcctccatggatgcaccttcaagaagaaggcaccaaatgccatgagggagagcaggaagtttgcacagaaggccatgggaaccaacgatgtacggattgacgtgaagctgaacaagcacatatggagcaatggcatgaggagtgaacagaggagagaacgaagaaggattgaacgcaagaggaatgacaaggaggacgctaaggaggagatgaactgtgtggagacaggtggtgaaggtgggggagaaggggtaaaaggtggggggacgaggggtggggaggatgaggacgtagggcgcg

SEQ ID NO: 58078 - DNA, 514 bp, Triticum aestivum
  unsure (1)..(514): unsure at all n locations
  Clone ID: PAT_TA_58078
cacaaccacctgcgccccatgggggcggtgagccgagctgcgcaacgcgtgcggaggcttggtgttgtgctccatctccatcaactcctccggcccaaccactatgctggacctcaccaagaacctgggaggcgtgcaggttgtcgaggcaggggaggcgcaaccggacctggataaggtgtgcctggaggtcgcgtcgccagagttccaggcggctttggtgctccgagtcaaacctcatccgcaccgcctgcttttggttcgggcgcgagcgcccaaagattgtcaggtatctgtcaagatgggatattcagggcactctgcgtagtgggggcctcatcatttacaggaaaggtattaattctaggaagtgattgcgtgctcatgtaggacttgatgaaggagaggggagtacaccaaaatatgtccagagaaaaatccctttatttatcttccctttctattttgagagataatcttcaggttctttttacatatattcttcagnttatat

SEQ ID NO: 58079 - DNA, 782 bp, Triticum aestivum
  unsure (1)..(782): unsure at all n locations
  Clone ID: PAT_TA_58079
ccaagtcagagaatctacacttgtccatcatctctccaaatctctccatcttccattcttgtctctccaaactgccaaatttctcttcaacctctaatactttgttgaagtctcctgcgtagatccaagggctattatattcccttctcatatattctagtaaatcctagctcctcttgcttattgatctaaccggctcaccataaaagccggtgaacctccattctatatcaccaatagaatcatcttttaccatcacgtcaatgtgggaattgctaagattttagtgacacacttgaattatttttccagtagagacaaagacccccactcaagccaccatatttaacaccaaaagcgtgttcgaagccaaatcgccgtcaaagttcctgagctcttttatctgacatcttggtatatgagagaaagaccagacgtggatgttgcgacctaatgaggtcactgatttcgcgaactctcttgggccgtccacaaccccgacaactcagagctaaaatattcattgatctcggcggtcacccatgaagggtgctgtcgatcccatttggaattgagagattatctcacaagcatattgacatccttgctgacggtacatattcccttcagtttgtctctgttatcctttgaatgcanacttaccatcgagaagcctcatctcctttaggccagcaccgtaatccctcagggaacaaagaacttgtactgccttctcccgtagcgtagcccagtcaatctccagtctctttgccgaatcgact

SEQ ID NO: 58080 - DNA, 569 bp, Triticum aestivum
  Clone ID: PAT_TA_58080
tgccaaatcttcttcctctgctttgaggaaaatagcagagcactctgatggaagaacgtatctgggacagtcagcctcagccagtgaagactatagctctaggaatagttgccgcattgttttactggtaaatacttgtgacaaagtgctattttcagctgtaaacattcagcctacactatgtactgcatgttttactaataattgctgcctggtatcttgtctgacctgaaacatatggtcactttagtaatagcaacatcaaagtagaaattgggttgggcaaggaattcatgattctggcccaacttttgttagatgtgtaaattgaaaaatggttgtcaactatgattattttgtttcaaataataacacgtaaaaaccttgttttgtttgcatggtatgggttaggagggtgaacagaatattaagacgcataataagtacctgtcttatttgctcatgaaaatggttgatcttaacataggagcatgatctgaccccatgcgtatgttagcagtctgggtttcatgccttttgtgaatgcgaagaggcacttgatgcatagc

SEQ ID NO: 58081 - DNA, 315 bp, Triticum aestivum
  Clone ID: PAT_TA_58081
ctttcatgagttaatgctgctcgacagttgtgacattgacagagctttgcatttaataccaactgatggagaatttccagtgaggaactaccggatgaatcaagaatttaagccacccttgcgtgtaactgctctaagtgaagaagctggtccatctagggctgaagctttactggaaaattcggcagaattttcttggaaagggactggccacacaataacagtacagaggcccgtgtcctcttacacaatgagggcgaggtttgaactgggagctggaggagtttgacatacaacagatttttatgaaggaac

SEQ ID NO: 58082 - DNA, 623 bp, Triticum aestivum
  unsure (1)..(623): unsure at all n locations
  Clone ID: PAT_TA_58082
gcgagagattgtcaagtttgtaagcttttatcccacaacccttttccttctcatatggagttgctttgttgtacaaaaatgttacctattcgtatgtggttgtatagaaggatagaattattaattgtctagttatgatttttagcatttgttgtgcttcctagggacatcgatctctactcttctatataatccacattgatctttattgtttgattgactggaagaagttttgatgtagttttcttaatcatgcaggagtttactttggatgacaaatgtttgtagatcatccacctcctcaacgatgctaacccgatccgatcatcgtcgacactatcatcatcaggatctaatgttgtttaggctgctgctgttgtgacggaagagcagaagaggcatggcgatgtgcagcacaattttagttgatgttgcaccatgttttggtgcttgtgtatttggttttgcttggaaccacacttgtatgtgcttggctatctggttttgcttggtttaantgatgttggacgtgcggacttgtatgtgctggtgtgtgtggttggcggaatgatttctgaatttaatcatttaatcaagagaattatttgagtgtttgcctggtc

SEQ ID NO: 58083 - DNA, 551 bp, Triticum aestivum
  Clone ID: PAT_TA_58083
gccacggtatttgaggtagccaacaacgcatggtgcccgcgctgagccatcggcaccagcatcgacgagaatgctggctgcctggaggtgctcatccccgtgctcctgaagcccctccagcaggtcctgcacgcgcggcctccattcactgatgttggatgtcagtctgcataaatcaaccgctgggcgaacgtggacggccgagagcacgcgccaatgtcacgtgtgcaccacaggcagttctcttcggtctacaccgacgtaaggttctcaatcttcgacatcctgctatgtagccacttgaaaggcaaatcaataacaggccgatgaaatcaagggtagcccctgcttctgtccccgtttctctgtctcccacccaaatgctgagctggtcttttattcagtacataagcatcgacaacgtttttagcgaaggttcagttatggtctacctgctttcttcagaggtcagaaaggtgattcaagtctgtaatgcttccactagatttatagaagccacacttctggtagtatggtcaataattttgcct

SEQ ID NO: 58084 - DNA, 519 bp, Triticum aestivum
  Clone ID: PAT_TA_58084
tggcagtaatagtcacggccaggacgacgtctgagcgtcgtagcggggcctcgaggagcttctcgcgtgttacctcgtcgtcaacgccactaagcaccaccgcgccatcgtcaccgacttccggcgggcctggctcgacggcacgaccaacatatgctgccaccgaactctggctgcttgtcctccaccctgcccatcctgctgtcgctctccacaaatcggtgctgatagaagtggtggagaatagacaaagatagagatactgttaggaattaattaattagattaattaattataaatccatgctatgtcggtggtcatgttttggcaaccgccttctttgtaactgccttgtaatgagggtataaataccccaatcttcaatcaatgaaacaactgttccatcagaaaaaaaaaaaaaaaaaaaaaaaaaaaaaaaaagagagagaagaaaagaaaaaaaaaaagaagaaggaagaaaagaaagagaaaaaaaaaaagaaggggggggggcgttt

SEQ ID NO: 58085 - DNA, 569 bp, Triticum aestivum
  Clone ID: PAT_TA_58085
gaagaggaaaaggaaccagcgcgtagccacagcgcgacccctcgagcgaaacatctacacgctcagcggagcaggagcaggcatgggtatagacctcttctccaggggcaggaacaagaggaccaagtgcttgaggcataaaagcgacgatgtttacctgaagctactaatatagctgtacacgtttgctggcgaggaggaccaacagcaaggtcatcgccgtcagtctaaagaggctcttgatgagcaagagtaaccgcccgtcgatctgcatgcgccggctctacaacttgatgatgggaaaggaggagaacaacattgatgtggttaggggtacatgcacagatgagatgcggattgaagaggttccagcactgaaggttaccgctatgagggtcacacagacagtgagggagaggattgttaatgctggtggggagtgcctcagttttgaccagtttgcactgcgggctcctactggggagaacactatcctgatgaggggacccaacagtgcccgtgagtgcggtgaggcactatctgaaagcacctggtgtgacgcacagaca

SEQ ID NO: 58086 - DNA, 620 bp, Triticum aestivum
  Clone ID: PAT_TA_58086
acttcttcaggtcacatgggatgagccagacttgttacaaaatgtgaaatgcgtgagcccatggcttgtggaacttgtatcagagcattccaccaatccatttgggaccattttctccaccacgaaagaagttacgggttccccaacatcctgattttccattggatggtcatctgtttaatccaattttccatgggaacccacttggtcctagcaacagccccctatgctgttactcggacaacaactctcctgcaggcatacagggaggcagcagaggtgctgctagcagggagcggcggcggcggcgaccgaccctccagtggagctattcaacgccgcagcggggccctacaacgggttcggcacgttgcctgcgcaggggcctaccacggcgccgcgatttcctctggcttgtcgacaaggtgcggctcttcttggcgcggacgaagacgatggtcatgggcaacgtgccagagacgcccatctaccggtggatggaccagtacacgacgtgctcgacggcacccttcgcgagaagatcacccggtggattgacgacgactacgaacgaacctcgtactcaacatgtgtgagcgattggcagcatcgacaccagt

SEQ ID NO: 58087 - DNA, 212 bp, Triticum aestivum
  Clone ID: PAT_TA_58087
cttatatccaagggtctagatgcagacctcgtaagctatgttccgtcagatgtttcaccggagaaccatttgctcatggccaagtgtaggtcttgatggggttaagcaatttgtttctcaaccctgagaaaattggcagaattttgttgtaaaatgctttgtgtttacaaaaataggcataaagattttggaaccttgttaggatatttatt

SEQ ID NO: 58088 - DNA, 353 bp, Triticum aestivum
  Clone ID: PAT_TA_58088
gtggctcaggcgagccatttgtctttggtagtggcgacgccctgatctggatatgaggatttggactcgccacacgctctcttgaagacctcatggtggcatgagggagctgccgagcgaaagctctgagctttgtcgccgacgacggtgacgctcgtgggcgtcgttatcttcttgaagacgtcgtctgttggggatcgttgcagaaaataaataaaaaatctacgcatcaccaagatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaa

SEQ ID NO: 58089 - DNA, 716 bp, Triticum aestivum
  unsure (1)..(716): unsure at all n locations
  Clone ID: PAT_TA_58089
attggataaaacaattgttgggttaagtaagtatatgttgttttcgtactatagtggagtacttgctctgttttcttccttcacattgcacggaactcgtgtactattcagaaacacgatggtgaatctgcaatcatgatggtttctttatgacaccagcctactttaatgtcattttctctcatcaagtaggtaaatatatggcgaaaattcgatatggctggtcataatactagacagctataaaactgtcacctatagaactgttgtgttccattgtgtcattgctactgccttatcttaaaactatatacccaagcaagtacacattttgaattgttcccattggtaatgtcggattgatcttagagtttactaagtattgccattgagaaactttctctatctatgtgatttagttaatgaattcattttttgtagtcgattattaatgtaggagcttgggatctttaaccacagagatgatgcatagataggttaatgtattttttgcgggggaaataggttaatgtatttgtactcttcttctttgtaggagttcaattaatgaattcagttttccatactcgattaattcagtttntcagttaatgaatttaatgtcctcttccttttaggtcccaagttggttattggtggggtttttgctcatgcacaagcacaacccatcataggaatcagtaggaccatcttga

SEQ ID NO: 58090 - DNA, 321 bp, Triticum aestivum
  Clone ID: PAT_TA_58090
gggcgctcttttcatcgatgcgagcgtcggtgtcagcaggaccagccgcggtactctcatgcccgttgcgtgcatgatgtgccgggacgatcagcaccatcactgaaggcacgagcaggagcgagcagggtacgaggttcatggacgccacggccaggtggatcgtgaggaggagcatgggccattgccgcgctcggtgcatgcatgagagagcgcgagtaggaacaaagacgagaacctgggcgctgcagtgagggagatcgtgctgaggagcacggtgctggccgtcgctcgtacgtattcggcccgtgcacattacgc

SEQ ID NO: 58091 - DNA, 680 bp, Triticum aestivum
  Clone ID: PAT_TA_58091
gacttcatgctgatcaatcaggttgctcaagagatctgggtctgtgagaaccaggcggtgactaggtgggaaggcgatatcatggatttcaagcaacacttgaagaaaagggctggtctctagatttcctgtcttttccttctctcggctctttggagatctagacaacccaaagttttgcctctgtatcagaaaagcttccatcatttagcgcgacaagtacaagtactattgtatcacttaaaacatatcttctctacgctattttataaccagacgatccgtatttaatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaaaaaaaaaaaaaaaaaaaaaaaaaaaaaaaaaaaaaacgggggggccccttttaaagaacccaacttaacttccccgggctggcaagggaataacttttttatgggggccccaaaattaaattcccgggccggggtttaacaccgggggaacgggaaaaccccgggggtccccaaattaaatggcctggaaaaaaatccccttttcccaagttggggaaaaaggaaaaaggcccgcaccgtacgcctttccaaaaatttgcccaccctaaatgcgaaagggaccccc

SEQ ID NO: 58092 - DNA, 386 bp, Triticum aestivum
  Clone ID: PAT_TA_58092
ggacgacggtgttggagatggtgagcgccttcgagaaggcatacggcaagaaaatcccggtgaagatgtgcccgaggaggccgggcgattcggagcaggtgtacgcgtccaccgccaaggccgaagaggagctcggctggagggccaagtacgggatcgaggagatgtgcagggaccagtggaactgggccaagaagaacccgtacggctactgcggcgacgctgaaaacaaagactgatccgagggggcccgtcgggagccttgtaacgtgaaagaaagatgtgtcaataagcccagggcattaaagtgtgcccaaaaaaatgttttctgttgtagtactactactagtactactattcaagatggaacctgagttgggtgggtt

SEQ ID NO: 58093 - DNA, 739 bp, Triticum aestivum
  Clone ID: PAT_TA_58093
gccggccgctgccgccaccgctgttgctcgcccttgcctcccacgcgccgccgtctcccggtcgtcctcgctcgcgtactctgccgcatctcccgcgccagcagatcgacgcagccgggcccgtccaccgcgtctccccgccgcccagctcgtccccggcctccgcccaggttagacctcgtcctacagctcgccctcacctctcccccctccaaaccctaccccgccggccgccgccgccaccgctgctgctcgcccttgcctcccgcgcgccgccgtctctcggtcgtcctcgctcgcgtactctgccgcatctcctgcgccagcagatcgacgcagccgggcccgtccaccgcgtctccctgccgcccagctcgtccccggcctccgcccaggtctgtactctgagggttactttcatttgcgttgaaagctatgtgggtcatttgtcacggccatagatgcggccccggagctgtcgggttcaccgtgacacaggtggagcagatgaaggtggaggcgtgagtagccgacatctactgcgtcctcttcgacgccgcgcccaacgctaagtctttcatgctagagctgtggtgcaatcagcatgtcgagtatttgacgaaagggctcgatgccaagtattgcttctccaatgtaaaattaactcgagtgtcgtccctgggtattattttgcttgacagttttcattccagtcgaccttagttattatgctattgga

SEQ ID NO: 58094 - DNA, 543 bp, Triticum aestivum
  unsure (1)..(543): unsure at all n locations
  Clone ID: PAT_TA_58094
cggnagtatcaccgnacgtcgcgcggtgtccggtgcgcccccggttactccatgaaaatccattggtcagaggctgttcaccttgtatacctgatgcggttctaagtaccggtctgatttaacatggctcaggacttgcttaattatggatgtatgaaaatctattttctgattgatactgatccagatggagcggggggagtatgattttaaaggatcctgaagtcaaattagctttgtataatgtggctgattctattagggcatatgctgacttatcaatggctgtggtcctgcaaaagaaatggtctttttatctatgctgcaggatcacattgatataatgatactatggctagtatttggaatgacgcattatttacaatatatttttattgtgccatattaattaacaacttctttgctgcaaggactaccgtctaatatctatcctgtttcttatgtacactgtgtgatcatacaatgttaattattaaaatagaatgttctaattattcaattgccatgttatgtcattcatgt

SEQ ID NO: 58095 - DNA, 669 bp, Triticum aestivum
  Clone ID: PAT_TA_58095
cgcctagtgctgctgtgtcctctcatgaacagaataccgcagattaccctgaacccggagaggacgagcagagcaaccccgccatggccgcggcgaacctccggcgcctcagacctggtggactaccagcgagtgccccctcgcctactgacgccgacgctcgccctgctggggtctccgactccacagagccgttaagcgtggagacctcgatcctgttcacatcacaagtcttgaacccgtcaggccgcgaggggaccaccacgccgcgggagctcgccgtggacttccgagacatggcgctcatgcagcacgcggagatcggcgtcgaatggctctacaaaggcacaggtaatgcggggcttgtggcaactatactacgaacaggaagcggttgacgtgggctttggaggaggactgaacgagagcgtgctgctgaagcaagagatgagcttaaccgtatgctgaatgaggatgagctgcgtgatgctgtgctgctggtgtttgcaaacaagcaagatcttactaatgccatgaacgctgctgaaatcactgacaagcttgacctgaattctctgcgtcagtgacactggtacatccagagcacatgtgctacctctggagaggggttgtacgaggggcttgactggctgtccaacaacattgcca

SEQ ID NO: 58096 - DNA, 668 bp, Triticum aestivum
  Clone ID: PAT_TA_58096
aaaggagtatggccaccggccgttgggaagggagcttcgaggcggacaaccgcggaacttgaggcggaccggcttagacagggcgacggacccttgggggcgcaagagcccgtaacgtgacccggtgcggacggtgagcgcaggcagcacctgctagcgtgagatgtgactcagagcgagaccgcatagacctgccacagcggcttcgctgcagttgctgtataacggaccgcgaccaccaacagagggaatcaccgcttcctctccaactacgttagatcactatcgcgacactgtgatgaatggaccaaaactaacctgacttacgacagcctaaaaccaggtcacgggccctagaggaggacgaacaattcagcactcggtgatgtatggtacagaatgataggacaagccgagagagaaggatcacaaaagcatggcacagtatgaactcttggctgtcacaagccagatatgcactgaggtaaactatgatgacacctataccttgaaactccgaagatctataggatcgataggacacgctggcacggatcgtattcgtactggaaattacatacaaacgagctaatatcctttagacacacacgagatatctgccttcgcctagctcatcttaggacacatgcgttatctatgacagatgt

SEQ ID NO: 58097 - DNA, 758 bp, Triticum aestivum
  unsure (1)..(758): unsure at all n locations
  Clone ID: PAT_TA_58097
ggaaaaattcccgatatggtagaggactgacgatttcctgacaatgggggcctaatttagtatttgcatgaatcatcattggattatccatggagagacaatttataattatcagaaaggcaccaccgatgtccaagtgtctttggtgtatgcgtcgtctttgtccgcttccttcacatgctcttcgtttccaccgatcgaccttgcgtagcacccaacacgccgtgagtgaggagttttcggccaagcactataagaaggatgatttttgctacctcaagaggattatccttaagttgttttgaggagaaaggggatgaccaagatgattttctgcaaccatatttacatctttagagcatactttggtcaggacgttggcggtagctaccatgttgcttcaacacgatggagtagtgcatgtagttcttgacgactgttagttagttttttaaggaaacaactgtattagattgtttggtcattcatagattttaatgtcttgacactataatactagcttggtcagtaatttccccacattntatgaaagatttttaaatagaacaacgatgtgaacgggaatcctctgaaaaggaatttgagttctagagagctttgttgggttaccacaccatatttttgcatggaagttaaatcatcggagtgggagttttgaggcaacangtatggcanaacttgagctgctgaccgagcccgcaattttgntattctaggcttgnttgggctgaaatttc

SEQ ID NO: 58098 - DNA, 756 bp, Triticum aestivum
  Clone ID: PAT_TA_58098
attagtcgctctacgattgggggcgacgctaatcgcggtgccaccacttccaatccactctcgcggtcgccgtgccgagctgttattgctctgtcttcaactactccaagatttgttctttagacgcctgcagcttcggtgcgcagggacggcggagagctcgggacttggttcagagcttaggatctttgtcgattcaggtttcgattggtttcgtctgctcggctgactgggttgtaaatttggaactgaaaggaagaatttgagcacagatgggccagtgttgcagcagagctacgtccccggattctgtccaaggaggagccaatggctatggctattctcaccagccaaaacaagcacaagcacctcctagttacaacaatgctcagccaccaccacaagctgaggtgaggtacacaccgccagcgatgaaccctcctgtagtcccacctgtggttgccccctcaaagcccatgccggacacgattctcggcaagcagtacgaggatgtgcgctctgtctactcccttggcaaggaacttggtagggggcagttcggggtgacgtacctttgcactgagattagcactggcaggcagtatgcttgcaagtccatatccaagcgcaagctcgtgagtaaggctgacaaggaggatatccgcagggagatccagatcatgcagcacctatctgggcagccaaacatagtgggagttctgtggagcatatgaggacaagggcagcgtgcatgtc

SEQ ID NO: 58099 - DNA, 588 bp, Triticum aestivum
  Clone ID: PAT_TA_58099
atagtattttacatgaccgaccgctgttaatgtatctttcatgatttctaccgcctcactttcttctaaccgacttagacaatgactctgacccttgggagcacatgacgcccctagcgccaacagtttctgacaacagccgtcagcggcctattgcatacatggcattctgacttatatgcactcgaatcataatccagtacaaggcatataatggccaatttcttaataaccatagaaccactgacaactggtgataatgaagcgtcctgctctgctgactaagttgacactactattgctactatctgatcaagctgtctatagtatactcacgtacgacggtgtaaacccagatcacgctccgtatcatattaagagcaacacactaattagcatgaattatgattcaatggataagaacagcaaacatgtgctgatacacacattctacggctatcacatcttcagtactccaggcctgctattcctagcccatcttcagtgactcctctaggccaaaatctgtcagacttaaccaatcaggagagcacgctcactctgcgcgtatttcttcagatcatgcag

SEQ ID NO: 58100 - DNA, 739 bp, Triticum aestivum
  unsure (1)..(739): unsure at all n locations
  Clone ID: PAT_TA_58100
gttggtcaatgagaatcactggcgttggtgatggactagttcaagggactgaagcatttgctcagggtttggcttttggggtttcgggtgttttaagaaagccagttgagagtgccaggcagtatggtgttattggcattgcacatggtcttggtcgtgcctttgtgggatgcattgttcaacctttgagtggtgccctggattttttctccttgacagttgatggaattagtgccagctttataaagtgtgtgaatattctgaataacaagtttgttcctcagcggattagagatcctcgtgctattcatcgagatggtgtgataagagagtatgacagtttagaagcttctggccagatggccctttacctggcagaagctagcagatattttgcatgcacagacttatttcgagaaccttctaagtatgcatggtctgattactacgaagatcattttattgtgccaaaccagaggattgcttagtaaccaacaagagggtgatactccttcagtgcttggatctagataaaatggacaggaaaccttccaaaatactttgggatgtcccttggnaagaagtacttgcattggaacttgcanaagctgngtatcagaggccttcacatgtaatcgtacatctgaagaatttangaggtctgagaactttgtaggcttataagtgcagtgttgatgaagaacgggaagctcagctgtttactttgttctcatacgaa

SEQ ID NO: 58101 - DNA, 431 bp, Triticum aestivum
  Clone ID: PAT_TA_58101
cggacgcttgggcgcgaccaacttcgtgggcaagctatctctggccaaggtggcacaggcacagggccagccggcggtttcttcctagttcctagacggtcagtctcatcatccattgccatcggaataataaagcgaggtcaccctgtagatgacaggttccgcactgtgtcattcacggctccgccgtaagcagtcagatagtactactatcagttatggtttcagagttcagtgatttgtaaagactcaaatgaccgacggatgagcaggttcgttttgagctttaaaaaaaaaaaaaaaaaaaaaaaaaaaaaaaaaaaagacaactcggagaaaaggatccaaaataacgaaacgcatacatgcagactccaaaaatattgggtcgccggacataaggtcacttgattccctgcccttgcacgccc

SEQ ID NO: 58102 - DNA, 607 bp, Triticum aestivum
  Clone ID: PAT_TA_58102
ctgtggcggtgcgtagcacacggagatggcgcgcgcggcggtggtgcccctagacgataagcacgaagacctaacccgacctcgcaaccatggctagcctcctgaagaagcctcagaataggctaatgccccgcctcactgattgcttgacaagattgatgaaacttttggcccccagccatcatctggacctcacatggacattgagtgccttcctctgatcctcatgctgaggaacacactgccatatgctctcacctaccgagaagtgcattctatccttatgcaacggcatatgatggatgatccaaaggcccgcactgacagcacctaccctggcggacctatggccatcattggcattcccaagactgatgcaaactaccggcttctgtgtgacaccaaaggccgtttccgccttcactctctcacggatgaggatgcttagcccaagctctgcatggtcctgtctggccagatcgaccagaagggcatctcgctaactgaacacgctatgatggacgaaccggcccgctacccacactctatatgatggacactgacactatcaagcttgacctggagacaacaagattggtgacttcat

SEQ ID NO: 58103 - DNA, 752 bp, Triticum aestivum
  unsure (1)..(752): unsure at all n locations
  Clone ID: PAT_TA_58103
actgaattaggtgttgcacaaccacgcgcacgtgctcaaagaggcttatgctcataatcatcttaacatctgttatgtttgtctcgcgtataggagaacagtgatagtgtgagccaaaacacttgcaaactatagcacactaactgtgttccaagatgtcctataaggatatgatagcagatgatcttaattctctccattggccaacattcaagcttttgttagcccatcaggatacaatcatacacctgatgcacagtcatatgctatatactggctagatactactccactatagctctaggtgtacttcgcttacagtgatgtacttgacctatcatagaccaggctatataacaagcgctagatgaataacttatgggatacgcgatcatttatgaactatgttatcatctggctcaataatactcttggagtactcgcgaggtgctgatggctgatgaaatacagctactctaatatgactggagacatcactgatgctgaggtcataacaccggacctattcttatctgtttgtaaactaagtccattaatacaagttagcattttgtcttaattggtcttggaactaacaaggaaaccttcttgttgttcgttctacaccactaatctgtttagccatccttgagaaaggctcgacggttggacgtgaaactatatttgntctccttttgcttctctgggttagttntaaatttaatcttggttggctgtttgcaattgaaaaa

SEQ ID NO: 58104 - DNA, 531 bp, Triticum aestivum
  Clone ID: PAT_TA_58104
agagggtttgtatactgattctaactgcgctctctgaaggcatgcgaaataccatctactgaaagcgtcatctcattgctgcccaaacctgcttcatgcctcctgatactattcgctagaggatgtcggatcgctcgacgcgccataattgcttcgtaggggctatctcatatacccgaaatcagactctacgccaatctggagttctgtaaggctacgctcaccaacttgtaccagcgagtacaggaataaaaaggtctgtacctacacactcctgtgtttggggacacactccagacacgagcacctctacccgtgcctgccagcatgctacccggggtcggcaaatcgaagcacacctgacgtgtcttagcatgctagtaccacccattcacattttgccacctacattgagatgttcaactaatggtgagcagtgacatagcgtcccgatacctatctactgaccaactatcgtgccacgcgttgcttttggtaacaaaataaattgatttatccgtggatatatgc

SEQ ID NO: 58105 - DNA, 756 bp, Triticum aestivum
  Clone ID: PAT_TA_58105
cctaattctattgctatgttgagatatctacctcctataacctgcgttgaagtcttaatatgcttctgtcatgggcttcttcattttgaaggcatctcatgaatgtggatataggcttgagaacttatgctagagcagagataaatacactattttgtgtcatagaaaaactactttagtccaggcgttcgcaaaatcgatatgcttattctggcctgctgtataaatatctttgctatgttgtacattcaagctacccattacgttctactattgctgcacgtaccctttttaggacagatgttcgctaaaattattggaccaatgattctgggtgatgttctatctgctcattgttaaaactcccacaataaaagtattttttcttctcaaggcaatccgtacagacatgattacaaaaactggttggggttttcccatcctagcaaatattcacattttcctttgcaaacaaaaaaggatattctcgcttcacaaaaagttaactttgacctcacgtgcctgcatacatttcttataaatttctactattccatgtattttataaaatcctactccctccgttgtctaaatataggtattttagagatttcaatgtggattagatacagatgtatatagatggatgttagagtgagattacccatttcggtccgtatgcagttcatattgaaatcttctaaaaagacttgtatctaggaacggatggagtaccttttatcgccaaattgacgg

SEQ ID NO: 58106 - DNA, 570 bp, Triticum aestivum
  Clone ID: PAT_TA_58106
gcaaacgtgatgctatgcacttgcagagagcgaacctgaggagcatcatgcttagggcacagacagcttcaaatcttgaggaccattggatcttagcaagatggggagcatagggaggcaacaacgcggtagggcgctgccatcatgctcgacctgcacaccactcgtactcctgcgacatcgtgaggcatgatgatcgtgaggagatcgacatgcatcgaccagggcaacacggccaagccgtatctacgtcgtcttcatggtcaccgagcggatcatcggtgacgccttctataacacacatgcccatgaaccccatcaacaccagccctgtgaggccaagagcactcataggacgatgcttgtcgggcagcatacgtactagcccgtacatgaagatgaggccgtttatggcggtgcccggaaccaacaacgagccgttgatagactgcacctacatggcggaggagaagaccttatctgctgaggagatattctgcatgccgctcaccaggatgacggagatcgccgcgggcttactgagaacgaccatcaacaacgccgtcagtc

SEQ ID NO: 58107 - DNA, 518 bp, Triticum aestivum
  Clone ID: PAT_TA_58107
cgacaggttaagggttatcttgcggagtgacactagtgcagactgatcgccactgttactatggtggttccattctctacaacatcacaggcaacgcttatgcattgcatcatatttacatttcttatgattttgcctcgggagctatttatgctctatcgcctcatgggtcggagcctataccaaggcacagacttcaatggacagtctacgtgctgcgggctttctcaatgagtacatatgtaatgtcgaagatgctgtgggcttatgctgtacaggtgacgttcgcgtatcagggatcatgctgacgctgcctgggctctttctgtcagcccggatcttcactctaaacagcacggggtagaggaccacagagacatactgcacatgtcgtgcacgtccagctgtgcggccagacgctcaacggcctggccagggctgcctggactttgcttgcgctcggggatcagaccgattagacctcccacgcgatcaaggacaacctgctatttacgacg

SEQ ID NO: 58108 - DNA, 363 bp, Triticum aestivum
  Clone ID: PAT_TA_58108
ggcgctgtatatgacgagcacttggcacagtggcttctcaaacagcatcaacactgcctgcggcacatatgtggtattcaaaatacctccagggaagtgttacctgtagtgtgtgttggacattacatcatgttcccagttttttacctgggctgatatacaacaataagaaaaataaatgtcttggcgtacttttgtggttgtaactataatatggtaatcgttgttctgttgtaagtagagtttatgttgtatatttgtcgaagtgtgaatttgcacattcacatttcaggggaatgacctctttctctttgagaaatcacaacactgcccagcaaggctatggggagagagtttctgatc

SEQ ID NO: 58109 - DNA, 323 bp, Triticum aestivum
  Clone ID: PAT_TA_58109
ctcttcccctcagacggctgagctcagggcagggaggcgaaggaaggtagcagccagccgcgctctgtcgcgagctcacatagcctctgaacttctcctgcctgccctgagctcttccccgacagacggctgagcttgaagaaatatacctctgtatatcttacacccatgctgtctttaccaccataccgaacttcctttcctcctgttcctagtcttttctgagccgaaatggtatggtataccggagtgtgatagggttgttggtgtattggtctgtgacttggagagtttaaggaataacgccatttggcttcaggact

SEQ ID NO: 58110 - DNA, 754 bp, Triticum aestivum
  unsure (1)..(754): unsure at all n locations
  Clone ID: PAT_TA_58110
ctcctctcccctccctcgcgccatcgctccaccatattgtgccgcgcgcttgaccagcccaggcccctctccccgtttcggagctccatccgtgtcgatccatggggaggctgtgctgcgcggcggctgcgctgctgctgctgctcgcctgcctcagtttcagccttggcgcctgcagctccgatgctcagcgaggatgggtgaacgaccgggaggaagatgcacgccccgcagacaggtgagatctctctcaccatacctttcatgttctgtgcaggaaggctctgaatttcagtgtcactgggaggaaatagagtgtaaaatctcgtgaaagccattatagtagtagcatgaaatcttccttcgtctaggcagagtagcttggaaacttcttcatctgcatgtttcgtgtttcgtcatcgcaacattccactctccattttaaattcgcgaggaaaacgattaaaaaacacttaaaatactgcaaaaacattcttcgcggccatcttctcagattgcatcgcatggataaacaccaataagatctgaggtgggaatggcgtgtcggctgtcagagacggacagctgaaccaccgagcaaccctggttggtgcatgtcncgtcgtccaattgttcttcaccgcttctgctcactcccatctgccgactccaatcattggcagggcgtgtagtccaagcggtacacatccgagaagctctgccacaaccaaccagntacagttccaagcagtcg

SEQ ID NO: 58111 - DNA, 683 bp, Triticum aestivum
  unsure (1)..(683): unsure at all n locations
  Clone ID: PAT_TA_58111
gcccagatttggtgatcgagatggccccgtgcgctttggtggtcgagagactcctgacggcctctggtggtcgtggcagggggtgattcttctggttttggtggacgaggccgcggtgattcctgtgctgtacgtgggggaatagggcgtggatttggaggacggcgacgatctgaccgaggtccacatgatcgctttatctcacatggacgtggcatggtatcgattggccggcgaggatttgacacggggcgatgcaggagctacagccgaagaccacattgaagtcgatcgtgaggctctgactgacgaagtgatatctggagcctactttgtgcgagcttaatccgtaactaaagctgatcacgcagcaggagccggatcaggagttggtcacggagccgcaatcgtagtcgcatcatgagcagaagccgggatcagggaccagtgagaacgcaggccgagggctagatctggttctgatgtgctgaccctgcattgtagctgcactgctgtaactgagccactttctgtacactacctggatcagngctgatgagactgcccccatacctatactttcgctggcggacgcatctgatatgacacctatgtcgcctggtggcttggtccatgtccaggacggtgcaccgatcatgagtggtaacgatgctcacattagc

SEQ ID NO: 58112 - DNA, 242 bp, Triticum aestivum
  Clone ID: PAT_TA_58112
cccacgcgtttgctagagtttgcaaagtgtccgaagtaatggacacagacgtacctgctaaggtggattgcagggaactcagcattgacaggattgcgcgctccgaaagcgccactccaggtgtgacgctgaccggcgataatatccttgtctccccccactgaggagtccatggtcgatgtctggctgagtgtgccgaccagagagagctctgcataactatgacagggctgaagagagtg

SEQ ID NO: 58113 - DNA, 547 bp, Triticum aestivum
  Clone ID: PAT_TA_58113
gccaaggtcgtgggcgacgcggcgagggagagcgagacgaggagcacggggatagccgccggtcgtacgtgttcagcccgcacagcttgcgtagagtatccagagcgaccacggattcgtcaaggcacttcccccgctctacgaatagtgcaggctactccgagacataaggaactaccaggttgccataatggaggtgaaccctctcgcggtcgttgcgccaggactcacggacgcggacggcgtaagcatacaccttctgaggcgaggtgtgactgacggcgatcgagaacggcaagaagagtgcctacaccgatagagaaggcgatgtcattagaacactgggggtgactattatgcacctgcacaacaccgacgggcataagaagcttatcatggacgagattctgcacgatatcttcgtgcgaggaatgttccagtattgatagcgcaagcctctatagccaagtgtgactgaacacgaactaccagcggttgttaagacctgcgatgagcgcctttagaggatgctaggatcgagccaagg

SEQ ID NO: 58114 - DNA, 792 bp, Triticum aestivum
  Clone ID: PAT_TA_58114
cggacgcgtgggcccaacccaaacggcacgcccaaacccaaagccaagtcgcactcctcctcctcctatcctctccctcgccgaggcggcgaccggccggcgccaccgaccgcgcgtctccgttcaattcggcgaatttggggctcaggaaagaagaggaggagcgacttctctctggtggtcggaaattcaggacaagatgcacttccttgcatcatttcacggccctgcaggttttgagcttttgtctgtttcgctgggatggatgccaagaagttcctgcagatggttgaagacaagaagaagagactccttgagaagaaggaagcccctctgaaatggcagcagaaactggaagcagcaattaaggccactgaagaaaaggagaagaagctcaagtcaaaaaaacacaggaggagaagctattcttcctcagaatctgatagtgaatccgagagcgacagtgatgggaaacacaggaagaggaaggaccgcaaaaggcacagaaaacatggccactctgactctgatggtgccaggaggcgcaagcataggtcaaagaggaggagctcggactctagtgacgagagtgacagtgatggatatgatagcgaatctgaaaaagaacgcccaaggaagaagcactcacacaggaggaagcatcgccgacactcttcaaggtcagagtctgatgcttcagattacagcagcgatgatgatgaacgaagatcaaccaggaagggccattctaggagccggaggcgccgccaccgatcctcagacgatgaatct

SEQ ID NO: 58115 - DNA, 752 bp, Triticum aestivum
  unsure (1)..(752): unsure at all n locations
  Clone ID: PAT_TA_58115
cggacgcgtgggcgatcttgccccagcgaggcagcgacatgccgtggagggatccctagcgccgctcctcctcctctccagtttccacatcgggattccttctaataaagatccaagcagtatcttcttgatgcccttcctctccaaccattgaatcgcctctgccccaaaggtacgttatgatatccaagtgattggaaatctgaaatcaatccttcctctctggctctccctaatatctttctttgtaacctttgaatctccttagcttccatgtcctaagtacgctgcaatcatgcatctatttttgatcttacatgaatatatcccgtgatgaatattgtttgatgggagagccataccgatggtagtttgaattaatttagttggccaccaccatggacgatactaggcattccacatgccctcgacgcaagatgcccaccagaatgaaccccatgctacagttacattaattgaggtggacaagcctgaaaagtttagggaagcttcaaggtataggtagatgtatgttgcctatgtacaatcctatagtttattntatttgcaaattgtgcatagtgataaatttttacaagaagatgcanaataattgatcgcatatagcctgcatgcgaacatacatgtcctagatctgtttataataatttcgtattactgagattntatcatgctattaagtagtgccctagcaggaacatactgnntggtgcatttttcttttggcatgc

SEQ ID NO: 58116 - DNA, 548 bp, Triticum aestivum
  Clone ID: PAT_TA_58116
gggctgaccaagtgttgtttctagggcgaaggtgctccagggccatgtctgtgtctctgtgcggattgtcagatgattgtatcttcttcttggatgatgatgaggagaatcgtatggactactgctacaacaaggagagcacttatttctgcttctttgaaatgagatccaacgatgtctattccgctcatccaaatatttcctcgaagcgttgtgatgagatgcgtctggctgcatggctcttccctcacgactgatgagaatgtgtcatagcattatttatatgcagctgccctctgcaggctatttatatttagatgttgttccggagttattctgcaaccagctcatacgttatctatctgaccgtcgcatgtatggtggttggtatagtcagtggttctcctacaagccatgaaattcattagtagtattacctgtatttttctaaactttgttactctgctaagtgctattaatcagcagcctgcctgaacttattatggtgcgaggcaactctccgtggaccaccagccgctccgggagcg

SEQ ID NO: 58117 - DNA, 725 bp, Triticum aestivum
  unsure (1)..(725): unsure at all n locations
  Clone ID: PAT_TA_58117
cgacggcgtgttctacgtgataagataatcaacgccgagatgtcgatcgtatccgtgcacttgaaagagatggatggatcatggatgcggtgcttgccaactgctgcaatgggacgtccgatttactatagaaatttcccaagacgttgatgtgtgcattttgcacagcaaatccgtgtctcataaacatgaggttgagctgtgcattctgttgaactttttttaatttttttttcatacaattatgtgtcaacattggataaaactgtattgtactagctaacttcttctgctacgaatgtcaatcgtattgcgctgtatatacaacagaacatttcaaaatgtacacctaagtatgcatcctaaactcaaccgcaaacattcttagtaactaccaatacttaggctgtataggatataagaaatactccctccgtttctaaatataagtcttttcagagatttcaatatgaactacatacggatgtatacagacatactttagagtgtagattcacttattttgctccgtatgtagtccgcattgaaatctctaaaaagacttatatttaggaatggaaggagtagtgtagagtgtantgcagttcttcattctgttttcgcaaaataaaaaatgttctttcattctgntcttttatgtatcctcttgaagtgcagatgcttaccagcacatctttttgtctgtttgatatcctgtactgaaa

SEQ ID NO: 58118 - DNA, 548 bp, Triticum aestivum
  unsure (1)..(548): unsure at all n locations
  Clone ID: PAT_TA_58118
gcggtggctggttcggccggtctggtggtcgtgatggcggtggcaggtttggccggtctggtggccgtgatggtggcggcaggtttggccggtctggtggccgtgatggcggcagaggaggcggccgaggctttcagagcagacagagtgctggcacagctagcgccgggaagaagaccacgtttggtgacgattagaaactgtttgagccacaaaatggtctgatgcaactgccgcgtgtctagacgactgtatccccgtgtttcccattgtcctagtggacctagtatcatttgtctgtagtattttcttgccgctatatgttgtaatgccagaattctactatatatgttaacacttatgtgacgttgtgcagccaccgatgtgtcgtggttaaactaaaaaaaaaaaaaaaaaaaaaaaaaaaaaaaaaaaaaaaaaaaaaaaaaaaaaaaaaaccanaaaaaaaaaaaaaaaaaaaaaaaaaaaaaaaaaaaaaaaaaanaaaaanaaaaaaaaaaaaaaaaaaaaaaaaaggggggcccgtt

SEQ ID NO: 58119 - DNA, 763 bp, Triticum aestivum
  Clone ID: PAT_TA_58119
gtttcttggaacgcactcattgccggttatgtggagtctgggaaggttgctccagcagttcagctgtttgttgacatgaagagggaggggttacttcccgacgaggcaacattcgctgcattgctcacagtggtcgatgagtccacttgcttcttgatgcaccagctgcatgggaagattgtcaaatatggatcggcattgggcttgatagtgttgaatgcagcaatcactgcctactcgcaatgtggtgccctggtgaattctagaaggatctttgatgaaattggggacagaagggatttgatctcatggaacgcaatgcttgcagcttacgcttcccatgggatggagcatgaggcgatgagattctttgctagcatgatgcgaacgagtggagttcagcctgacatgtatagtttcacaagtatcataagtgcgtgcgcagagcatcgtgaccatggagggacagtaattcatggtttggtgatcaagaacggcttcgaaggagtcacgcctatttgcaatgctctaattgccatgtacactagatttggtgagaactgcatgatggaagatgcatataagtgctttgattccttgctgcttaaaaacaccgtctcctggaattctatgttaactgggtattcacagcacagtttgagcgctgatgccttgagattcttcagatgcatgcagtcaaaaatattagactgacgagtttgcattctctgctgtcctgcgttcatgctcagaccttgcttta

SEQ ID NO: 58120 - DNA, 782 bp, Triticum aestivum
  Clone ID: PAT_TA_58120
atttcctgcatattatgcttgatttgaacgcagctgtacagtttgatgcaagtaaatagttttcgtagacatgcttcttttggtgcttcctgtttatttcctcttaacattcatgagactgaaatcacagaacattgttagtcgctgacacaagtagtaatgattagcacctatgtatagtatcaaggattgtattgcctaccatctcaattctcttccatggaacaaagaaaatgtataggtttaacatcagattacgccattttagtgaatatatacaagcaacatgcattttgatgtgtgtttgagagaaaaaaaagtgttaagccttagacaatgatattaactgaagcatatggccctatgctaaatcacaggcgcttgatcgatgcttggttatttcatgacctccgtgcttgatctaatggtacttgtaaatccagagataatgctctcacgatgcgaggagagagcccttaccccgcggacgattgtgattggcgcagcagagatgcagaatgattgaacgcgtggagccactggtaagtactcctacctagtatgatgatgattgatggccctgcctgatccgcataaccggtcattggtactgcagcatacatacgtcagatgtgctcgaaacgagggagtataattgaaggagcagttcaagggatttgcgctgtcagcacagttcgacctgaggctcggagctgtgtttttcgactggcttgggttttgcacagcgaaatgaagaccggtgccacaggattcatgcgtcg

SEQ ID NO: 58121 - DNA, 661 bp, Triticum aestivum
  Clone ID: PAT_TA_58121
gttgtatatcgcgagcggagcccttgtttttttgttttgttttttttttcttttttagagaaaaaaactgagcaccagactgtacttgactgggaactgattacacaaagaggaccatgcattgcctggaatatactttaggggggagcatgcacatgacgggcacacctgattattgaccaacacagtgaatataataacaaaaaggccgtacttacatatatagcggtaaagcatctctgcacgtgttcgatatcaaggatttctagcagacagtgctggggtggctgatagatactcctctcgcgcgagcgactagagtgtacgtgcggagcttttggtagatggcctgacctcttattcacagaggaccccaccaaggccctagcccaggaaaggcccacgccagtaaacccagcgttgcctccaccgccactggataagcgcctgtcctaagacccactccggggtcatcgcggcgccataaaacggcccgtcctggaggatgttagccccgagcaggaaccccacggagagcggccccatggagcccacgatgccccttttggggtctatcatcggctcgtactaggcgtacatgaggccgaacgttatcaccgcctgcagcatcaccgagtgccagtcccccaccctcaacgcc

SEQ ID NO: 58122 - DNA, 791 bp, Triticum aestivum
  unsure (1)..(791): unsure at all n locations
  Clone ID: PAT_TA_58122
ggtgaactttccattggccttctgtccatgacgttccacttgatagatgatatccccatatccgccatcgggcacgccgttggtcatgccatggcgacgcacctagtcaagaatgccaaattttgtgttaggacaaggaaggatgatgatgatgaaatcgatgatgatgaagaactggtcatctgggcaagacgattcatgttgttctttcatgcttctcaagttgcgtttggtggtctcactagtctcaacataggaaatttgagatttggtgagtcagacatatccagcatcctcaccacttgcaagcggctgaagcgtatgcacttgtacaattgtgactcgggtgattctagcaccctgcaagttgaacacgctaatctcagtgagctctgtatcgtatattgtggtctcgagcaagttaagctgaactggctccctcatctcacaagcatagtctttgacggttggatagattttcaagatccacttgttcttggtcatgttccattgctcgagtctgtaagcctcacaaatgttgcccttagtttcaacaagatggtcaagttaagtaggtttcttggcagtgcctctccacgagttctgaagttggggtttaggtccgaaaagatttgggtgcagccagaatgtccaacgcaagatctggcatctgtgttccgccaactaaggttttgtgaaccttgntaaacttcctgaagggtatgatctcacctgggacatgtttattctttgagctgcaccctactgnagggagttgacatgacagtctg

SEQ ID NO: 58123 - DNA, 380 bp, Triticum aestivum
  Clone ID: PAT_TA_58123
atagccgccatgatggccgctgatccaatagagctacatgcctatgatttcagagggcctggattctcattatcaatgtataatgtggatgagtctattatggcatttgctgactcatcaatggcaatggccctgtccaagaaatggcctctttatctgaacaccaagaacacaattctaaaaaaatacgatggcagattcaaggacatctttcaggaggtatatgaagagaattggaaggagaagtttgaggaaaactcaatatggtatgagcaccggttgattgatgacatggtggcatatgctgtgaatagcgagggtggatatgtctgggcatgtaaaaactatgatggagatgttcaaagtgacttccttgccca

SEQ ID NO: 58124 - DNA, 664 bp, Triticum aestivum
  Clone ID: PAT_TA_58124
gaggaggatctgggccgtggccgtggcaggcacggccagggggagcgtgaggaggaggagggccgtggccgtgggcggcacggcgagggagagcgtgaggaggaggagggccgtggccgtgggcggcacggcgagggggagcgtgaggagcacggaaagcacgagcagggccgtggccggcgcggcgagggagagcgtgatgaggagcacggggatagccgccggccgtacgtgttcggcccgcgcaactttcgtagcatcatccggagcgaccacgggttcgtcaaggcccttcgcccgtacgtgttcggctacgtcgctcaaggcgagggcgtgctaacggtgatcgagaacggcgagaggcggtcctacaccgtcaggcaaggcgatgtcatcgtggcgccggcggggtcgcgcggctcggcgttcgtggtgccccccggccacccggtcgtggagatcgcctcgtcccgcggcagcagcaacctccaggtggtgtgcttcgagatcaacgccgagaggaacgagagggtgtggctcgccgggaggaacaacgtgatcggcaagctggacaaccccgcgcaggagctcacgttcggcaggcccgccagggaggtgcaggaggtgttccgcgccaaggatcagcaggacgagggcttcgtcg

SEQ ID NO: 58125 - DNA, 730 bp, Triticum aestivum
  unsure (1)..(730): unsure at all n locations
  Clone ID: PAT_TA_58125
gtgccaggattttacacggggaagtggctcaccgatgcgcgtctcgtggccccgctggatccggtgctcaacacctccatctcgtgcgtcacgaagtcgccgccggggacgctgcgctggtcggtcggaggccgagctagcctcgtcctctaagttaccctccggcatcatcaagccaagggatgcgggaggcagcagtccattcctgcggtcgacctcattcttgattggattagtaaacaaagagggaggaggggtcgggggatggagggantggagaagctctcatcggcagcgactttcgtggagggcggtgtgtacgcctgcgaccacacctgcagcatctgcctcaaggccttctgcgacagtgactcctccacagtagctacctctgtcttgcagatgttacaggctgcaagcatgatttgcatctccagtgcatccttgagtggtgccagagaagctcccagtgtcccatgtgttggcaggcaatcaacacgaagggccctatgagtgctttggagaagatggacatgaggccccaacctacactggcatagctaggcaggggagtatccttccacttgacatttccttctcagttntgtatggttaatttttagagccgtggttactatgaaaaccgagatgtggatattgcagtattgatcttagttcaattcattctattacgtagcctcactttggtatccatgatttccctcatttg

SEQ ID NO: 58126 - DNA, 508 bp, Triticum aestivum
  Clone ID: PAT_TA_58126
gaaactcttacctgctgcatttattgatgtgcctccctccgtacgtctagatctagatgcatccatttgatccatcagaaaattgcatgtttgtaacatcgccttaactaaagttgccgtgaaaagagttcggattagcatgcttaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaaaaaaaaaaaaaaaaagggggggccgttttaaagaaccaaagtttacttccccgggcttgcaacgtaaaagtttttttttagggcccccaaaattaaattaacgggccggggtttaaaaacgggggaatgggaaaaacccgggggtacccaaattaaatcgctttgaaaaaaatccccttttccccagttggggaaaaaccaaaaaggcccgacccaatcgcctttccaaaaatttgcccaccctaaatggaaaagggaacccc

SEQ ID NO: 58127 - DNA, 585 bp, Triticum aestivum
  Clone ID: PAT_TA_58127
gacggatattatcaccaccacacgatcgtaagggagatagaaggagaacgcccgcgaatactcgcacggcacggaatactcatagagacagacactggctggagccagaaggcttaacgcgcgatgcaggagcaacaagaaaagcaacttgagctaatacttgcaattgtgaaagacaagtaggatagtagtatgacaagcaagcacttaggctcaggaaactgctatatctaccaggtgacgctgcagcattatgcaagaataaacggacccgaatatccatggaacatcagatatttaggcacgtgagatcaaacgttatttcgacactgtactcacggcgcaaggatggcaactaaacttaccatacctcggcaaacataatttgccatgaagaaacgcttgagttgctatgcctaaaaatgtgacgacagtgctggatagcatatcaaaatatataagctgaatcacttgcaggaggcaataaaaaccctgatttcatttgccgacaccgaatctatagaagcgccataagcctctggattaaggttctgtaccatccagatagcgaataggactagatga

SEQ ID NO: 58128 - DNA, 844 bp, Triticum aestivum
  unsure (1)..(844): unsure at all n locations
  Clone ID: PAT_TA_58128
gtacaactaaaaacattttttacttagtgatatctgcactgcccttgcctacataatttgcacatctcacatggaccaggaacattttttacttggtgattatatctacactgccttttcctgcacatgctctttatgttatgcatacactttactcaaacatctatttgcccttatgttctgctatggcactcgctcaatttacatttgtgaattatgattgctggaagtaaacttgactgaaaatacacgtaattcatgcttgttcttctaacaaaaaattcagtccatgcttatgtccctgtgtcactgaagaagataatttggaatccagctcttttactttttttggtttagttacttcatgagcacaacacttcttactgctggctatttttcttttctcactgtgcgagcactagcagtgtagaatttgtgagatctgctagttagttaagcaactactagtttaataagtaaatgcccatgagatgctcctgttggtaccttcgatttttcttctttatggagagaaagtaattcattaatctcactgaatccatctaccaagagtagattgtttgttaactaggcctgctattacactgcttctctgttatatattatgtgcaaactacctctgtgttatgtggtgaaaattgccatcatatcgatttccacacaataagttgatgaatttatgccacatgatctttgctcaatttaatatatatcacaatttgatgatgaatntcttggtcttagtacatgccaccatgttcaggatgntatgtactaaatacctncatctaaaccagttgtaaaaatattttttttctgccct

SEQ ID NO: 58129 - DNA, 290 bp, Triticum aestivum
  Clone ID: PAT_TA_58129
cgcctcgttgttgcatggtggatcgcgctagtgtatttccttgtacctagggtgttgccgtatcatggcgcaaggtatacgcgcagtactagtactacttagtttgcaggtgcgtgtacgagaagtaggtgatccgatgcgagaagttggagagtgtgtgtgtgtgtgtggccagtcagggtttgtgagggttgtgtggttgtgtttggtcatttgaactacctgtgtatccgactagctagctgctgctaatggtatgtagtactatgtatgattctcgtggtgttctc

SEQ ID NO: 58130 - DNA, 704 bp, Triticum aestivum
  unsure (1)..(704): unsure at all n locations
  Clone ID: PAT_TA_58130
ctccgtggtcaccataacttggcaagctaccccttgcaagttgtggctgttggtggtgacaaaaatagttgtggaaaatctttttgcacgatttagtcttgtagcttctggaaggtgtctgaatccatgtggatgatagaatcaaaacattttgcacttgttttgaaaatccaatcgtgtacagtttgagctaaatgtttttgtccttccagcattgctctttctttgatggatgtttcttgaaaagaagagcagccaagtaaaatttggaaatgtttttgtccttcttcttcaaaattccaggttgtgaaagcaattgagaaggcaatacccataccgcgaggaccatctattgctgagaatcaccctgcaagggaggagctgaaggccatggagtcccagaaggtagacatcgaccgcatggcgacgctccaggtgcggcgggagctggggngnagaggcttggctgcccctagccctccaaacggnccggcttcatgaggctcacattctgggagctctcctgggacgtcatggagcccatctgcttcttcgtgacgtcgacatacttcatggcgggctacgccttcttcctccggaccaagagggagccctcgttcgagggcttcttcagagccgttttgcagtgaagcagagcgccttatgcaggcccgggaatttgatgtccgccggtacagtgagct

SEQ ID NO: 58131 - DNA, 228 bp, Triticum aestivum
  Clone ID: PAT_TA_58131
gcaaaactgaaccttgttcttgcccctggtattgggtagtttagggatttgaaccgccgcagagaacaaagtcactgcagcttctggccaactgtccaaatatttagctagtagcattgcccttgtgcgacgctaccctgttgtgtgtctggcacaaccttattcgcgttaactatatgcgtaagtctatctgcgcgattagcattgccaagaataaaaaaaataact

SEQ ID NO: 58132 - DNA, 746 bp, Triticum aestivum
  unsure (1)..(746): unsure at all n locations
  Clone ID: PAT_TA_58132
cggcaagaaagacgagttgagtttagcagagaagagcggcttgcttgcttgcttgctttggtacgtacgtacgtcggtcagtgaagatgagcacggcggcgcggacgacggggcggcgggggttaccatggggcgcagcgaggacgcgacgcacccggacaccatccgcgccgccatctccgagttcctcgccacggccatcttcgtcttcgccgccgagggctccatcctctccctcggtacgcaccccacccagctatacgagcacccatccgtccgtgcatgcatggccagcttcgtccaccgtaccatgcgtctatgtagcctagcttgcttaaatatcgacggtctcaagacgtacgtgtgtgcatgtgtgtgcttgcagggaagctctaccatgacatgagcacggcgggcgggctggtggccgtggcgctggcacacgcgctggcgctggccgtgggcggtgtccgtagccgtgaacatctccggggggcacgtcaacccggccatcaccttcggcgcgctgtncggcgggcgcatcaccctcgtgcgcgccctcctcttactggatcgcgcagctcctcggagccatcgtcgnctccctcctcctccgcctcaccaccggaggcatggtactaccatctttctttcgatcttcctcgcgagcaccgtctatctaattaatcatcgcagaagctaactgattaattaattaatcttgtgatggaattggtgttcgcagc

SEQ ID NO: 58133 - DNA, 609 bp, Triticum aestivum
  Clone ID: PAT_TA_58133
cggtactgttgacgaggaatccgcctgatggcgcacgtcgcgctataaagcatgggggcaacgtgtcttgaaaaccttggagccaatgggcaaaccggacccgctggtgatatgcactggtcagctccgttccggcatgagacaccgatgctatataatacttgtgcactcaatgggccgtggctgtcacagatacacttctattggctgagacatattacaagcttttttatattaagggcggagacaccagaccatatgtttgagcaccctacaggatattgcgcaatcttgatgctgaagctcttaggatggcatgcgactcgaattgtggttaccactactacgtatgaggacagtgagcgttgatgttgatgtacacggatctggtggataatggggaggggaccctaaggacgaatatgaactgtggggaacagctatggaggggaaaggtctcgcacgatggcctagcctttcttcgtagaccatcaccgtaagggcctctttggcgtgagaccggattgtgactgatgaatataaacctgctgacattaaacgactgcaactggctggagcgtgataacgccgttcatcagagacgtcgct

SEQ ID NO: 58134 - DNA, 746 bp, Triticum aestivum
  unsure (1)..(746): unsure at all n locations
  Clone ID: PAT_TA_58134
cccgttttatacctagccgccagcagcatccacacttcctctgcatagataaacaagaagggtgtctcgcaaaaggacgatgaacgacttctacgtatcagatgaggagttgcatgttccgttcttgcctcaagtttgcccgtttgctggtgatatgttagttctatactgcagatcttctctggtttagacacacgactaatggtagattcctcgatctgtcctgctcaccagctctctccaagatgtgtgaccgtaagccgacggtatatattggacttggctctaaacaggcttggtcttaccatagaaaacaccaaggtgactgatgctggagatggagaattgtatgcatcgatttctcttcatttgaatgctgacaagagcaggcacacgtcagagccagctgtgttccatggggattatgctataacaaaggaagctgctgtagaatcggctagctcaacagtcctggcctatctaaaagacaaatccatggtcattgctgatgatgcaaattaccatgtaaaagtttgttggcgcaagctacttgtagcttcctcatgggcaatgctctttgaagaccaatcaaaagacttaaacgtgaagatgtccatgatgtctaaagagattgatgtattaagcaactaccaatatgcgaacaatgcttccccattgcaattagtaacaccctgccttgnctttntgaaattntcttggttcattntaatgcaccatccatcatt

SEQ ID NO: 58135 - DNA, 474 bp, Triticum aestivum
  Clone ID: PAT_TA_58135
atctagtgtaatgtcaaggtggaacagtcttcttcccttactgactatcctggtgtaagatctgagctatagagctggcaaatccttgaatggaagcaccacatgtctttttcctttgttctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggatgcaaaaataaaaagggtccaatgttgctaaaaaaaaaaaaataaagtgcccgttttttaaaagcgtaacctatgtaaaaagcactgccaaaaccaaatacaagggccgggcgggaaaaaccctgggggggaaaaacctaaggggttaacaaacaaaacccttttgcccattagcccatttacgcaaggggcctgaaaaaagaaacgccccaaacagtgggccttttaaaaagggggagggg

SEQ ID NO: 58136 - DNA, 701 bp, Triticum aestivum
  Clone ID: PAT_TA_58136
aaaagttgcatagactgtcgaaagaaagttcaaatggaaggcgacacgtataaatgctcacgttgcatcaccactgttcctatgccgagatacaaaatatcactgaatgccatcgatgcggacgcaaaaaggcacgaagactcgccatttgctcggttcatattttggggccagcagggagaaatcctcacaggaaagcaagtactgattttagtagcataagccaacagcagggcggagtatacgccacccgaactgaccggtttggttggcaaaaaatttactgtcattgcaacacctactagagactccctagacggagagcatatgttctaccaggtagaaagtaccgaactattgttcgagccagcaaacccagagaacgctcaaccaccgaccgaagaaacacagggtgaaaatgaatcacaagacaacacgcttgaggccacacccccgccttctccttctgctgcaaaggaagaagaaaacgactcaacaggcaagagaaggaaacgcaacgaccaccttctctctctttacaaacgtacagagttatccatatggaatttcaaggctaactaaattttaatatcccgatcttttcagaacaaagaaagacctattcggtcagcagccagcccacgctggcaccgagtacaccgaccagaactaggcaccttgtatgggggaaaaaattctgt

SEQ ID NO: 58137 - DNA, 568 bp, Triticum aestivum
  Clone ID: PAT_TA_58137
cgtcatccttccgccgctcggcgtcttcctccgctacggctgctgtagcatggagttcttgatctgcctgctgctcaccatcctgggctacatccccggcatcatctacgccgtctacgtgctcgtcgcgcatggctctgcctcggaggagagcggcagggactacgacgcccttggctgatatcgtgtagcacctcatgccgtgcgaatcaacgtcctgtgtgtgcgtgtgtgagtgcgttgccatctgctgcactgcgtggcgtgccttctttctatatcagtctgtaaatgctgcttaaaccgtgctccggtttccccggccgtcctgtgattctcatacaaccgactaaattacagctctgaagattctgcccactggcttacgccagtcggagagcaggtttgtgtgacaatcaaaatcgaagcctccttgccacgcctgagattttgtgcacggttaggagggaggggagtctttgtttatgtccgtcttgctgagctcttcttgatcgatccatctctgttatggttcgttccggtgcgcgtgcttcccagcgtgttctct

SEQ ID NO: 58138 - DNA, 779 bp, Triticum aestivum
  unsure (1)..(779): unsure at all n locations
  Clone ID: PAT_TA_58138
gtcaggcctggctcggatatgggcggcttcacgcggatccttcactctggaaagccggatggtttgatggatgagatacccaccttagtggttgaccccctccctgaaggcgccgatcggggttacattgtcctcaatagaccctgggcatttgtccaatggttgcagaaggcgaaaatcaaggaggattatatacttatggctgagccagatcatatctttgtgaagcctttgccaaacttagctcacggtgaagaacctgcagcatttccgtttttctacatcaaaccaactgacaatgagaagatactaaggaagttctttccagaagaaaaaggtcctgtctcaaatatcgatcctattggcaactcccctgtgattatccagaaggcccagcttgagaagattgctccaacctggatgaatgtttcgctaaaaatgaaagaggatgtggagacagacaaagcttttggatgggtcttggaaatgtatgcatatgctgttgcaagtgcattgcatggtgtgcaccacagcctccaaaaagatttcatgattcagcctccatgggacgcgaaatcagacaacacattcatcatccattatacttacggatgtgactattcactaaagggtgagctgacttatggtaagatcggngaatggcgttttgataagagatcttatcttcgctcaccaccaccaagaaatctttcattaccccctccagggagttcctgaagtgtggccacccttgtgaagatggtcaatgaggccactgc

SEQ ID NO: 58139 - DNA, 617 bp, Triticum aestivum
  Clone ID: PAT_TA_58139
cgcacttgtggaaaaaatgcagacctgcctcctaggacacacaccctagcctggcaccgaaaaacgcctcccggggcctctggacgatgccgcatcctatatcagggctaccggcgcaggtggaggatccccaatggggcgattatgggactaaccatggatgatgggtggcggaacgtttacgggaggcatggaaaattcttgaatatctttttgcgctgaggaacctcctagtgggctacgtccaagcgtgatgggtaccggacacagaactattgtgtgatgcattggtcatccttactccggagcaggaaaagaagtgctcaatgtggcggccccaaatcaggatatgccgggaggtcggcccttgctaagggcgcagatcagcaccatgacggcgaaagacagcctactggcgggtggtggtttctatggagagctgatctgcaagtatgttgatcaacctggagtggtgttctgtactaacctgtccggctacaagatgtccatcaccaacgccgtcgagatctacaagtcatcaaacggctccatccggatgatggctgccaacaacgactgcgttggtagaacttttgcacggagaagtacagactgct

SEQ ID NO: 58140 - DNA, 478 bp, Triticum aestivum
  Clone ID: PAT_TA_58140
gtcgcactgtgcacgccttcttctcgcgctgttttcagacagcccgttcccttgatcgtgtgcgtatgctggatagagcacaggcacggagtgaatcgctccaatccatccatgcgctgcactaattacatgacgatgcatcatgactacgcttaacagagtactagtgtcacaactgcccgctaccctagctcgcacagaatggcgtcactctgtcattacaagcactgggcggacatggcattgcgttagcattcgcgagggccatacaactgatctgccgtattaaaacagcccgattccgcttggccgtgccacgtgtgagccacactgttgccttgctgggcgaaagccctgccagggtcagattccggtccgtgcccccgccgtagcgcgtcgacccgctctcagccgtgcgagcagactcgagcaattcgtcgacaggcgacggtttcggagccgacacccccgagcccaa

SEQ ID NO: 58141 - DNA, 358 bp, Triticum aestivum
  Clone ID: PAT_TA_58141
gaagctttttgcgagtgacatttacttcttctgagctagctcaagaaaccaatatggtctctaaccagatccaggtcagctaccatggccggctcagactaaggccttgctactgaggagaacatcggacaggtgatgggcgcgaccaaggacaatgtgggtctgacctcggaggtcaccaagcttaaggccggacagaccaccgaggccacctagcttaaggctggctacacggtcgaggtaacttagcagaaggacggtcacgccacggatgctaggaagtataaggtcggtgagacggtcgaggctctctaagcatatggcctatgatgccaaggacaagactgcgcagacggtt

SEQ ID NO: 58142 - DNA, 350 bp, Triticum aestivum
  unsure (1)..(350): unsure at all n locations
  Clone ID: PAT_TA_58142
gcgtccggttgcgcctcgctggagtgtattcagcgngcttgccgcctcagagcgcggcggttgccatcctcaggaacgcctccacggcttcgtcgccggacccgagcagcagtaggagcatgagcgcgggtaccgccgttgttctgtgccagggcgcgatcattttgctgctcgaagctntatctcatgggggggggggctacttaactgggagcctttgtgagggtgattgccgtggttctctttttttccggtttactagtggagctgcgcggtcctgcctgtctatcctgtatgcctgtccccgcgtttctcttcttcacaccgctgtgggtgatgcctattcttcc

SEQ ID NO: 58143 - DNA, 451 bp, Triticum aestivum
  Clone ID: PAT_TA_58143
gctgtgacagaatgatcactgctgggcctggggcaggggtgtaagcggcgcgcttagtagggaatctcaagagaaattatggtctagcgttgagttacacgaggtttgatgaagttgcactaggaggctggggccttaccgggacgccgcgtctgcatccttaccctggaggcaaaagctacacagaaaatcactcactggtgcaactgctcctggtgaagaaaagaaacgaggagaattgcttggagctgctaggcctgaatgccgccgagggctccccgtacctcacggccaaacaccaggctggctctgaagaccacacactaactggaaaatgctagtagcactattatatgagtcttattacggaaatgaatcgtagatggctggaaattatttcttaccacgtgtgttgatttcacatgagatgctctatgcgtgtaaagaaaat

SEQ ID NO: 58144 - DNA, 211 bp, Triticum aestivum
  unsure (1)..(211): unsure at all n locations
  Clone ID: PAT_TA_58144
ttcccgctcgaccacgcgtccgggggtggagtatgttttgacagctttctcactctcttctcttctntagtgctaatttgacagtgagcagagaacatgttaaaacatactcaccctcttcctgctctttacagcttaggcgctcactgtacaaatttagcactagagaagagaagagagtgagaaagctgttcacatcattcggggggcg

SEQ ID NO: 58145 - DNA, 757 bp, Triticum aestivum
  Clone ID: PAT_TA_58145
cttgtaactgtagaaaaaagtatagataacccccagaagtatcccgtttggatacataaccccctcatgttttaaaaccgagttcttaatcccctgaactattctaaaccagacatatcaccccctggcacccacttaagtagtttgggacgatggttttgcatatgtggcgcttgggctgggcccatcgaccggccacgtcggactgggcctgctgggtgcggtgtaaatgacgcccttgagcaagttcgacccagactcggcctcttcgcctcccaatttagcgtgagctttttaatttttcagcagtgtactacagcaaattgttgatcattatactgttctgtatgcaatgctatgttaaagaaggaaacttttgacaacaaatattttatgactgtactattctgtatggaatggtgtgttacaagatattttatcagaagtgtacatattattggcatcaaattcagaaatagacagcaaatttccatagcattgaagatcttaaattcacacaataagttccatggaatactcaggttcaacctgataaaagctacaggtctttgacatgcaaaactccacaaacgacacttaattgtcaaggaattttgatgtttcacatcaaataaaagcacacacttctatctggtgttacacatcaactacgtgacattgaaaaacaatctgggcattcactttttcccagtgagaagtcattccagcctgttatttctttgcacttgcatctgct

SEQ ID NO: 58146 - DNA, 290 bp, Triticum aestivum
  Clone ID: PAT_TA_58146
gttgttgatatgcgcaacggctcgcagctcgactcctatatggttcagcctacccacctcatgcttcagggggggtttatttccaccgtgtgagcacgagcaggctgacctctatctgtacctgtttaggctcagacgtgctctgtgtatctccgtagaatggccatggtgcctggccaatgaaggaaatgagttggccttctgtatttcgctacatgcttgccgcctgtgcgctatgctctttttggaactgacgtgataatgactggcaaacgtgtgccagtgcgacc

SEQ ID NO: 58147 - DNA, 679 bp, Triticum aestivum
  unsure (1)..(679): unsure at all n locations
  Clone ID: PAT_TA_58147
catggctcacggaagcttcattggaccgtgcggcaacgagccctatgcaccggatgctgcgcaacaggctgagagcgtggacatgactcttgcgctgcactatcatctatcctatgacagccaggtcaccggtgagcctattcctaggtgaacacttctcacccgaccggattacctgttcacacagatccaagtcgctgttcacaccaggtgggcgcaccaaagacatgagctttaaccgcagaattcgccgctgacaatgcttagaggaacatncggcagctccgctgttgtgcactcactatgaacacgtctctagatgacagatctgtgatggtgataacagaccagaacgccgaagatactgtggcgtacgcactcgctcacatgtacaagactgatgcatgcaaggatgagaccacggagcactcctaagacacaaacaaccgccatgggctacagtttgcacgaccaaactgatgaccatcgataccccgggccggacccgcgatcacctaaactatcaaccaaaagtatcacaccgccaccggacgaagtgaatgaacttttgaggcacaggaagcccatgccgaactcaggtgactgcactagagccatgtgagcccccgaggttgctgaatccacgcggatcatactatgggggatctgtatctggagc

SEQ ID NO: 58148 - DNA, 760 bp, Triticum aestivum
  unsure (1)..(760): unsure at all n locations
  Clone ID: PAT_TA_58148
gtcgttgttttatcaggaggagagcaccgtcaccatcacccaaccgtcctccccccctgattgtttcagattggaagtggcttgcacacataaatccaagcaagttgacgggaggattcatctgtgcatttgagggagactcctgcagcagttgggctctggtacggcaagttctgcaatgcggggtggagcggctatggagggaggacccctgcgatgacctcgatgcctgctgcagcgaccatgaccactgcatcaaaaaggaaggtactaactaagctacatacatattcctagcttcgggaagaaaggactagatcggtcaacacgggcttccctgaacaaccatacatcatgttgcgttattttgacatgcgaattcaattgctagcaatgattgatgggctgagccagcagtgacttttgtggctagaaagtttcagactttttagtctctgcttgctctattctgttctttcatttacaaccactatttgaacagctctgcatgataggtataacaagttgtgttgtcgtcttattctcgaataactagctgcaactgcatttgtgttgcgttgtggcgtgatcattggatggtggattagcaccagtgcctaactatgttcctagaatgtaaaatttggataagcatagttcacttttgtatctcagcctagattgattgaaataattgcttgcanaaacttatatggtaggaaactaaaaactagataagatatgtagatgcaatcttttg

SEQ ID NO: 58149 - DNA, 180 bp, Triticum aestivum
  unsure (1)..(180): unsure at all n locations
  Clone ID: PAT_TA_58149
acattggttcaggttaacatcagcttctgctgtgaacctggggcgttcctgcatcttgtggaggaactagctgttgatgatagcagacgagagagctgttctgagtgcatgactttatacgagatctcggntctactttagggccgggcttggggtttttccccttgggggggggggggg

SEQ ID NO: 58150 - DNA, 729 bp, Triticum aestivum
  unsure (1)..(729): unsure at all n locations
  Clone ID: PAT_TA_58150
ccggattcccggccgaccccgcgtccgaaacatccccaaacccccaaaactcccatcccatcccatcaccgcttcccagctcagctctgctcattctcttctcttctccactcccgtccttgttcctcgcgctttcgttgttgcgctccacactcctctgttcctctctcatcgagccaagattttacagagttcgaaaaccgttattatcccggcgcctcgcggcaggcagaggacggctcgcctgctcgtatagttgctgttacatttctgctcgcctttttaaataaagaaggtaaagaggaggaggaggccgtctttattgccttcccctgctcgcatcgtcactccgtcctcctcactgccgtccctttggtctttattcccctgctgatccgcgcccccgttcaatcgttcgtcagctcgctcaggcgcagcgcggctaaggctgcagcttcctttcctgctggggccagggggctcgttttcagctttctaaactgcgtctgtcttaaaggggttttgggtgagagagacacccttcgtgtgcttccggtggtggagaagaagagttggcgcgtgcctgttcgcggtcgcgcacggtgcgtatctactgggacgatccccgacgtgacggactcgtccagcgaggacgacgagggctgcgccgctcggagggtgggaagggatggtgccggnagcttccgccgcccccggcgccgctggtgc

SEQ ID NO: 58151 - DNA, 154 bp, Triticum aestivum
  Clone ID: PAT_TA_58151
gcagggccggtcttggctcttattttttttgagaacgttgacactttattaattaagcaacaaagttacatagtcttgcggatacagcccggagcggcagaatgaaaaatacaaagactaacaaagtttatacaagacttggtacatgggccag

SEQ ID NO: 58152 - DNA, 721 bp, Triticum aestivum
  Clone ID: PAT_TA_58152
taatacagcatttcgccgctcttttaattagatttttttggccttcgtctccgcttcgtctcgtctcgtctcaccaccgccagtccaccaccagctagccggaattccctcgccggagaggcgctgaggcggcatacctaggaggaggagcgaagaatgaggagtggaggggtgcccgctgccgcgctcgctcgctagggttaggtgcgcgcgtgcgtgaggatggagctcgctctctgagctcgcctcgccccccccgctgagggcattagctgtgccgtcgctgcgcgctgggtgatccgccctcctgtgagctccgggggagccgttttggcttgcgccatggagccgtctcttccgggcgcggccacgggttgcgtgttgcggtaagctcctggccgcgacaagctgaagcggatctcgactgccgatctggtgctagcaggatgccagctagaatcatggagcagaggcaccacatgcccccattccacctccccgtggagtccgaatcgtcttctcccatgtgaaaaaatatacattgatttcgggaagtaggtctgctgcatcttctccggtcgaaaagccaaaggctattggccaaaggttgggcatcaattagggcttatggagccatacaagttgatggaccagaaaactccctttggtgagcgcaagttggtgggccatcaaaggcatgttaacctgccgccaaccccct

SEQ ID NO: 58153 - DNA, 406 bp, Triticum aestivum
  Clone ID: PAT_TA_58153
ggaggtgggtaggggagaggagaggagaggaggcgtgagcactaggaaaagggggagggagggttgaatttcattattaaggatgaagaatacgctaaacccaaaaaaattggggcggccacgctagagggacccgcgtcccgtccgctactttgccccttgataggtttcttatgggggacataatttgatgaagggcccgtcttttctaggtttgcggttggaaaaacccgggtggaccccaactgaaacgcctagccacaaactcccctttgaccgcgagggttaatgcggaagaggcccggccggggagcctttcctaacatttggaacacctgaagggcaaaggggaccccccctgctgcgggacttaaagcgggggggcggggggggttacccccagaag

SEQ ID NO: 58154 - DNA, 447 bp, Triticum aestivum
  Clone ID: PAT_TA_58154
gtggggcatagaggcctatgaacatatcgtgagcacctactagcaacgtggatactgactatcacttaatatctccatgcacacttagacagaccgggcactctgcgccatctgctagctagccctggaaccaagcaagaccgactttgactggaatttctgctgtaatgtttgcttctttggctctatatgatctattaggggcactatgctcacgagattgagacctaaggatgacgccaacggtatcctgaacgtgaaggcggaggacaagggcccagccatgtagaggaaccacactatcacacacgagaatgggagcctgaaccactaggatatcgaccgctaggtcaaagacgctggccgagctttccacaacaggacagaatggtaaaaccctgcatttacgcaccttaccagctttagacgacagtctactttatgaag

SEQ ID NO: 58155 - DNA, 593 bp, Triticum aestivum
  Clone ID: PAT_TA_58155
gtgctgaaaggatgaccattttgttaaattaacaaagataattgttgcctataactactgcagtggcttgaccaattccaactacacggaactcgctcagttgtatgagaagtacaaggaccagggttttgagatccttgctttcccatgcaaccagtttggtgggcaggagcctggcactaacgaggaaattgttcagtttgcttgcactcgcttcaaggccgagtatccaatttttgacaaggttgatgtcaatggtgacaatgttgcacctgtctacaagtttctgaagtccagcaaaggcagtctcttcggagacaacatcaagtggaacttctccaagttcttggtggacaaggaggggcgtgttgtggatcgctacgcgccaaccacctcccccctcagcatcgagaaggacatcaagaagctgctcgcgagttcttaagccttgttgctgcgtcaactagatgcattggtgcatcacctgaagcttcagtataatgttgtaataaaggctctgcagtccaatctcgtagttgtgtatgtcatgtaatggatttcgtggaatgtgtttcttctgctgcagagatacc

SEQ ID NO: 58156 - DNA, 752 bp, Triticum aestivum
  Clone ID: PAT_TA_58156
ctctggttgtttacactgtaccgatagtttttaggcttcaaagcttcagaatgcaatcactatcatgaggcagatactttttgatcctttttttcaagttaataggttcgttatattttgatctttgatctctgttatggatacggttttgtaggttgggaagttgtgagtttgtatatcaccaatgttatatgtgccacaccatcattatttatgaaattggcatctttcctatttagagaagttgtgctatttccgcaaaatagattctgttcaactatgtatttatcaaaggcagtaagcttcactttctccctaaggtatgtgggtttcccttatagagctgttatctccaaagaacatttggtgaatagagaaaggtgtttatgagattgtcatttgcatgtttaggctatccaacctagcagggatagaagtttgaatctctggacttgtattttttttgtgtgtgtgtgttaggaacagcactagcatagtaattaattttgatggtccaaaaataacgttgacatagtgaagggcttgcgccatatgaaaaatttatttggtaactacattgtcgtgccacatggattggatgtcaacacggtattgatctcacccagtacaccatttgtaataataaccaccgcaaatcaaaaatttgtctatgtatctaactggctgtgatcggagttagatcattttctggtagaaggaaagacatgatcttattgacaactttagcagta

SEQ ID NO: 58157 - DNA, 693 bp, Triticum aestivum
  unsure (1)..(693): unsure at all n locations
  Clone ID: PAT_TA_58157
cgacgatgcttgtctcctattccctaggtacgccgccgccgcgtctgtcgatctctcttcgctctaggccactgctactcttgcagccgccgtttccagtttccactcatccccaaacctggttcctcccgatccctcacctcttacaaccgaggatgaatcattggtgtgctgccaccttgagcgagatgccgccgatgcgcaaggaagatgtgaaggggcagaactacactcgcaaccggcaaccctattgaggctgcagcggtggacgccccttgacgggcaggcggcgagaatggcgcggtgaagaactctcgcgtcctgattccagttcgatgtcgcatttgacaaccggcgccagggagaaggtcaatgctaagcaaccaagcagtaggattatccgtccggttctatcaatttttgcagtcgttgtgtccgtgttgtgttcgttggccggtgaccgattcagttttgcatatggggatattaatgtggatatttgattnttagttcaagtaattgngttcctgccatttctatctgtacatacatccaatttctaagcatcagaggtaatcagtccagtcaaccagaaggttntgattctctacctgtcggcattagtctgtactgtactcttgtgcctgttttctgcctgccccctgtctcctatgtggctctctgaatcctgct

SEQ ID NO: 58158 - DNA, 328 bp, Triticum aestivum
  Clone ID: PAT_TA_58158
tgataccgtatggccagtcgtccggatgcttatgtttaccagggcccgtggcccgtagatactttgcacagcacactcctccctttggctatgtgttgccactcgacgtgaccgggagctccacagctttgcttcccgctgtcgcttgtgcagatgctgcttgcagccctccgtagtcgccttgccgtttctttctacggtgctgtgttggttgcagctctcgtatgatctctgtggtcagcggcacacttccttcgtatagcagtctgttgttgtaatagtacgctgtattctactataactgaggtctccctctcattcttggagc

SEQ ID NO: 58159 - DNA, 497 bp, Triticum aestivum
  unsure (1)..(497): unsure at all n locations
  Clone ID: PAT_TA_58159
tcgctgtccgaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaagggggggaccggtgtaggggacctctgggtggcgcccgctgttcggccgccgtgcttcctcttctttgggtgttcctctaggttcattttttttgtcggtcgtttggcagcgtttttgcctgggaaacccttggcgttccctggcttgtcccccttgtggccctttccccctttttccggcttttggccatttggccttttcccccacgggccgcctttccaaacagtttcccacccttggctggttccttggggccccccctgtcgcgcccctttgggggcgctgggtgggggggttttttgcggtgttcccgtttcatttcctctcactttnacgccccttccttccccttccttcccttcctttctcgtccgttttgccgcctttcc

SEQ ID NO: 58160 - DNA, 711 bp, Triticum aestivum
  Clone ID: PAT_TA_58160
cttaggcaccgcccgccgccgccgctgctcccaggacagcagccaaggaagacgaaaccaagcctccgccatgccgaaatccaagcgcaatcgctcagtcaccctgtcaaagaccaagaagaagccggggctagagcggaagggcaaggtggtcacggagatcaaagacgcgattgagcgccacagcagcgcctatgtcttcacctacaacaacatgaggaaccagaagctcaaggacctcagggaccaactcaagtcctctagccggatattccttgctggaaagaaggtcatgcagatagcattggggcggtcacctgctgatgaagctaagacaggcctgcataaactctccaagttccttcaaggtgcttctggattgttatttacaaatctcccaagggatgatgtcgagagattattccgagaatttgaggcgaatgattttgcgaggacaggaagtattgcgactcaaacggttgagctaaaggaaggccctctggaacagttttcacatgaaatggaaccctttctgcgcaaacaaggactgccagttcgcctaacaaaggtgttgttgaattggttgcagatcatgtagtatgtgaagaaggaaagcccctttcaccagaagcagcacacactcttgcgcgtgcttgggacgaaatgggcgacgttccgactgtaccttgtctgccgctggtcgtccgatga

SEQ ID NO: 58161 - DNA, 207 bp, Triticum aestivum
  Clone ID: PAT_TA_58161
ggattccctacagtggccaaatcccggcgccgctcgtgatctctgcctccatcagctccacctcgccgtagcaatcagtccagaggaggaggtgtagctagtccacctggtccacccgatttttctttaacattttctttgtgatgcatgctcactgatggatcaacaactatttattgatatggagatgcgctcctgctttttttg

SEQ ID NO: 58162 - DNA, 304 bp, Triticum aestivum
  unsure (1)..(304): unsure at all n locations
  Clone ID: PAT_TA_58162
cgccgcggaccgtccgtatcccggtcgaccccgcgtccgcggacgcgtgggcgacccacgcgtncgaattgattgagagatcgttcgttatcctactggagtctgcagaagggatggcgaccaaggtggtggacctgcgctcagacacggtgaccaagccgtcggaggccatgcgggccgccatggccgcggcggacgtggacgacgacgtgctgggcgccgacccgacggcctgccgcttcgaggcggagatggcgcggatcatgggcaaggaggccgtgctgttcgttccctctgtcaccat

SEQ ID NO: 58163 - DNA, 298 bp, Triticum aestivum
  unsure (1)..(298): unsure at all n locations
  Clone ID: PAT_TA_58163
cactacggaaacgatatcatcaaccgccagatctaccttgacatgctgaaccattgcccatgtggagctacaactctttgaactactatcagttcatgattgacgcctgtactacatgcgcaacctgtgtacgggcatgactatgtttatataagtccacctggaatatatcattgggagcattgtgagcactataccacaagaacggtctattcacctcccctagtccttgggcgtctgcttcncgggagcctgttcttcttcagatcctgagattaccgatactggctgaggagac

SEQ ID NO: 58164 - DNA, 310 bp, Triticum aestivum
  Clone ID: PAT_TA_58164
gccccggaaatcccccgggcgcgccacacgctgcgcgacatgtaaaagaaccagacaacagaacacaagaatagaaaaagcaaaatacaacaacattgctgactttttcctatacagaacccctaaaacaatacaactagatactaaacatactgctgccaatgacaaggcttttttggtgaacctctccgctccctttatctggcagtttttccgtcatgcccaagagaaggctcttccgaatgccgactatatgtttgtaaatgaaactgaggcgggaaacctctgtaaagccccaggtagatacact

SEQ ID NO: 58165 - DNA, 393 bp, Triticum aestivum
  Clone ID: PAT_TA_58165
cgtccgcgatcctcccgcgaccaagcaccgacaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacttggaggtgaagggtaccggcacctggaaccagtgcccgaccatcgacgggggaagtaagtccttcccct

SEQ ID NO: 58166 - DNA, 118 bp, Triticum aestivum
  Clone ID: PAT_TA_58166
agactcgccctgtatcggcgcattagtcccggcggtgttctatgagttacgcccaagttgaccgttccaatttccggcgccctaacgccctctcctttagatttattagcttcctttc

SEQ ID NO: 58167 - DNA, 323 bp, Triticum aestivum
  Clone ID: PAT_TA_58167
gtgccacgtgatccgcatatctccgatgctatgcgactagggacttgatttcagtttgaacatgtcatggtagcatgctgtgcactactcatgaccttcctgcgatctcttcgtagcagtcgctgcagtgcgtgtcttccaccactgcgaaagtctgtatggtgctccgaagagtctgctatgatggaaccgctcgaggattctcacttcctgaggctgttggtcaatgttcttggcagttgtgatacctactggaggaagtatcagcgagagggcctatgcttcttctgaaccatttattatgctggctctgacaagtgtca

SEQ ID NO: 58168 - DNA, 542 bp, Triticum aestivum
  Clone ID: PAT_TA_58168
gcggtgaaaaaataatgtgacatgcactatcatgtaagaacccgaactatactagttcaaacttgggaataaaagacaaacacaggtcttgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggtgggggagaggacaagcccattttaaaagaaaccaaactttaaaaaccgcttgaaataaaaaaaaaaaaatgtttttaaaaagggtaacccaaatttaaaaaaaatggccccgttgttaaaaaaggcgggaaaacggaaaaaacccggaacgtaaacaaaataacaaattgtgaaaaaaacccaattttaaaagggggggtaaaaaggaaagaaggctaaaacgaacgccctttaaaaaaataccccaagccgaatggaaaaagggaacccccccttaagggcccaaa

SEQ ID NO: 58169 - DNA, 478 bp, Triticum aestivum
  Clone ID: PAT_TA_58169
gtggccaatgaaaaaagcaagatctatactaatagatagatggatagtcgttacttagcagatgcaccaatcgatgtaacgatgacaaataaagtggcgtgcaccatcatgtgtgaccccgaccagtgctagttcaagcttgggaataaaagacaaacatgagttcttgtttgccaaattagaaaacaaaaaaaaaaaaaaaaaaaaaaaaaaaaaaaaaaaaaaaaaaaaaaaaaaaaaaaaaaataaaaaaaaaaaaaaaaaaaaaaaaaaattctattgtataaccaaaaactatattaaatgaaacagctatttacaataaaatgccttggaattttaaaaccctgtcattattaaaacgtttggggtggcataccattttggttttctgaaataacggcttagagaagaggaccgatcgccttgcccttccgttccgtagcccgtttggaaaggggaacgtgccccaccgtgg

SEQ ID NO: 58170 - DNA, 271 bp, Triticum aestivum
  Clone ID: PAT_TA_58170
aacaaaaaaaaaaaaaaatttttgggggggcctttttaaaggttccattttttctttcccttgcttgcgacgaaaaagcttttaaataggggccccaaaattaaattcacgggccggggtttaacaacggcgggacgggaaaaacccggggggaccccaactaaatccccttgaaaaaaatccccctttccccagggggggaaaaaaaaaaaaggcccccaccgatcccccttcccaaaaggtgcccaccccgaagggcaaaggggacccc

SEQ ID NO: 58171 - DNA, 773 bp, Triticum aestivum
  Clone ID: PAT_TA_58171
gccggggacaagcacaagcatcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggtttcaagggttccatccaatctcagcagcagcaaccccaacagttgggccaaatggtgtttcccaaccccaacagcagtcgcagcagcaactcgggcaacaacctcacaacaacattggcacagggtacctttttgcagccca

SEQ ID NO: 58172 - DNA, 783 bp, Triticum aestivum
  unsure (1)..(783): unsure at all n locations
  Clone ID: PAT_TA_58172
tgtataccatgttctcgggatcggtggtatgttcctttagtgagatcgataaaatattatcattgctttatttctgtaaataagtgatctgatcacaagtttatgttctttttgttctcgggatcatgctctctttaggaaccatttggcacagtcatcatttaaacttgttgatcctattttatcattgtaaaagtttaaaatggtcatgcttattagtatcctactgctttgtagcactcttaaccattgattttcactagcaaagttcaaagcatgcattgtttggagatctacttcactaggacattctctagtcagttcgctgttcactaccttgctcttgtcaaatgcctttacttgaggacaagtaaagatttaagtgtgggggaacttgataagtacatttcctattcacattttggcacacaaacacaccatttattgtgatccaacgatccattcttgttatgaactatgatatatttgaatgaaaatcatataaaagatcatttacttgtcatttgattattttgcagaaaagtgcgcaaaggcactataaacttcaagattcggacaaattggctattgagaagagagaacagcaggaaagaagtgaagaaagggacttgagcgagaagaattgaagtaatcaaggggccaagctatagatggcaggacctacttgggaagaaagaagagaaatagcagggccaaatcgtaagtggcagacagggnnaggggatcaaaatccttgcgcatactcaattcccttcgggcctg

SEQ ID NO: 58173 - DNA, 626 bp, Triticum aestivum
  Clone ID: PAT_TA_58173
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaaaaaacaaagttaacaaacgcgggaatgcaaagaaaaagttttttaaaagggcaaccaaaataaaataaacgggccggggttaaaaaacgtggaaacggaaaaaacccgggggtaaccaaattaaatcgctttgaaaaaaatccccttttcgcaagtgggggaaaaaaaaaaaaggcccaaaccaaacgcctttcaaaaaagttgccaaccctaaagggaaaagggaaccccccctgaagcggcaaaaaaagcgcggggggggggggggtaaccccaaggggaaccgtaaaatttgcaagggcctaaacgcccgctcttttggtttttttcctttcttttctagcaacgttcgccggttttccccgaaaagtttaaaaaggggggctcctttaagggttccaattaagggcttaacggaacctcaacccaaaaaaacttaataaggggaagggttaacgaagggggcaatccccctaaaaaacggtttttc

SEQ ID NO: 58174 - DNA, 723 bp, Triticum aestivum
  Clone ID: PAT_TA_58174
tcacgcgcagggcctcgtcggcggtgctgcagcgcatccggtccttcagcatcttctccttcccgtcctcgtccttcccaccgcggagcctagcccgggtgccgccgcggccatcttccacgaaacagaggacgcggggacgccgaagacgaggtcgccatcgacgccccgtctaccacgcccacacgcgacggccgagccggctagatccgcaaaagaggacgtcgtggaagacgagaattcgatgagcatggacgaggcgtatgcgctcgccctggcggggcggcagcgggcggcgccgacggaggaggaggcggcggggtccgaggtggacgccaaggcggaggagttcatccaggggttcaaggaggacctcaggcagcagcgcctcaagtccatcttcaactacacccagatgctcaagcgccgcgccgccggcggccagccgcctgccgcaccagaatgataccgtcgctcgcatcgcaccgatggttggttggtctgctcgttccgcttccgtgattggctcacgtgatcgttgaaagttcagaccaactcaggattgacttgctgtcatggacgtcgccgccggcacagcagccggtctggtccaccattgattcacatgttcattgcttaattttttattttctttagagaggattgcttcgcgtgtttggtttaaaaaaagggagagctggcctttttgagttgcttgctctc

SEQ ID NO: 58175 - DNA, 151 bp, Triticum aestivum
  Clone ID: PAT_TA_58175
gtacgagcatatgccatggtggcttccgtgcacctctggtctcttactaatgtgttacaagaataatcttgctggtgtgaaataagttgtcatgcttcagagtcttaaaatgtattgttcacttctctatatagatttggacttctgaggt

SEQ ID NO: 58176 - DNA, 701 bp, Triticum aestivum
  Clone ID: PAT_TA_58176
tttgcgtctttcagagtttctaccatcaaatagtttcccataacagaatatttgctaatattggtagctaacaattgagatacttatgcttgttgatgccttccctttttgtagtaacatccatgtgtccagcatatgtagaatattagaattttattggctgtttattgtagtttgttctcagggtttggaaaattctttagctatattccttgtctcaagcgagcatgagcaatatcttctttatgccgcatgccgccaagtttctctattttaaatggttgtgtctttccgcttctaaaaagggatatatattttattaatctgactataatttgtggtaggtacatattgaaggatgttctgaggctagcacctggtttagaagttttgcaattcacagcaatacctcataattttgatttgatgtccagaatgtcaattgaagaatgagcctacaaactacattggaggttgtaatatatccttatatatggggcttgtggtttttttttcaattataagtttacatttatgggtattacaaagtccccctttctttttccacaggggcagtagctgtgccattcgattcgaaggacaaagagttgatcacaacgggggtagcattcaggatatatacccaagagtttagaaccaaattatatgatgtaattgaccactatttctattaacttttc

SEQ ID NO: 58177 - DNA, 345 bp, Triticum aestivum
  Clone ID: PAT_TA_58177
gtgaagcggtgcttctgctgtagctgaacaaacaaaccttgaccaccaccagcagctgttgctgcagaaagtgatgtagtattctctgtggagggaaacaataataaagtgtttggttttacaaaaaaaaaaaaaaaaaaaaaaaaaaaaaaaaaaaaaaaaaaaaaaaaaaaaaaaaaaaaaaaaaaaaaaaaccaagtataacgaaccaagttaaagaaacgggacaatttaatggatagggctaactaaaattaaattaccatgcccatttatctacaccgacggtgaaaaaaaaagggattgggaaaccaaatttagttacccaggaaaaaacatcttcct

SEQ ID NO: 58178 - DNA, 482 bp, Triticum aestivum
  Clone ID: PAT_TA_58178
cggacgcgtgggcggacgcgtgggcggacgcgtggggcgacgctggggctcaacattgcggtgtatagacaagcttaacattcatgctggaattacctgctagatcgatgctcaactaagcaggattatccatgcacctggcggtaggggaaatggtgcaagggaggttgtcgagagctccttggggagtgttgtaaacggctctgcaatgcattgtactgacgtctgcaacattatccagggatgaatccagagcgatctccgcgggttattcctatttcatcgcggtcgtgcaagcagattttaacgagaagccgagagcctgccgcccagggacagccagagccctccctgcagcatcagccatggtattggctattactgtagatgaagttttcattcataattgactaataaactgtactcataccactagcatgtgacagtataacatagcgcatggcaatgtcatatgaataaaa

SEQ ID NO: 58179 - DNA, 178 bp, Triticum aestivum
  Clone ID: PAT_TA_58179
ccgggatgccgagccgaaggccggagaggacgcaacgatcagagcgcccgggtcggaaacaatgtgcattcaaaaaggaaggtatattacaatattcacaatgaactagtggttttctttcattttcttctataatcacaatgaattccaaatgaaatgacaaaattctttgaacttg

SEQ ID NO: 58180 - DNA, 620 bp, Triticum aestivum
  Clone ID: PAT_TA_58180
cggacgcgtgggttttttttctcttctgcttaccatgtctgatccatagagatgttgctaactctcccattcaatgtagtggacgaactgcttttgttttgttcgataaatagctgtgagatttgttgttgggtttagctggttgaaattgacatttgaacttaatggtttattctgcacgcaaaaaaaaaaaaaaaaaaaaaaaaaaaaaaaaaggcggtctagataaaaaaaatataaagttacacgtacatgcgaatgcaaaaaaaatactatatatatagcgtaaatctaaattaatgtcacgtggccgtacatctacaacgactgggaaagccaaaaccctgccgaaaccaaacttaattggactagaagcacattctccctatctgcagctgtagtaaagaggaagaggccgataccgattgccattactaacagatgctcaatgtgaaaggggaatggcacgtgccctgtagcattaacatcaagcgcggtgggtgttacgctcacgcgcaccgttacagttacacattgccatagccctagcgcccgttcctttctttcttttctttttcttcacggccacgttcgttcgcctttccaggtcaaaatctaaa

SEQ ID NO: 58181 - DNA, 459 bp, Triticum aestivum
  Clone ID: PAT_TA_58181
ccatgtgcttgtctgttgctatggcttgagtgctgactactgctgcgccgccagggcacactcaaaggctgctgagcaactaaaaaatgctatgggagccacctctagaggaggagaggacgatgactgagcaaaagcttgacaagaatgctcgcctgccgtataagaccctaatatacgtaccacgggatgatattgcacatttgttatatatggtgcatgtaagttgaatcactacatccggggtctacaataccgggtagagcaaaaacacgttgtcacaatatctaacgacgtggggtcttatcccattgatgacaatcattgtattagagaaaagttccctgccttattgagatccgaaaaggaagaggatcaaaatgcactgagcaacaggccctataagcggctgattaagcgcatttgctgacaatggaacagcgcagttgtgacccataa

SEQ ID NO: 58182 - DNA, 786 bp, Triticum aestivum
  unsure (1)..(786): unsure at all n locations
  Clone ID: PAT_TA_58182
atccatatgaagacctttctcatccttgccctccttgctatcgtggcgaccaccgccacaactgcagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaattcttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaaaaacaacagttgcaacaacaacaacaacaacaacagcaactgcaacaacaacaacaacaacaacaacaacaaccgtcgagccaggtctccttccaacagcctcagcagcaatatccatcaagccaggtctccttccagccatctcagctaaaccacaggctcagggctctgtncacctcaacactgcc

SEQ ID NO: 58183 - DNA, 241 bp, Triticum aestivum
  unsure (1)..(241): unsure at all n locations
  Clone ID: PAT_TA_58183
gtgtggacctgctttggttgtatgtcttgtggcggtttgctttatttactaaagcggggcgaaagcctttttcggtagtttgtggagaagagttaagtagtagggtagcctttctatggtggcgatcgcatgctgtgtagcgagtgtagttaatttgatggatcatgttacaaaaaaaannnnnnnnnnnnnnnnnnananaaaaaaaaaaaaaaaagggagagacgatataaaaaataca

SEQ ID NO: 58184 - DNA, 587 bp, Triticum aestivum
  unsure (1)..(587): unsure at all n locations
  Clone ID: PAT_TA_58184
gagatggttggccccaacaacgtgagagagaagcagccactgatgggtgccgaggacttctccttctacaccgaggccgttcccaagacatactactacttcgtggggatgctcaacgagactcgtggaccgcaggcgcctcatcactccccctacttcaccatcaacgaggatgcactgccctatggtgcagccatgcaagcatcattggctgctcgctatctgcttgagcaccagcccgctaccgctgctaaggtggaacctcgtgacgagctgtagatggggggaggtaaggctctgtgccaaatgaagctgacttgttcgacgaggacctatcgccaggtgattatgcaactgtttgtacataatttcctgatttcagcgcattccaagcgagcagatgaccttgtgacggcattgaagcactgcgaatatgtgtttctgtggtaggtctcgttcgttttcgcatctgcacttagccgggtctacgtgtaatctttgagtgcagtgctgagacaaaataaaacacctcatggatgantggatgtattggggttgttaagagtggggtcagacaggaattttat

SEQ ID NO: 58185 - DNA, 750 bp, Triticum aestivum
  Clone ID: PAT_TA_58185
gcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcagcaacaacaacaacgacaacaacaacaaccgtcgagccagttcccctaccagcaacctcagcaacaatatccattaggccagggctccttccagccatctcagcaaaacccagaggcccaaggttctgtccagcctcaacaactgccccagttcgaggaaataaggaacctagcgctgcagacgctaccagcaatgtgcaatgtctacatccctccatattgctagaccaccattgcgccatttggcatcatcggtagtaactgagaagggaagaactctagtactagatatatgaaacaccgttt

SEQ ID NO: 58186 - DNA, 118 bp, Triticum aestivum
  Clone ID: PAT_TA_58186
ggaccatgcgcgttcccaagctgccggagagaggtggagaagctgaaggcggcgaacatcacggcggtctgcaagcaacccatcgtcattaatgagtctggagaaggagcgtatgtct

SEQ ID NO: 58187 - DNA, 382 bp, Triticum aestivum
  Clone ID: PAT_TA_58187
tttggatgtttgggttacttgatactacaaaactcttgtgatataccgtcaattgcttcggttccggtaggcccttgctgatggtttctttcacagaagcttcccccagtgaactgccacagttgtgggaaatgcgggcaaaatatttgctgtacctacatgtgtaagaattaaaaattttgcaactatacaagtattgaagtatatattgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaaaaaataaaaaaaaaaaaaaataaaaaaaaaaaaaaaaacaaaaaaaaaaaaaaaaaaaaaagaaaaccaaaa

SEQ ID NO: 58188 - DNA, 417 bp, Triticum aestivum
  Clone ID: PAT_TA_58188
ccctggcagtacaccaaacgtaaatagcccacgaagcagatagcaccttgtagccagcatggcgtgacagcagaatagacacgaaccaaaccaccttcccatacacaatgccacatcacagagtggcaaatggtacgagccctgaacagcgatcatcaaccagcaacaggaagtgacaggttagcagcgcactgaggactcggctacactacaccagtaccgctagatgccgcaataattacattctttgtaccattgctcttatcaccaaccaccaccgcgcttatacccagtacacactataaattaggctatcatccgatggaagcctgctaatttaatgaatatacggaacctcaaaacacaaaaaacttgcataatgatgatgggctcatagtactagagcgctacatgcta

SEQ ID NO: 58189 - DNA, 533 bp, Triticum aestivum
  unsure (1)..(533): unsure at all n locations
  Clone ID: PAT_TA_58189
tcgtccttctagaattcgcggtgcagttattagctgtatcgatctgcatcatctccatcatccgggtcgtcctcatgggatccgtgggatagttattgggcgtaatgatcggtgatgcgatggtgcgtccatgtcgggacctcgtgtgggtgatcgtctgtccgatgatgatttactatgtgagggccgtcctgctgttcatcgtgtcgttggctctgcatctactggggttcgaggtcagacttcatctgctgctgatttgcgtcgacggcacaaagagatccgactgggaaacgtcctgttaattgcgatgttgatcacgcggagccgttgtgtgcactcaaccttctactactttgtgtgtgctattttgtattgcaggttatcaggcttagatctgcttgcatattccttcattgttttgtgtcagtttgatatgaatacgtagcctaccttatgtattggaaactgttgttgaaaccgttgctgggtgatgtccagttcgaggaatggctgcatttgtgtttgcnnaa

SEQ ID NO: 58190 - DNA, 247 bp, Triticum aestivum
  Clone ID: PAT_TA_58190
ccaagccctatgcgagtttgctgattcggcccttggtgatgccttacaagatgtttatgcataaatatacctcccctgaaattggacacctctatgtttcctacactctggccgccgtcattttcttctgaaactaggagctttttgcatcaaatctggagctggtaccttttgcatcaaatttggtttccaaagtggggtagtgatgtattgctggacacattttgagtgatgataagttgcactc

SEQ ID NO: 58191 - DNA, 489 bp, Triticum aestivum
  Clone ID: PAT_TA_58191
cgttgtttagtcgatggatatgtcgatgcagcggtgacaaataaagtgtcacacaatgtcatgtgtgacccgcccaaactagttgtttaaattctgaaataaaataaaaataaagttgtatcaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgaaaaagaaaaaaatatttaataaaaaaaacataaattaaattaagtggtctgttattttaaaacgtaaaatattgaaaaaaccctggggttaacaaacttaatcgttttgaaaaacatccccttttcgccagttggcttaatagctaaaaggcccttaccgttcgccctttcaaacagttgagcagcctgactgaagactgttaccctccctgtagcggagcattaagccacggggacgtgtcttttacccagcaattt

SEQ ID NO: 58192 - DNA, 670 bp, Triticum aestivum
  unsure (1)..(670): unsure at all n locations
  Clone ID: PAT_TA_58192
ttttgtgtaagttatcataactcttcattctatgtggcattagtattaacatgttgaaacatatttctttttttacttagtccatgatgctagagtcaacacgaggtaaaaagttttgcgagaaggaaactatccagacgttggcaacattatttgatagctggcctgggatagacaacgacatctcatcgtgcaacatgataagtaaagtatttttctatttatcatggtttatttgttgtttctaatagctccacttgtagatttatcttccctttgcatccatcggccgatacatcttatacgtcatcgacaaagaggcacatcgtctatatattatggaccctattcaaacatcacaattgttagaggataataatttgaggcatgcattgaaatttaaaagctttgtaagggatttcaaagaagcactcgaaataaaggctgcctggttggaattccgatatatctaaatggcaacatttatttccaattggtatttcaatgagtatagacgggtaatgaattcataataaaaatatttatnttttgttatcactatattttttatattactaatttaaaaaactgcnaggaatgtgtctggctatttttgttttttattttatactctggtggaacggtaaaaaaatgggtcaagccggtttgc

SEQ ID NO: 58193 - DNA, 758 bp, Triticum aestivum
  Clone ID: PAT_TA_58193
ccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcaatcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaccgttttcttaatcgacagtttgatcgttgttagcggtgaaaaataaagtgtcatgcactatcatgtaagaacccgaactatactagttcaaacttgggaataaaagaatacacatgtcttgtctgcatatgatt

SEQ ID NO: 58194 - DNA, 393 bp, Triticum aestivum
  Clone ID: PAT_TA_58194
cgtacgtatagtaagttgctggtaaatatggtctctgataaataaagtgagtaaccatgcaaaaaaataaaaaaaataaagtgcgtacgtataccgtatacgtacgagagcccggtttgcactttgcacaatgatcttggagaacacacacccctctgtgttcttgtatgtattaataccccacactatatatgttctccatgtatgtatcaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagggactatgagttcaataaattcaaacgtcttttcacacggttaagaactgcgaaaactgtgaaaattgcggaactta

SEQ ID NO: 58195 - DNA, 500 bp, Triticum aestivum
  Clone ID: PAT_TA_58195
gcttgtgtcagtttctgtaacggtgatgctggcctcccatcccttgatgcgtactgatgcgtccatggtctgagatttcacagggcaaggtcgtgtctcacctttgcgttcaataaaattggatcccatcgagagtatccaaaccagtgtgtcaccctgttttatgtgtgtgtatgtccattccttgttcgaaataaaagccatcatgatggatgccaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaataaagttaacctaaattaaaaagggggcccctttttaaacaaaggaggggaccgacaaagggctttccaagccgaaacctatttttaattggagcccataaatttttttaacgggcgccaatttaaaaaacctggggcgtgccaaactcctggccttaccaaaaaaaaccctttgggacaa

SEQ ID NO: 58196 - DNA, 421 bp, Triticum aestivum
  Clone ID: PAT_TA_58196
ggtttgtgtgcatgtgtgtgcttctttaacaataataaaaatatacaacttgttcgataaaaaaaaaaaaaaaaaaaaaaaaaaaaaaaaaaaaaaagaaaaaaaaaaaaaaagaaaaaaaaaataaaaaaaacaaaaaagaaggaggcgtagctctagaggacgcagagctctaaaacaattgactgggacggcgttttacatcgtttgggggtgcgaaaacccagacggtgggcagcggattaacaccgaaggagactgcaaattaccgccggcgggaccaaattgaaaagaggggaggaccgatcacctttcccaaggtggcgcatactgaatgggcaaaggcacgcgccctttacagacgcatgaacagccggagtggtgaagggaacgcgcccggtgaccgctacactagccagcg

SEQ ID NO: 58197 - DNA, 660 bp, Triticum aestivum
  unsure (1)..(660): unsure at all n locations
  Clone ID: PAT_TA_58197
gtccagaacgcagagaagtacaagtctgaggacacggaacacaagtagaaggttgacgccaagaactccctggaagaactacgcctacaacatgaggaacaccatccaggacaagaagatcgcctccaagctgcctgctgatgacaagaagaagatcgaggacgccgttgacgccgagatccagaggcttgacgccaaccagctcggtgaggtcagacgagttagaggacaagatgaaggaactggagggcctctgcaaccccatcatagccaagatgtaccaaggcgccggtgctgacatgcccggaggatggacgaagacgcgccgtctgccagcggaggtactagacccaaaaagaggaagtagactaagttagtcgctcatatataacgagaaatacactatacaccattttattcagtactacaagccaatcatataacataaggntgaaaaatcatggacaacatcaacaaggtgtaccacaaccatactatggtgaggcatgaacaaagaactgcagcacgaatgtgggtaaatgctcattcaacctgaacacatatgacggcagcttgtcagatggaggggggcgacgcattgctctctagacaatgcaagaacactatgcagctagcatgacgcttgagcatgcatacacc

SEQ ID NO: 58198 - DNA, 470 bp, Triticum aestivum
  Clone ID: PAT_TA_58198
gagtatcatgcaatactagtaccaacaacccacacaggtggaccaatgtgtctcccaaccccaacagaacatgcagcagcaactcgtgcaacaacctcaacaacaacaatagccacaaggaaccatttttgcagccacaccacatagctcaatattgaggtgataacttacattgcactccgcaccctgccatacaatgtgcagggccaatgtgcatgttgtacgaaaccaccactaagatgccattatgcggtgacatctgagttggcgtctactgataaaaaaagatctctaggaatatatagatggatcaccgtaggctatacgaaggatatgttaatgaactgcagacaaataaagtgtcacacaacgtcctgtgtgacccgctcaaactagttgtttaaattctgaaataaaatacaaataaaggtgtattaagaaaaaaaaaaaaaaaaaaaaagggccgccat

SEQ ID NO: 58199 - DNA, 806 bp, Triticum aestivum
  unsure (1)..(806): unsure at all n locations
  Clone ID: PAT_TA_58199
cgactgcaaaccagtagcgcggaagggttgcgggagaacaattctccagtggtaaaatcccctgtccatcgctggttcgtgcagttttggaggcgaggagcgagtacggcggcaggatctgagcagagagccgggttactgggtcagtccggcagtaaaattccttgtctctccctcggatcaaggcgatgggacgcaccaaggcgattgacaacgcagatctgcaagaagtactctctctgcgtgatgattttggggttctgcagaaagacaattctctgatacgcacagaagtggcaaaactccaaaacgatgttcagtccatgagcaagaaacaatgggacatagccttgcaagttggagatgtggagcaggctatcatttacctgagcaaacaactatcggctataagtacagtcctgaagaacatggttcaaccaactacctctcagcaaacagataagcaacttcccagttctagctaggtggttaaatctcctactctgcatcaggaacaacctcgagacacaaccgacagactggaacaattaaggaagcaattagctgctgagaaggaaaaatcaaagcaaatggaagagttgcagtgtcagaacttaccaccaatttggacaaccaagcctatagttcctccagggtttgcaaaccaaggaagacaagagaatgctagtgctataggaactcctctgactacaaggcaggaaggacacactcctgttttcaacaagtattaccagcanaatagagagagacaactttgggcaggggtattacaaaacgtatgaaca

SEQ ID NO: 58200 - DNA, 416 bp, Triticum aestivum
  Clone ID: PAT_TA_58200
gtcacgggtaccatggctgccgctgctgcgcgcgcgcggacgaagtcccggagcccatgtaccgcgcggaggtccgcaactgagcacacgagatgcagctatacgtacctacgtgtgcgtacaactctacgtgatgttgttctgcacacgtacgtatagtaagttgctggtaaatatggtctctgataaataaagtgagtaaccatgcaaaaaaataaaaaaataaagtgcgtacgtataccgtatacgtacgagagcccggtttgcactttgcacaatgatcttggagaacacacacccctctgtgttcttgtatgtattaataccccacactatatatgttctccatgtatgtatcaaattccatgtttacagttatgggaatatgttattgtggaataaaatcatagaggaat

SEQ ID NO: 58201 - DNA, 306 bp, Triticum aestivum
  Clone ID: PAT_TA_58201
ccgggatcgagtgcgggcatggccaggacagtcgagtcgccgaccgaatcgggttttacaagcgctactgcgacatcctcggcgttggctatggtgacaacctcgactgctacaatcagaggcccttcgcttaattaattagctttacataaccccacacacaaaatgcaataagagcatcctctgatatgtatctgttataagttgtaactatggttacttctcataaggaactcaattaaagcattcagtatagatgctttggtattgagttttaccaaaagtattggctcttgctttgaggtg

SEQ ID NO: 58202 - DNA, 376 bp, Triticum aestivum
  Clone ID: PAT_TA_58202
gcaaaataaaaaaagaaaaaaaaaaaaaaaaaaaaaaaaaaaaaaaaaaaaaaaaaaaaaaaaaaaaaaaaaaaaatataaaaaataaaaaaattaataacgcaaagcaaaaaaaaaaaataaaattttatatagtgaaaacctaaattaatgtggctgcccttttttttggcaccgatttttactggggcgggccgtggcgtttctcaacttttttctttttgcagcacattcccctttcgccggctggtgttttacagcagaggcccgggcaggatcgcccttgtcaccaatttcaaaggctgaatggccattgcgcctttccctgttggggctttttaagagcgggccctgtggtggttcctttcaaccgagt

SEQ ID NO: 58203 - DNA, 704 bp, Triticum aestivum
  Clone ID: PAT_TA_58203
cgccacctcgtccttgagcgtgtgcgcgtcaagcctgctgcccatctcctcctcgcagctggtcttctctcttctctttactcgcttgctgtggactgcgtgctggactggcgatacgatagagaagtcgaagggatgtggggagactcgacggggctggacagcaccgccaagaggagccatttctccagcgccagaggggatgacggccagaagtcgctcgacgcagtggttaaatcggcaagcaaggaggccatccagtggggattggcagccggagtctactctgggataacgtacggtctgagaggcaaaaggacaccatgactggaagaacagcgcgatagcaggggcgattgcgggagcggcagtcgcgctgaccggggacaacgggcactccgaccacgtcgtccatttcgccatcaccggagccgcactgtcgagcgcggcgaccatgctctccggcatattctaagcggcggaacgtggggctagggctatgaaatttggagcaactcttgaaatgtggtactgtatttcccttaatttctccatgtacctttagacagtttgtgcactctgtcccatctgctagctagccctggaaccaagcaagtccgaatttcgttagaatttctgctgtaatgtttgctccttttgttctatatgttctattcgtggcactatgctcacgagtttgagaa

SEQ ID NO: 58204 - DNA, 623 bp, Triticum aestivum
  Clone ID: PAT_TA_58204
gtgcctctgcgagatgcatgggtcatgaataaatgtgaactttgtttcctgttgatggattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggttttcaaaaaaaaaaaaattttaaaaaaaggggggtaaaaaaaattttttttttttttgggaagaaaaaaaaaaaaaggcgcccccatttttaaaaaaatcctaaataaaaaaaaaccgggggaaaaaaaaaaaaaaattttggaaaaaaaaccctttttttaacacgggggaaaaaaaaaaaaaagcccacaaaactacccttctaaaaaattgctcaccccccaaaagttaaaagccaccccccctttaaggccaaaaaaaaggggaggggggggggttttttccgaaagggaacctttttttttaaaaaacctttaagccccagattttttttattttcactttttttttt

SEQ ID NO: 58205 - DNA, 556 bp, Triticum aestivum
  unsure (1)..(556): unsure at all n locations
  Clone ID: PAT_TA_58205
gaccacgcggccggaggaacgacccagcgccccgcgcgggagggaggggcacaaccaggacggagcaacaggcggacaagggccgcaaccaggacaagggcaacaagggcacgacccaacgnccacacggcagggaggacaagggcacgacccaggacaagggcaacgaggggactacccaacngggcgggggcagccaggacaagggcaacaaggctacgccagcccataccaggagagcgcggaggaccaggcggcccgcctaagggaggcaaaggcgcagcagcgcgcggcacagcgtgccggcaaggggccggctggagggcagcgacgcagggnccaccaggcagggagagaacgctcggaagcgggcacggcgcgggggcacgcaagcaccngagctacacaagaaacgcgacgcgngcgcacagcgccgcggggcactagaggaaagcccaacaagagcgcaagaagaagagccccgccgacgagccaccngcgagaaggggccccccccaaaaaaaaaaaaaaaaaagggggggcgggccaggggccc

SEQ ID NO: 58206 - DNA, 614 bp, Triticum aestivum
  Clone ID: PAT_TA_58206
ggagacacgttgcgggacaactatcgctgcgggccatccgagaatatgctaggttttactcttgagatacagaaggcaagcaagagggcggaagagcaaactcacagaaactcaagcataaaaaccctcatggccacaatgctctatattgaggaacaccctgcacttactggaaggatgatggcaagatatcttctggagcactagctgcagattgccgaccttgcctttcacgtgacgatgatatattaaagaagaacaatgaccactgataccgctgtctaagctaacaaaggagagtagaacacctaccttgctacaatgacgactaatattaaagcggccaactatagtgcaccatataccgcttcaaatgcacttgctatggactcacagacatgtactgcaccctgcacgctccgtgccatcagcctgagcacgataactcactatgacacacactgaccagatacaactaaaccctcatcatccagagcacaggcttcagctactactgatactaccacaactggatgaactgtgtgcggcgaaggctacatatccacaccgacctcatcagacgctgcatgtagatcgagtataaaacaaaccgg

SEQ ID NO: 58207 - DNA, 326 bp, Triticum aestivum
  Clone ID: PAT_TA_58207
ggcgccagtgctgcgcggcggtggttgctcgtgcgccggctcgaagggctcagatcggggcggcgcccgatctgctgctccgtctttggaggtgacctcttggggtcggtgacggcacagctgcacttttccctctacgggacggcgatgggtgtggcagtgcggcgcgtggcgaatggtagcacagtggtggtgttggtaggcgtcgttggcgtgctttggtcgcggttgcacgggcagcagactagagcgttagttggcggcgaggttggcctccgtcgacagcgcggatgcgaggcggttgctgcattgtggcttcaagagtc

SEQ ID NO: 58208 - DNA, 151 bp, Triticum aestivum
  Clone ID: PAT_TA_58208
tagtaagtaagaaataatgactacaccgttttctagtcaaggtttggtcgttgtaagcggtgaaaaaaataaaagtgacatgcacttatatgtaagaaccgaactatactaagttcaactgggaaataaagcaaacacatgtcttgtctac

SEQ ID NO: 58209 - DNA, 309 bp, Triticum aestivum
  Clone ID: PAT_TA_58209
cacgatttcaaccagaagaactggcctggacaacggaagatgaacttgtgagctctgagttaaatgctaaaaggtgtctgtctcctcctccgcttggaaatagttgttttgggacaaagggtgcagtggcacattgcgaggtttcggtgaactgccttgatggccgaacaatcaactttgtttttcttctttctgttggctcttaggttatgaaatgttgctggcgcaaacggtttatgaatagttatgcatctggagatatgatatgcctgtctgccatgttcattttgatgccgttccatgtggttt

SEQ ID NO: 58210 - DNA, 521 bp, Triticum aestivum
  Clone ID: PAT_TA_58210
cttcgaggcattgagcttgttgttcagtctttggctgaggaagggggagtcgactttgatggcataatgcaatcagcagcagatgacttgtctccatcatattctgaaggcggatttcaaaggggacaaggtgatgtgcctcaacaccaaaccgaaaagggaatgggaagcaggactggaggcagtacaagtcatggaaatgatgatgaggatgactactatggcaatgggggatatgataactatggcgagggtgatctgtatggtgatgagcactacgatcactatggcgatggggaatatgatgactatggagatgaggatgactatggctctggctatggcggtggcgatggcgatgatgatgattggctataaaagtctaatgatcttcaagtcatgccaaaatgtagttatgttagatatttgaaacactttattatcttaaaaaatgctgaagctggagggtacggaggacaagcacgaaagcgtatggcgccgccgacccgcgcacgttctca

SEQ ID NO: 58211 - DNA, 638 bp, Triticum aestivum
  Clone ID: PAT_TA_58211
cggacgcgtgggtttttttttttttttttttttttttttttttttttttttttttttttttttttttttttttttttttttttttttttttttttttttttttttccaaaaaccgaaactttgggccgagcgcccgtttaaaaggaaccaacttaacccccccgggcaggcaaagaaaaatcctttttatggggccaccaaaatcaaaagcacgggccgctttttaacaacgtgggaacgggaaaaacccgggggtcacccaacaaaatcggtgggcaaaaaatccccctttggcaaggggggtaaaaaagaaaaaggcccgcacggatgcccctcccaaacagtggcccaaccagaaggggaaagggcaccccccctgtgggggcccataaaccccggggggggggggggtaccccccagggggaccgttacattggccaggccccaagcccccgctcttttggtttttttcccttcctttccccccaggttcccgggtttcccccggaaagtttaaaagggggggccccctttaggggcccaattaagggtttaacggcccccccccccaaaaaaactggattgggggagagggccacacgtaggggcccctccccccgaaagacggttttccccc

SEQ ID NO: 58212 - DNA, 680 bp, Triticum aestivum
  Clone ID: PAT_TA_58212
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaatataaaggaaaaaggattaaagtatgcgggagtgacgcagtgttaggattttttttgggggggggcctatattcttttaattgtggggggctgggttcgcttttgggggttgggttttttttgggggggggcgcgcgcttatcttttttttttttttggcccttttttcttttttggggggggggttttttcccccgccgttgggggtgtcccccgggggtgccccctttttggggcttggggcccaccccttttttggggcgtgtgggttttgtgtggtggggcttccccggcccttttttccaacacttgcgcgggcctttgggccaggggttcccccctttttggcttcttttttggccgggggggggggggttttccccccaggggtttaccttttttttttgggtttgggtttcggccctaaggtttttttgggtccccttttccttgacacccgggtttggggggttttccccccggtttgttccaggggggcgttttttgggggttccccttttggggtttggggccccccccctcctaaagggctcttggggggggggg

SEQ ID NO: 58213 - DNA, 619 bp, Triticum aestivum
  unsure (1)..(619): unsure at all n locations
  Clone ID: PAT_TA_58213
gtaattaatccttacctgcagtttttgaatgttctattaacttcgcagcaatcaaaataaattaatataccaaaagaaggtgactattggtaaatatttatattgacaggttaaattggtctttcttatgagtgcatacacattctgtttgtgccttgttgactgcgaaagtacagggtaacacacatgtgtctttttcatttggatgagttgattttctttttcagccatgcaacttctatgtttggaacatgtgttcttccgagctgatctattttgccatttcctttttttacaggtcaccaatataatgcctttgcatccacaagtttctagaggtgtgtttggtcagctaaaaaggatcttctgctggaatatgtttctacctaaaacggaatcttatattttgcacttttgtcttttatgtaatgctttgacttatgaacctacaaatttatgcatgtgtacatgtagacctgatggatgtcctgttactggacttgatgcttatgtgtgcacgtaagcacgcagnatggatctttgtgcttttggctgtcttagacttgtgtatacacacacacacacattatctattaagtgatgcaatcttanattactg

SEQ ID NO: 58214 - DNA, 435 bp, Triticum aestivum
  Clone ID: PAT_TA_58214
ggaataaaagacaaacacatgtcttgtctgcaaaaaaaaaaaaaaaaaaaaaaaaaaaaaaaaaaaaaagaaaaaaaaaaataaaaaaggacaggcttacgtaaaggagcaatgaaaaaaaaaagcaagtaatatagagacatataatattcaattgacgtgagcctgaagttatacaaacgtggccggctggttaaaaccctggggggccgccaacttaattggcttgaaccacattacccttttggcagcagatgtaatttttgagaggtggggaccgatcgaacttgcccagcagcggtggaccttgcctggtgattgggacactccctgtagaggcgcattaaccccggagggggtgattaatccttgcgggggggggggttaacttgagagggccctatccactggccctttccctagggtccgttcctt

SEQ ID NO: 58215 - DNA, 645 bp, Triticum aestivum
  unsure (1)..(645): unsure at all n locations
  Clone ID: PAT_TA_58215
actggatggttgtatctgcagtatttgaaggcaaagaaacctccaccctgacatctgaatcgagcaacggtgatagatcaacttccgaccttccaatctctactcccttgagtgatcccatcaacaacaaggtcaacatgttgttgccatttctgccatttactttgtttagtgaaaggaaacctcgaatctcactgcttatattcactatatttgtcataggtccatttgctcaggacaatgcttcaatgggaggagcaagtacgccgtcgagcatcggtagcggagagaagtctcggctcgctgaccgatccaattcttcgtgaggtggccatcatctgctggccgtatgggaagataatgaggatgagtactggcagcacagctgctgacgccggtagaagaatgggtgtggatgggaagctgctttgggtgaatggccaacttgtgctgcctcaaaccgagctcaaggatggagatatagtggaagtgaggacgtagtagttctcaggggaattgatcagattggctcattgatacatacaggggatgcanaatgcaaaagaatgatagacgtagccaaaacctcggaagtgcacagtccatctgtggaaatggaaaataatcgaaagaagcaggcaggga

SEQ ID NO: 58216 - DNA, 600 bp, Triticum aestivum
  Clone ID: PAT_TA_58216
gccaaggcgcgtcgtctcaacctatatcgtcgcttgcaataataataggatacccatacgagaagtaatcccaaaccagatgtagtcaactcatgttattatagtgtgatgtattgtccatgtccttgttacgaaataaaagccataatgatggatgccatgttgctgcccaatataaaataaagaaaaccaaaataaaataaaatggcaagggctttcacatctacagtatctaggataaccttggcgttacccaaataaaataccttttatataatcccactttaacccaatgactgacagtgaatagacccgacagattgccttacacaagtggtacacacttaatgctattggaacccaccctgtttcgccttattaagcatgacggaagaggcgattacccacagcctttcccattaactagccagcccccaagcgcaatgtcatttggcttgcttcctttcatttatcacaaggtcggcggtttttcccgtcaagctgaaaattaaactttccatttacctatccccatatagcgttttacttcacctctaccccaaaaaactcgatcagggtgttgccccatgaagcggtaaa

SEQ ID NO: 58217 - DNA, 513 bp, Triticum aestivum
  unsure (1)..(513): unsure at all n locations
  Clone ID: PAT_TA_58217
gggttaccatggggcgcagcgaggacgcgacgcacccggacaccatccgcgccgccatctccgagttcctcgccacggcgatcttcgtcttcgccgccgagggctccatcctctccctcgggaagctctaccatgacatgagcacggcgggcgggctggtgggcgtgggcggcggtatcggtagacggcatgacgacgtactcgtagaggagcccagcgatgccggagccgaggaagggcccgagccagtagacccagtggtgcctccaccgccacccgacgagcgccggcccgaagacccgcgccgggttcatcgcagcgccatcgaacggcccgccggcgagtatgttagccccgagcaggaaccccacggcgagcggcccgatggtgcccacgtggcccctcttggggtcgatcagcgtcgcgtagtaggcgtacatgagcnccgaacgtcatcaccgcctccagcagcaccgcgtgccaatcccccacccccgacgccagggagaaacc

SEQ ID NO: 58218 - DNA, 425 bp, Triticum aestivum
  Clone ID: PAT_TA_58218
gctggcaggcccaattcggttggttagaacgcagcgagctaccccatactaatcagcctcctaagtacaaaccataccaatatgtcctgtgggttgtggcactcgtcttgctgcttgtcgggttcacgctttcgttggtgatgctcttcaaaggcaagaacgggaatgacggctgccactggtgccactacctgaactgcgtgccgacgtcgaggtggaagtgcgatacctaggcggtcccttctttcggttttcgacgaaaacgcgtagtgttgagaggaccattttcatgcttgtatgtttgtagataggaactgtggtgttaattaagtttgttcgttagcgaattctgtaaatttgtttgccaggtcctgtaagtttgtaattcgagcacctctccagtgatttcatgcgtgtttttgtgt

SEQ ID NO: 58219 - DNA, 216 bp, Triticum aestivum
  Clone ID: PAT_TA_58219
taatacactggacgctgcaagaccaacaacaggactgaggaaaaccatgcaagctcaccactaaaatcgccctaagaattacatccaatgttgttgtcagaagcccaacataacgaagaggaccaaactcgatcaacattctcaacagcagcacatgctacatggtaaatgggacgagccatacaacatagcataaatcgaggtgatgagctgcga

SEQ ID NO: 58220 - DNA, 782 bp, Triticum aestivum
  Clone ID: PAT_TA_58220
gccaggcgaccgtcggggacaaccattggcacatggcaacgctcgccacagccgtatatcattattctaacaacaaccatatctgcaacatgcaaccatttccagcagccgcaactatcatattacgcagccacaaccatttcgaccacacaactatgtccacaaccgtaaacacagcattctcaaccacaacaaccaattacacagcagcatgctgcaacaacaacaacaacaacaacaacatcgaacagcaacaacacacaacaacaacaacaagaacaacagatgcttcaacaaattttgcaacaacaactgattccatgcatggatgttgtattgcagcaacacaacatagcgcatggaagatcacaagtctttgcaacaaagtacttaccagctggtgcaagacctgtgttggcagcacctatggcagatccctgagcagtcacagtgccaggccatccacaatgttgctcatgctatatattctgcatcaacaacataaacaacatcaactaccatcgagccaggtctgcttccaacagcctctgcaacaatatgcattacgtcagggctccttccggacatctcagcaaaacccacaggcccagggctctgtccagcctcaacaactgccccaggtcgaggaaataaggaacctagcgctacagacgctacctgcaatgtgcaatgtctacatacctgcatattgcaccatcgcgccatttggcatattcggtactaagtgagtagaaaataactctagggctagatatatgaaa

SEQ ID NO: 58221 - DNA, 505 bp, Triticum aestivum
  Clone ID: PAT_TA_58221
gggcatggccaccacgacagcctcatctacagcgtcatccagaaagaacaaaatgaggcgtcagggttacaatgcaatgacagagaaaaccctgcagcagccgaaccaaatgcgccttgcaacacataacagctttcgcaagatgaactaatacaaaaaacgcaacaacagcacgcgctacagaacacctgcgcacactcacagcagataggtacgctcgatgtgacgactcacatagcgctgcggatgctgccaacactgtccaggggaaacgtgcacttgcaaagaaccataactagcgtgcctttcgtcgcttgcattgctttctcggcactactgataaggtaagatcgttaagacttaacgcattgtgtatgatctaggatccaaagaatggatcaaccgaacctatacccagatactgacacatacatcgacgcaatacgtcacatagacattgatctgatagatcgtcagcagctgctttgaccatgtagtcacacac

SEQ ID NO: 58222 - DNA, 726 bp, Triticum aestivum
  unsure (1)..(726): unsure at all n locations
  Clone ID: PAT_TA_58222
gatcttcaggcagccactgttgtagcaggacgacaacaatgtgactcaacaaccatcagttttaggagcagcatacgcaccattgtgggaggagcaaccacgcattctttgagtatcaaccctacctagcacagcatctctgcattttggcaggaccaccttgtagatctaccgaagcaaccatcgtttgcacaggagctgcaactggtgtttacctacacagcagtcaccttgttcacatcattcatcagcaccaacagatggagcaacatcaaatatctgcatgttcagccatagcattatagacgcagctgaagccatgcatagtctattcctccagtagccgagcagacctgtgggaatgccacaacgtcgtgctagggcgcaaatgatgcagcagagcaggtgccatgtgatgcagcaacaatgctgtcagcagaatgccgcatactccccgcaacaaccacaacaatcatntccgccaacaacatctaccggagattcagtcatttctacaacaacagatgaacccctgcaagaatttgctcttgcagcaatgcaaccatgggtcattggtgtcatctctcgtgtcaataattttgccacgaagtgattgccaggtgatgcagcaacaatgttgccaacaactagcacaaattcctcaacagctgcagtgcgcagtcagtcacagcgtcgcgcattccatcatgatgcaacaagaacaac

SEQ ID NO: 58223 - DNA, 636 bp, Triticum aestivum
  unsure (1)..(636): unsure at all n locations
  Clone ID: PAT_TA_58223
tgaagtagctcccgtggagggtgagaaaactgaaaacggcctggcagtcgaatccacagtgccacctccagcatcttcagaggaaaagaaagtagaggcagatagcaccatcaatccggcgacccctcctccagctgaggtgaaggcagatgctccagcggcagaggcagcaaaagccacggagaatccagcagacaacgccgtccccgaagaacaatccgccgcgaacgtcgacaacaatggacagattcatccaggtgtttctaccgtgaggtgtacctgaaggtaggtttcctggaagacaggcgaggcgaggcgaaacggggaacaaacctggtctctgtttgctttgagaactgtaagcgtgtttaacctgacagcgcctgtaattgtaggccctttccgcatacttcacagcttgttgtcttatgaggtgctgcagggcagcaggctggcttgtgccgcctcggtcattattatcatttgtaacttgttagagtgcacattaatctcaggaggacatagacaatactntatgctgctgttgttgtaacctgacgacctttatgcctttgccttggtgttgttattcataaataagccatggaggcttgaacaannnaaaaaaaaanaaaa

SEQ ID NO: 58224 - DNA, 272 bp, Triticum aestivum
  Clone ID: PAT_TA_58224
cggacgcgtgggccagtggcgcctttgcaaagatcagggccagaactgacgattgaaatgaaacgaaatagaaacacaacaactctaaagaaataacatgcagttgcataattctaccgcctcctcttcaacacgatggagcgctcggagccctcctgctcgctgtcgctggagctgctgtcggcaggcggggggagcaccggcttccggtagaccttgtggaccacgaagacgacgtccgacgcctcagggtccgcgtgcgcgcggcggaa

SEQ ID NO: 58225 - DNA, 267 bp, Triticum aestivum
  unsure (1)..(267): unsure at all n locations
  Clone ID: PAT_TA_58225
gcggtggttcgatgagtgttctagctcttgtctctttttggtttgttcgacattctttttaattgtattgtatcttcatggtatgttcgtgccttgtctatataatgttatgaataaaacttgttgggttctgtgatnnnnnnnngnngncnnngnnccaaaacaaaaaaaaaaaggggctgggcggtctagacgatctaaacgataccaacctgacgtatgcgacgcatgcagacgttctatagctgtcatagaagacacactaaa

SEQ ID NO: 58226 - DNA, 132 bp, Triticum aestivum
  unsure (1)..(132): unsure at all n locations
  Clone ID: PAT_TA_58226
gccagccatgggaagcaagggcctcaagggtgtgatggtgtgtttactcatactggggttggttctggaacaggtgcaagtagaaggcaagagttgctgcaagagcaccctangaagaaactgctacaacct

SEQ ID NO: 58227 - DNA, 150 bp, Triticum aestivum
  unsure (1)..(150): unsure at all n locations
  Clone ID: PAT_TA_58227
cgtgtatttcgtgttgtttctggacagttgtaacatttttatgtatgatttatttgtagaggctattggttttctactacctaacaatttatttgtacctacaccagttgttgacgatgtgctgctgnnnnttttttttnnntttttttt

SEQ ID NO: 58228 - DNA, 216 bp, Triticum aestivum
  Clone ID: PAT_TA_58228
ggctcgactcaagacatggtggggcagaccacggaggtcacttaacacaaggccgaagataccactgaggcatacaagcaaaaggccggtgagactgtcgttgccaccaagcagaaagtcgtcgaagcctaggacaagcacggctcagactgcgcaagcggccaatgagaaaacgtacgagactgcgcagttggcctaagagcgcgccgtccaagc

SEQ ID NO: 58229 - DNA, 300 bp, Triticum aestivum
  Clone ID: PAT_TA_58229
gcaagagcaaggcttagtcaacccgctccccccaccgcatccatgagagcatgaccgaccgtttagcatgctaattgttatcactatcacttagtacttagtaggttcactatatatgatttgagggatgactctgtccactccgttttaagactctgtcctggggatgaaaaatagctgatgatggcggcacgtttgtgaatgaattaatcgatggaatgacctgttagactgcatgattcgtgatgattgttcatttgtggagccattttccgtttgacttgcatcctgatgattgtt

SEQ ID NO: 58230 - DNA, 512 bp, Triticum aestivum
  unsure (1)..(512): unsure at all n locations
  Clone ID: PAT_TA_58230
cccacgccgtccgaaaaacagaggcttatgttagctaatggagtactactagtgctattgatttggtgtttgtagccgggaggagagaataggagcggccgatgatgcttactgttggtggtagctttcgttttcgtttcgatttttgggtggagttggaccgcatgcaggctgggttcagatttgtttctgctttgatccgtccgtgcatagatcatcttccttttcctttcatgtatcgtcagctatattttgtcaactaaaaatcggttggatggagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaannnnggggggggcgcgttttaaaggatccaagtttacaaccgggggcttggaaaggttatagtttttttttaggggcaccaaaattaaattcacggcccgtggtttt

SEQ ID NO: 58231 - DNA, 405 bp, Triticum aestivum
  Clone ID: PAT_TA_58231
acgttcggattttgggacgactacgactcactatagggtaagaaccgcaagactgcgaaccgcccctatgatgaagagctctctggaactgtgatgagggataggatcatccgagctttcttggttgaggacgcagaagattgtgaacaaggcgtagaaaatacagaatgacctaggacaggacgacctcaaaggattctgcttgatacgtaagtgcgaagtgagatggtgttctgtaaacaaggaaaatatttttgtaggtggttatgatcaatggtttagtcccttctactaaatgttttagagtacttgaaatccttctgccgacgtgacatcatagattgtgaaacatttgatacccatttgcagtttcatttctgaatgcatgtagaatctacttgagtt

SEQ ID NO: 58232 - DNA, 684 bp, Triticum aestivum
  Clone ID: PAT_TA_58232
gcagtggcaagtatggttttgttcatggcctcatcaaggcattcgtggattctggtgccaaagcaatcatctcatcatctgtcgagcctccagattcccaggcaatcgcataccatgggatggatgtaagtggaagcctcgagaatgggaagtttgtcattggggatgatgaagctgatgagtcggagcctgaacctgttagccctataagtgactgggaagacagcgatgctgagaaaaacggtgaaggcaacaaagatattgatgaagaggagtacttggctcagtttatctgcctcttatatgacaagttgttccgtgagggagtcacagtggacactgctcttcaacaagcactccgcgcacatcctaggttgaagtacagctgccatctaccgaatgtttcgtagttagtgatattcacaacccatacaaaaatatgaaattgatgatactagaaaaaaataaggatcgtgtggattataatggggttatagaattctttttacgaggaaggggttatagagtttatactcgtgttcattgtgcaggcggaggaaagtgaatgttccccaattgaatcttttggcgaatgccgttgtaaaactgtagtacatagatcatgtactgatggaggctaatagaaaagcaaatgaaataaaggttgaaggctttgtactgtgt

SEQ ID NO: 58233 - DNA, 201 bp, Triticum aestivum
  unsure (1)..(201): unsure at all n locations
  Clone ID: PAT_TA_58233
gttgcccttgtcctgattgatgcccttgtcctgactgctgtgaagaagttgggtagtatccttgttgcccttgtcctagctgcaacggagaagttaggtagtaccctggttgcccttgtcctggttgttgccattgtcctggttgttgcggtagaactggttgttgntgctgcgaaaatggtgattgttgntgngaaaatg

SEQ ID NO: 58234 - DNA, 617 bp, Triticum aestivum
  unsure (1)..(617): unsure at all n locations
  Clone ID: PAT_TA_58234
gggggggcggggggctgctgatggagtctaggcctgctgaagtcgcttgcggatctagctcaccccgcctccggttgttggcagccccgttctccaccttcggagtctccttgtcagcggccctttttgatagaaatgggagtacagggaatatttagttaaaacagggaaatataaaagtgtattggtaattagaagttattaggtaggaacatagtaagaaaagggaataacaattgcttgcttaaatactacacaattcatttgacattgctgggtaagtcaacatgcagataattgaaaagaaaacttaatttgaacaaagtctggacggatgaattttatcgggaaagttagcatatatctcatgacaaggcccttttatgtgcagtgcaattttagtggcangctttcagtacataaaaattttcaatttctttccaaaagccagtgccaaaataggagtcaccacgttcatgaagtcttacagtagcaatgattgtaaatccatgngtttaatgtgcagtatgacatctgtggagccttcatctatgtaaagnggaaaaattatgcactacantaatctgttgcatacaagggggatgttctgcagaaaa

SEQ ID NO: 58235 - DNA, 479 bp, Triticum aestivum
  Clone ID: PAT_TA_58235
aaaaataattttttttttttaaaaagttccacaaatagcccacaaaaaaatatgggaggtaccacaaataaaagttacacaaaaaattgtaggacaagatgtttttttttacaacagtacataaacgatttgcacatcccaaaaaaaaattgcaaaactgaaaaaaataaaaagttgccaaaaaaggaacctagggttaaaaaccctacctgaaatgggcaatggttacatccctccatattgcaccatcgcgccatttggaattttgggtactaaatgaaaaaaaaataactttagtactaaatatataaaacaccgtttttttaatccatggtttggccgttgaagcgggaaaaaaataatgggacatgcactattatgtaaaaacccgaactatactagttaaaacttgggaataaaaaaaaaacactggttttgtttaaaaaaaaaaaaaaaaaaaaaaaaaaaaaaaggaaagg

SEQ ID NO: 58236 - DNA, 544 bp, Triticum aestivum
  Clone ID: PAT_TA_58236
tgggcggggagctccttgccgccgtgtaatggaatatttatgatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataattaaaaaaaaaaacaaaaaaaaaattaaatggaaaaaaatttaaaaaaattttaaattggaaaaaccctgggttaaacaaatttaaaacgttttaaaaaaaaatccccttttaaaaaattgggttaaaaaaaaaaaagccccaaccaataaccctttcaaaaaaatggcaaacctaaatggcaaaaggaaaccccccttaacgggccaattaaagcggcgggttattggggtaaaccaaaaggggccccgtaacttttcaaacccccaaacgcccccttttttagtttatttgccttgcttttttgccaatttcctccagttttcccccttaagttttaaatggggggtttctttcaggggtccccttaaa

SEQ ID NO: 58237 - DNA, 611 bp, Triticum aestivum
  unsure (1)..(611): unsure at all n locations
  Clone ID: PAT_TA_58237
cagttgagactggggctcatgacaacaatgaagctagcagcctacctaccttccagcaaaggtgcatgcaccaacataaataaacacagagggcatagcgcctcttgttcaggaacaagctgcactatatacacaggcatactatctgacacatgactaaacaacagacaagggcagagaggacatactcacacataaaacagggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggggggataaaaaaaaaaaaccggtgtgagggaggggaaaaaatttttaaaaaggtttcccaaaaaaaaaaaaaaaggacccctttttaaaaacggtttaaaaagggaaaaccggggaaaaaccccaatttacccccttaaaaaaccccccccctttaccccctttttgtaaaaggggaaaaaccccaaaagggcccccccttcacacctttttcaaaaatgtgaagggcnaaagggggcaccctttttcgcccccttataaccccgaaaaagggggggggtttgggg

SEQ ID NO: 58238 - DNA, 226 bp, Triticum aestivum
  Clone ID: PAT_TA_58238
ctctgggtgagtacctactactctgtatgtacgtacaagaacttaaaaaatgcgactaacagttactaactactactttcaagcgtagatgaaaaaagtcaaatttgacttagtatactatgtttgtgatacagtgtgaattgtggaaaaaaaaaaaaaaaaaaaaaaaaaaaaaaaaaaaaaaaaaaaaaaaaaaagggcgaccaaatcaaaaaaaacaaaccta

SEQ ID NO: 58239 - DNA, 159 bp, Triticum aestivum
  Clone ID: PAT_TA_58239
ccccgtcctcgaggtcctcctcgggggagctgtacatgtctggaataggcatagagacacccagatgacagttgcattcgagccttctaccaaaatgacaaactaatttatcctactagaggtaccaagtatctaagtaaatgttctcatgggatttgt

SEQ ID NO: 58240 - DNA, 702 bp, Triticum aestivum
  Clone ID: PAT_TA_58240
gaggaattttcttcctccctcatttttgtgtacattaagactgtaattcttttgttgtgctggtttttgattgatttacagcgacgggttatcagtcaaaatgtaatcagaataatatatccatgaataaagcttcttctgctttgccatcacatcttgcagaaattggatgagcaaactgttacaaataaatcagtggatgtatattctttttggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatcaaagtttacttcccggggctggcaaagtaaaattttttttttggggcccccaaaattaaattcacgggccggggtttaaaaacggggggacgggaaaaacccgggggtacccaaattaaatggcttggaaaaaaatccccttttcccaagtgggggaaaaaggaaaaaggccccccccgatcgcctttccaaaaagtggccaaccctaaaggggaaagggacccccccctgtaggggcccttaaagcgggggggggggggggggttccccccaggggaaccgttaaatttgcaagggccttagggccggttcctttggtttttttcctttcttttt

SEQ ID NO: 58241 - DNA, 404 bp, Triticum aestivum
  Clone ID: PAT_TA_58241
cgcaagctaaccggccggcctggccggatagcgtggccgaggaaagttatgcgtggatggacaagatctgaattctgaagaaacaacatctgtaattctgaagaaccatcgatgcttcctggttgggcgtctgatgcctccgtctctccggccggtcatcttgcctgaaccggaggatgtatcagatgcaccttggccttggcaccgccaaccggaggcagggcagggcagcatcaggtggtcggtgcctgtagcttctcacatgtgtccatggcaagctgattaagctgcccggatgggaggaaattgtacttggttctcggtcggcccgtgttgccctgtgccgatgatttttttcgttagaaacgaattcagaaaaaaaaatggatctgaagatagcaatc

SEQ ID NO: 58242 - DNA, 526 bp, Triticum aestivum
  Clone ID: PAT_TA_58242
aaaaaaaaaaaaaaaaaagaatttaaagtgattttaggtgttgggatgtacggtatatgggatttcaatattaaaaaggaaaaaagggaaaaaaaaaaaaaaaaaaaaaaaaagcaataaaaaaaaaaaaaaaaaaaatttgggggcgcctcctagggaaaaaaaattgttctgccgtggggcaaccgtaaagactgtgtttttttttggggcttcccaaatttatacgtttgggcggtttttgcccattccgcttgtgggggaaaacgggggggggcccagattgtggctgtgtgaaactctacctttttcccaaatgtgggaattggaacaaaagggggcccccgcgtatttgccctttaaaatggggggggttacagggggcgaaagggccccccttgtagtgcttaataaccgggccgggggtttttcccttccctttttggccccgttcttcggtttacccctttaccccctagattttgggtttctttttcctttttaactgaaaaggtggggggttccc

SEQ ID NO: 58243 - DNA, 468 bp, Triticum aestivum
  Clone ID: PAT_TA_58243
cccacgcgtccgaggagctgtgaccaggaccgggtcgggttctcacgtggaaggaaggacgggaacttggtgctgaaacaatgtggtctttacctgtgtttagattcttgaagctgggttctcttacgtttgtgtctcctgtttgttaactagtctgctactctcttgctgtgaaactgggttcgctttctctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggacgggtttaaagattaaaagatcaaaatctacgtacaggggacgtgaaaggttcttttattgggtaaccgaaaatccaaatcattgggccagtggcttaaaattgtaaaagattggaaaaaccaaaaacgtgaccaaataaaaaattatattcagcaaataccaattttcc

SEQ ID NO: 58244 - DNA, 287 bp, Triticum aestivum
  Clone ID: PAT_TA_58244
tccaaaccagtgtgtcaccctgtgttatgtgtgtgtatttccattccttgttcgaataaaagtcatcatgttggatgccatgttgcattgttgctgccctgatgtactaccatgactgagatataatggtatatgttgtggtggaaatggttgttgctgccctagaaattgttgttgttgtaccaatggaacttgctcttgtggctgttgctgagatggattttgtggctgcaattgtggcactggaactctaactgcagttgtggcggtggtcgccacgatagcaa

SEQ ID NO: 58245 - DNA, 196 bp, Triticum aestivum
  Clone ID: PAT_TA_58245
gcctgatctacagcggcgatcatgacatgattgtaccttccatcggcacgcaggcctggatcaggtctctgaacttctccgttgtggatgagtggagaccgtggtatgtcgatgcacaagttgcaggatatacaaggtcatactcaaataacctcaccttcgcaactgtcaagggcggtggacatactcacacata

SEQ ID NO: 58246 - DNA, 349 bp, Triticum aestivum
  Clone ID: PAT_TA_58246
ataatcaaaatttaaaataatagtgttattgtaaaaaaaatataaaaaaaaaaaaaaaaaaaaaaaaaaaaaaaaaaaagaaaaaaaaaatataaaagggcaggacgatttaaaggaacccaaggataagaacaaaagaaataaaaagaaaaaaatattaaaaaaaaggaaccgaaattcaattcaaatgggcggagggttaaaaccgggggaatgggaaaaacatgggtttaaccaaattaacccctttgcaaaacaagcccctttgaaaaaacggcggaaaaacgaaaaagccccgaccggtccccctttaaaacagttggggaacctcactggttaatgggacccc

SEQ ID NO: 58247 - DNA, 384 bp, Triticum aestivum
  Clone ID: PAT_TA_58247
cggacgcgtgggccgtggttgacccgaaatggttagtggagtagcgcaagattctacaagggcgcagatccaaccaagatgagcaagaggaagcgacaggaaaggattgagcctctgtacgacaggtaccacgagcccaactcatggcgtctcagcaagcgccgagcttgatggtccatcataataccctaccacaagttttggcggaactgtaaatacttgtgctctactcctagacactgttgcactaggtatttttacctaccggagtctagtcctggataccgttgtatggatatttagttatttacacttcagcgctcgaccattactgggtgattcagtttttccagtttcggataatttagatcggataatttagat

SEQ ID NO: 58248 - DNA, 762 bp, Triticum aestivum
  unsure (1)..(762): unsure at all n locations
  Clone ID: PAT_TA_58248
cggacgcgtgggttcaaaaagtcaaacggaaatcaaggcatgcaacatggtgttctacttcttgctaggaaatgttttcttcctgagtattctttcaggatctctgctccatcagataggagaatcctttacgcaccctaaagatatccctagccgtctagcaagtgctgtttctgcacagtcagatttcttcatcacatatatcttgaccaatggcatgtcaggcttttcctttgaggttcttcagtttggtttgctaacatggcacttcttgaaggcgcatactgttggacatagtgatgaaccatatctgtatggcttcccttactacagagttgtgcccattgcttcccttgcagtgttgattggaatggtgtatgctgtcgtttcacctcttctgcttccgattcttgtgatctactttttgctcggttatgccgtgttcatcaaccagatggaagatgtatatgagatcacgtatgacacctgtggacaatattggcctactatccaccactacatcttcctctcggtcacgctcatgcaaactacaatgatanggcttgttcggcctgaagtcgaagccaggagcttcattcgccacaatccccttgcttgtgttgaacatcatgttcaacgagtactgcagggtccggttccttccaactttccaatgccggccgatccagatctgcaaggacacgatgaccttgataaaactgagagggagggcggatgcagctcgaacatgctgtcagggcg

SEQ ID NO: 58249 - DNA, 741 bp, Triticum aestivum
  Clone ID: PAT_TA_58249
gtgaaagagctttcacaccaagcttatgcccaagaggtgcatccatttcaggaatcttctaatgaacctggattaaccttctacaaaaaggctagtttctgccttgtatgatgactctcataaaaccgctaatgaagccgattcgtcgcgtgacaaaaagttgaagaataaagatgtgatatcaggacaaatttctcctcttcctttgtccatttgcaatgagaacaatgaaattactcgtaatcaaggaaatgcagcattggcattacggtctgagctatcacttccttcactgccaccaatggcagcatttaaccagctgagttcatcttcacttgctccaagctgtcatctggaacaagcatcttctcagatggttataataccatctatgccagatagtcggcagctacggactttgttgcttggagcattgggacaaccaacagctgacccacaggaccgactattaggttcacaagagggtagtggaatagatgatcttcacaaggaggctatgctggtgaaactagtgctgggccggacactggtggagaattatgtcagaggtatttggtaatggctgataatgccaatgttcctttgttgccttcagcacagagttgtgaagctattttgcacgacaaccggctctccaaggacaacacggcagctgcggggggagtgtgttacttgttatgctgctccagccgaggacttgtctctcatacctgtagctac

SEQ ID NO: 58250 - DNA, 368 bp, Triticum aestivum
  Clone ID: PAT_TA_58250
cagactggttgattgatcgggatccgattttgctttctgatatttttaagcggaattattggtcttgacttggttgcgttgtggaactgtagaagtcaaaagttgtgtactgttccagtctgaacttccaatgctggtggcgacactgatcgtgcaagggggaggatcgccagcagcagctttcaaccatgcatcgtctctttgattcaaaggatcttcataggatttttgaaggattagaatccttaggaatgtttcctacgttggtcgtttgattcgtaggattgaatcttgtagaatttttttccaaggatttatttgtactacatttcacaggaattctaacatcctctcaaacctcttggaag

SEQ ID NO: 58251 - DNA, 128 bp, Triticum aestivum
  Clone ID: PAT_TA_58251
cccacgcgtccggtcctttatttctctgaaccaaagttgtgatgcttccactacatttgaacctgctattggatagacacagctatgtctatgtgtcattatatttgagataaatctgtgtgctatgt

SEQ ID NO: 58252 - DNA, 391 bp, Triticum aestivum
  unsure (1)..(391): unsure at all n locations
  Clone ID: PAT_TA_58252
cccaagcgtaagttctcctcagcaggggccatattatccaggccaagcttctccacaacaagccaggacaagggcaacagccaggcaaatggcaagaactgggacaagggcaacaagggtactacccaacttctctgcatcagtcaggacagttccagctggcatntttaatacacttnctntnatnaggcacagntgaatttnatnaanannaantntatntaaagatcccagctgatcttatcctnactgctccagagaagtngtccagtgcccntggtgtccttgccccagctcctgccatttgcctggccggagcccttgccctggctgctgcggagacgccnggcccgggtattttggcccctgctgaggagatcttacgcctggc

SEQ ID NO: 58253 - DNA, 527 bp, Triticum aestivum
  Clone ID: PAT_TA_58253
cgatgtaacgatgacaaataaagtggagtgcaccatcatgtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaataaaataaaaaaaggaaaaaaaaaaaaaaccaagggaaaaaaaaaagaattgaaccaaataaaaaatacccccatttcaaaaaaattttaaaaaggtaaaagacccacacaaatatgccaataccaaacagttcccacattttaaagggtaaagcaaactgccattgtaacgaaactttaactgtctaaaagttccccccacgtggaacgttaaaattaaaattaacctaaaccctacacatgccccttgccccctttcctttcactttacttacaacgttttcttctttccccctcaaattcccaaaccacggtttaaatttaaattttccctttaatttttta

SEQ ID NO: 58254 - DNA, 456 bp, Triticum aestivum
  Clone ID: PAT_TA_58254
tggatcttaggtggcaaaaattgtatgaaaatgtgagcttgtcaatcatcctgttatctttcagaaaggatcatattgttgctgagaatatggttaattcaagcttgtcaatcatcaaaaaaaaaaaaaaaaaaaaaaaaaaaaaaaaaaaaaaaaaaaaaaaggacgaaacgggctagagcattcaagagtgacccaagcttacatacccatgcatacaatgttatatagtgttatataaaagtcacctaaactgaacgcactgtcacaacgttttacaacgggaaaaccgtgaaaaaccctgacttaacccaacttaatcacattgcaccttatcccccttgtcgcagttgccaaaatacccgaacaggaccgcccttaccaacacttcccaacagctgaacagccaaaatgacgaacgctacaccccctcataaagcgcattaagcgcggtgg

SEQ ID NO: 58255 - DNA, 448 bp, Triticum aestivum
  Clone ID: PAT_TA_58255
gagaaaacaattgctttcatcggcaaacatggatatattcttaagtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaataaaaaaaaatagaaaaagaacagataggcctacccatcacccccctcattcctaaatggaaaatggaaaagggccctgtagcggcaacattaaaaacaactctataggcgggttacgcgcaggggtgaccggtacactttacattgtaaatagcccaaaaccccttaagctccccttcccttccttttttt

SEQ ID NO: 58256 - DNA, 624 bp, Triticum aestivum
  Clone ID: PAT_TA_58256
tggatatgtcgatgcagcggtgacaaataaagtgtcacacaatgtcgtgtgtgacccgcccatactagttgtttaaattctgaaataaaataaaataaagttgtatcaagacaatgttcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaagggggcccttttaaaagggccaaggtttattaccggggcattgcaaggtaatggtttttttatggggccccctaatttaatttcctggcccgttttttaaaacggcggggctgggaaaaacctgggggttcccaaattaatgggctttgaaaaaaatccccttttggccagttgggttttttggaaaaaggcccgaacggttggccttcccaaaaagtggcccttcctaaagggtaaagggcccccccctttaaggggccctttacccggggggggtgtgtgggtcccccccagggtggcctttcccttggcaagccccttaaccccgccactttcggttttttccctttttttttttccccctttggcggttttccc

SEQ ID NO: 58257 - DNA, 462 bp, Triticum aestivum
  unsure (1)..(462): unsure at all n locations
  Clone ID: PAT_TA_58257
cggacgcgtggngaaaaaaaaaaaaaaaaaaaaaaaaaaaaaaaaaaaagaaaaaaaagctgacggacgcgaagcatgcaaaggtaatagatctatgatagcgaacacctaaataaaataaaatggtacatcggaaaacactcgtcgggactggggaactccctgagagttacacaaacttaaaacgcctgtgcggcggatgcttcctttcgggcaggctggcgtattaaccctttgaggcccttggccgaataggcctttaaagccgattgcgccttccctctttggcgaaatgggacccagcctctgtagcggaacagttaatcccaccagggcgggggggttttaaagattccaggcttttacactcgccaatgcgcaaaaataccctttttttgggggcccccaattcttttttggggcccttggtttttctaccccgcaagggggaaaaccttggct

SEQ ID NO: 58258 - DNA, 569 bp, Triticum aestivum
  Clone ID: PAT_TA_58258
gcagccaggacaagggcaaagggcactacccagcttctcagcaagagccaggacaagggcaacaagggcaaatcccagcttctcagcagcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggcaacaaccaggacaagggcaacaaggggactatccaacttctccacagcaggcaggacaagggcaacaactaggacaa

SEQ ID NO: 58259 - DNA, 113 bp, Triticum aestivum
  unsure (1)..(113): unsure at all n locations
  Clone ID: PAT_TA_58259
tttactttcgagttttcgagtaatgaataaggtgcctcttgttgcaataatcataaagctaatcctgcttgtaattacatttcgtggcatggccattccggcaacatgtccnt

SEQ ID NO: 58260 - DNA, 500 bp, Triticum aestivum
  unsure (1)..(500): unsure at all n locations
  Clone ID: PAT_TA_58260
gctgtcgatggtggtgacggacgcctactggagggagttcctgccggagggcgccacccgggaccgccccgccgctcgcgtctgcggcgagcgcgtcgagctcgccgaggcgttcccgccggccatggtggtggtcggtgggttggacctgctcaagggctggcagacgcggtacgtggaggcgttgcgcggcaaggggaagccggttagggtggtcgagtaccccgatgccatccacggcttccacgcgttcccggagatcgccgactccggcgagctcgtggaggacatcaagctgttcgtcgacgagcatcggcctacgaagtcgtaggaaacagcaagcatccgcagtctttgcgtcgagcgtcgatgttggcgacgttcctatggggtgtcctgcgagatgtgaccgtgcaatggtaatggacaggctaaacttttcagccagctgaataaaacttgcatctgtagcgaanaanaaanannnnnnaannanaaaa

SEQ ID NO: 58261 - DNA, 555 bp, Triticum aestivum
  Clone ID: PAT_TA_58261
ctatttccacaacaaccatatccgcagccgcaatcatttacacagcactgacaaacttaatactcaaccactatcacacaggagcatgcatgcatggactagagagagagaagaaagagggaaaacagaacaaaaaagaagcgcaaaaggtacccacatctccattaagtacacacattctttcttccaacctctgcgggcattatcagttgttgcagcacttctcactcatcaccacaggttctgtctgatcttacacaaggggaaaactggtgaacttgtctcggtcttcttgtcttcctctctcctcctcctctcctcacacgctcattctcacctctggtccaggtgctcttctcctccttctgccattggtagcaaataaatgaaacaaagataagattcaaccaaccatgtgctcccaggagaatgctctctcttctttgtacatagcagcactccgttttcttgtttttaaaactactactaccagtctgttgggtgttatttccgtgccatttgtaatttggtctttgaaactccgtttgtgatttg

SEQ ID NO: 58262 - DNA, 443 bp, Triticum aestivum
  Clone ID: PAT_TA_58262
cagcaatgggagcatctgtcttgatatcttgaaggagcaatgaaagaaaatacacacaagcacataaacaaactgacacacttggtttggatactctcaatgggatcctgttttattgaacacgatggtgagacataactttgacctgtgaaatctaagaccaagcatatgcattattagtcatcaagggatgccaagagagtatcccccttacagaaattgacacaagcatcaacgcagctgctgacgatgaagagatgaaactctatgtggaacagtgtggtgatgcttgtgtcaatttctgtaacgctgatgctggcctcacatcccttgatgcgtaatgatgcgtatccatggtctgagatttcacagggcaaggtcgggtctcacctttgcgttcaataaaattggatcccctcgggagtttcccaaccaggggggca

SEQ ID NO: 58263 - DNA, 528 bp, Triticum aestivum
  unsure (1)..(528): unsure at all n locations
  Clone ID: PAT_TA_58263
tttcgcagcaacaagcacaacaacaacaaatccttaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggggccaagccatccacaatgtcgttcatgctattattctgcatcatcatcaacaacaacaacaacaaccgtggagccaggtctcctaccagcagcctcaggaacaatatccatcaggccagggctccttccagtcatctcagcaaaacccacaggcccagggctctgtgcagactcaacaactgtcccagttncaggaaataaggaacttatcgctgcagacgctgccagcaatgtgcaatgtgtacatccctccatattgctcgaccaccattgcgccattttggatcttcggtactaactgagaagagaagaactctagtactagatatatgaa

SEQ ID NO: 58264 - DNA, 316 bp, Triticum aestivum
  unsure (1)..(316): unsure at all n locations
  Clone ID: PAT_TA_58264
cactatttcagctagattttgttgtagtagattgccaggttaggctgaacaaagggcaatatagtgttttgccttctatcaaaagttggtgatctgaaatactgaacagaaaactattatgtagggggacgtgtggtgcagaaccgagtagacaaagaacatgctcaaagagggctctatctatcgaatctcaaattttgatgtttaagtgccaaaaagatatacaagcaatggattttcctacaaaaaaaaaaaaaaaaatttttaaaaaaaaaaaaaaaaaaanaaatataaannaaccaaantttnnnnnaag

SEQ ID NO: 58265 - DNA, 427 bp, Triticum aestivum
  Clone ID: PAT_TA_58265
cccacgcgtccggtcgatgcagcggtgacaaataaagtgtcacacaatgtcatgtgtgacccgcccaaactagttgtttaaattctgaaataaaataaaaataaagttgtatcaagacaatgttcatattggcattgtgtggatgtcaaaaaaaaaaaaaaaaaaaaaaaaaaaaaaaaaaaaaaaaaaaaaaaaaaaaacaaaaaaaaaaaaaaaaaaaaactaataaataaaaaaaaacaaaaatcaattaaatgaaaaaaggggcggcccttttaagggttccaaatttatgtacctgggcaggcgaacgaaaattttttttatagggccttctaaatctaattgaatggccgaaattttccaccggggcgcttgaaaaaccctggggaaacccaatttattagtgtgaagaacaccccctttt

SEQ ID NO: 58266 - DNA, 582 bp, Triticum aestivum
  Clone ID: PAT_TA_58266
aaaaaaaaaaaaaaaaaaaaaaaaaaaaaaaaaagggggcagcgctctatagaaagaacacaattatacacacgacgcgcgtgaaacgaaataatctcttatatagtgacaccataaataatttacatgtgcgcggaggtacacaccgttcgagtgtgaaaaacctgtggcgccccccattttaacgcgttttggggcatatcccctttttccacatgtggtgtaatggcgaaggggcccacaccgtgcgcttttcaaacacgtgcgcactccgagtggaatgtggtgcgccccctgtcgcgtttttttaagcgcggggtgtggggaggacccgcacagggtcccctttacttttgagagccctatagcgcgggctattggcgctctcccctttctctttctcaacaggtgggcgtttttccgcttcactctatatagcggggtctctttttagggccccaatagagcgctttttggcttcttccccttaattttttggaagagggagggggttcacccgggggcctttaacccggagacaccttttagccccctgtgttgggggttcacgcgctcttaacc

SEQ ID NO: 58267 - DNA, 477 bp, Triticum aestivum
  Clone ID: PAT_TA_58267
tcgccggcatcgagatctccttcacgctcacctccaagtcgggcgccgacgacgagaacgacgagttcgccgacctctacatcgtcaagtggacgtcgctcatgatcccgcccatcgtcatcatgatggtgaacctcatcgccatcgccgtcggcttcagccgcaccatctacagcgagatcccgcagtggagcaagctgctgggcggcgtcttcttcagcttctgggtgctggctcacctctacccgttcgccaagggcctcatgggccgccggggacgcacgccgaccatcgtcttcgtctggtccggcctcctcgccatcaccatttcgctgctgtgggtcgccatcaacccgccgtcgcagaactcgcagatcggaggctccttccagttcccctgatcctacccgtatatcatatatgagttacatgccatttgttccagcagcagcagcagcagcttgctggcgggggggg

SEQ ID NO: 58268 - DNA, 545 bp, Triticum aestivum
  Clone ID: PAT_TA_58268
cggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaggatcaaattttttgtccccggccttccaaacaaaaatttttttttttgggccccctaatttaatttccttgcccgggtttttaaaaccggggttttggaaaaacccggggtttcccaaatttattccttttgaaaaaattcccctttttcccagttgggttaataaaaaaaagcccccacccaatccccttttcaaaaatttgcccccccttattggcaaatggccccccccttttttcggccttttaacccggggggttttgggttttccccccagggtgaccttttttttttccaggcccttaagccccccttttttggtttttttcctttcttttttgccccattttggcggttttccc

SEQ ID NO: 58269 - DNA, 183 bp, Triticum aestivum
  Clone ID: PAT_TA_58269
taagtttgatgaacatgaccgcagctcacctcagctgcggctgcagtttgctcgttttaagggtccaagggggcaagcaggaggacctggtggtggtggtggcggcggcggcggcggtattaggcgttaagttgttgggtgtaattggtatctccaaatgatattaatatatttcatttgttc

SEQ ID NO: 58270 - DNA, 491 bp, Triticum aestivum
  unsure (1)..(491): unsure at all n locations
  Clone ID: PAT_TA_58270
tcgccggcgactggacggcggccggcggaggtcgatggatcggtcgaaggagtggtggcagaaggcggtggtcgtgccggtgaggcgcgcgtgggtcgtcgtcgccgcgcgcctgcgtcgcaagaaacagcatgatggccggggcggcgcgctggtgaagctccacgacgacgtgcagacgtgcgcgtacgaggacgtgcaggtcatgtgggagatgctgcagcgctccgagacggggaagatgatggccggggcgccgccgtccaagggctccgcgctggtctggctcagacctcgccgccgccgncactccattgacctccggccccggtgctgagcgccggccaacgcagcctgtcatcgtcagataatggagagagagtcagagtcagagtcagagtcgccctgctatatgcatatagctccttcgtctcctgcttgatgtaaatattttgcagttaatttcggtcaagaggtaccagtctctttat

SEQ ID NO: 58271 - DNA, 425 bp, Triticum aestivum
  Clone ID: PAT_TA_58271
cagccacttgttgtcatagcagttggtagcaccaacacacatgtagcatgttgcggaggaagcactcctactggatcggggaattcaaatagatagtcgaaactgctgctgtggctaacatacaaatcaacatggctattgcatgatgatcgatgccatgtagcggacctgaggtactaccatgaccgttagataacgagataggttgtgtcaagtcctcctggggcctgttgggcctgtctatctagaggaaccgaggttacagccacatgcgtgcgacggcagaggtctgctatagagacacctaaattcaatgcgctggccgtctatatacaacgagctgactgacaaaaccctgccacgacccaacttaattatcttgcaacacatacccatttcactcggccggcgtattacaacaagag

SEQ ID NO: 58272 - DNA, 556 bp, Triticum aestivum
  Clone ID: PAT_TA_58272
gcggaaaaccctttccactacaacaaaggatagaattccctagtcgcaggacagcaaaagaattatatgatagattgttgttctctgactcaaccacaacaaaaaagctatggtttgttcacactataccaacactgctcaaaattagtggatcggagctcattgaatgtttccaagagtttggcctatttacaagacttacaagtgtattagaaggacgctggatgaaaatgaacgcggatggtatggaatagaagagcgcagaaggtggcgcaaaatacttcccaaggaatgggtgactatggtgctgggtggtggacattacatcaagaatccaaagatgagacagatgtttgctggtggtctgcatgattatgccttggacacttgccaactgggtattgcatcatgtatgcatttgatatggaccttgaaattctgcatgtatttgaccccaaacgtacgtgcgccggcatacgcatactcgaaaggctacatcaggcaaactgtgaaatattgctggatggacttctaaaatgcgttgaagttttctttg

SEQ ID NO: 58273 - DNA, 419 bp, Triticum aestivum
  Clone ID: PAT_TA_58273
cgcaacaacaacaaggtatacagatcctccggtcctgtttcaactacgcacaaggccagggtatcatacaacctcatcaaccagctcactatgaggtgatcaggtcattggtattgagaacccttccaaacatgcgcaacgctgtatgcaccgtacctggactaggtccaccatcaacgcaccatttgccaccatacacccacgcctttgagcggacaactgaaaaatggaagagttatgctaatagggagatggatcatcgctgacttagctgatgcaccagtgtttgaagacgatgaggaataaagtgacgtgcaccatcatgtgtgacccctgaccagagctagctcaagcttcataataagacacaaacaaagttcttgtttgctaagcatgaagcatcccatcctatagttgtt

SEQ ID NO: 58274 - DNA, 593 bp, Triticum aestivum
  Clone ID: PAT_TA_58274
cccacgcgtccggtgcgatcgtgtgcctactcgtgctggggctggtcctggagcaggtgcaagtagagggcgtggactgcggcgcaaaccccttaaagtggcctgcttcaattcttgccttctcggtcctagtacagtgttccagtgcgcagacttctgtgcttgtcgactccccgcgggcttggcctctctacgcagctccgatctacttcgttttggcagatgaaccaaacgccattgagtattgcagcttgctgacaacactgaagagatgaagctctatgtgaaacgctgcggtgatgcttgtgacagtttctgtaagggggatactctcttggcatcccttgatgactaataatgcatatgcttggtctgagatttcacaggccaaagttatgtctcaccatcgagttcaataaaacaggatcccatcgagagtatccaaaccagcgtgtcagtttgtttatgtgcttgtgtgtattttctttcgttgctccaataaaagatatatggtggatgccatgttgatgcctgcttcatgtactgccatgattgagatataataatatatgggtgggtcatttatggatata

SEQ ID NO: 58275 - DNA, 485 bp, Triticum aestivum
  Clone ID: PAT_TA_58275
gggacgaacaaccttgcgtgcgaggcgaggccgctccgattcgacagacgcaggcgcagcgcagggatggacgccttctactcgacctcgtcggcggcggccagcggatggggctacgactccctcaagaacttccgcgagatctcccccgccgtgcagtcccacctcaagctcgtttacctgaccctatgctttgccctggcctcatctgccgtgggtgcttacctgcacattgccctgaacattggcgggatgctgacaatgctcgcgtgtatcggaaccatcgcctggatgttctcggtgccagtctatgaggagaggaagaggtttgggctgctgatggggttgggaaacacattggcccaactgttggggttgctgctgctgagattggatggaaccctgaacctgttgttgttcttgcaggatgatggagtagatgatagcacggattgcctcatagcgggattgctgggggggggggg

SEQ ID NO: 58276 - DNA, 633 bp, Triticum aestivum
  Clone ID: PAT_TA_58276
ctttcgttgctcaataaaagatatcatggtggatgtcatattgatgcctgcttgatgtactgccatgactgagatataataatatatgttgtatccttttcctatggatataaactctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccgtttaaaaaaaaaaaacttaacgtcccgaggggggaaaccaaaaagttttttaatggggtccccaaaataaaaatccgggcccggcgttttaaacccagcggaaaggaaaaaccctggggttccccaaattaaaatggcttggaaaaaaaaaccccttttgccaagggggggtaaaaaaaaaaaggcccgccccgaccccctttccaaacattcaccaaccctgatagaaaaaggaaaccccccttgaagggaccaataaagcgcgggggtgggggggtttcccccaaggggacccgttccctttgacaggccctaacggcccgccctttaggtttttttccctccctttttcgcaaagttggccgctttcccccggaaaggttaaaaggggggc

SEQ ID NO: 58277 - DNA, 280 bp, Triticum aestivum
  Clone ID: PAT_TA_58277
cggacgcgtgggccaggacctcggcgtgttcagggacctcaagggcggcgcgtggttcctgggcgccactgagccgtaccatgtcgtcgtgttcaagaaggcgccgcccgcctgatcgaggtccatgcggcgtgatggcgcgctcccgtagcgtgcatgtgtgcatctgaataaggcgggccgaaacagtgtgctgtttttgtctctcttagacaataagtgtggtgctgtgctgtccttactgcttaggcggttttgtgaaacgtgagaaacttttttc

SEQ ID NO: 58278 - DNA, 627 bp, Triticum aestivum
  Clone ID: PAT_TA_58278
gcacatgttcgtatggacattaacagctgggtgcagcaagacaggaactcatgggtcagatccagggatatacacaagatttggctcgttcagcagtagagttgcagcaggtggctgcagtgaaagctgagacccaagaactcaggcatgaaacacagcatttatgatccagtattgagcttgagaagaaaggatatgcagagagttatgagcagggacaagagatgcagaagaaattggtctcagttgcttctgaagtggagaaacttcgtgctgaggttgctaatgctgagaagagatcacgagctgctgtatctgcaggcaatcaaggttacgctggaagctatggaaatcctaatgccaattatgctgcaaatccttacaaggctggatacagcatgactcaagcaaatgctactgattctggttctcagtatggggctggggcagcgcatagttcctggggcgcctacgacatgcaaagagctccaggacggagatgaataccgacatcctcctcccttttcttttattattaaatctgggcctgttagcgaagtaacaaacggagatttctggcacaacctgatttctgtgcaatgttaatttatgacgagtcagatatgc

SEQ ID NO: 58279 - DNA, 546 bp, Triticum aestivum
  unsure (1)..(546): unsure at all n locations
  Clone ID: PAT_TA_58279
gtcacgtntccacgtactaacatgtgcccgttcccggtgtggccggcggtcgcgccaaacgccggccaccccgtgctcgccgcgggcggcttcttcctccctccgggacagtcgaagcgcgtcggggcaccggccacctggaacggccgcctctggggccgcaccggctgcaccttcgcggggcggggcgccaacgccgccagctgcctcaccggcgactgcgacggacgcctcacctgcaccggttccgtcggcgcccctcccgccaccctggtggaggcgcacctccgcgcgggcctgaggtgggggagctcgtgcggctagtgcgtgggggccgggtacaacctatgagtggccgtgttgtgcgggcccgggttccgtagggccgacggctgcatcgccggcagtgcctggggcgaagacgctggggggccctgcgttgctgttccttactgcggccggagtcgcttgcctcatggggcctgatgtggcatgtcggtgcgtgcggtttggtccttggcgtggacgcattcccctgacgggcgg

SEQ ID NO: 58280 - DNA, 606 bp, Triticum aestivum
  Clone ID: PAT_TA_58280
caaaaaataaaaaaaaaaaaaaaaaaaaaaaaaaaaaaaaaaaaaaaaaaaaaaaaaaaaaaaaaaaaaaaaatataaaaaaaccaaaaatacaaaacacaagacatacaacaaaataaactattatatgggggccccatttttaaaaaaacctaaaagggggcgcccgttttaaagaacccaattttccttcccgggcctcgccaaagtaaaattttttttaaggggcccccaaaataaaatcccgggccccccttttaacacccccggaaatgggaaaaacccgggggtcccccaattaaaccccttggaaaaaaacccccttttccccatttggcgtaaaaaaaaaagggcccacccgaatcgccttcccaaaaattgcccaaccctaaaggccaaagggccccccccttttacctcccctttaaccccgggggggggggggttacccccaagggtaacctttaattttccaaggcccttaccccccgcccctttagtttttttccctccttttaccccaaagtggggggtttttccccgaaaagcttaaaagggggggccccttttagggtcccaattaatggtttaagggccccttccccc

SEQ ID NO: 58281 - DNA, 240 bp, Triticum aestivum
  Clone ID: PAT_TA_58281
cgtgtatgtcccacctgagtgctccatcatcagggcaccatttgccagcatagtcgcggggattggtggccaatgaaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaaacagagttcttgtttgcc

SEQ ID NO: 58282 - DNA, 284 bp, Triticum aestivum
  Clone ID: PAT_TA_58282
gggcggcagcggcggcggctgcagtcaccgatgctgcgggcacggtggctgccactgctgtgccggccccgacgagatccccaagcccaagtatcgggcggaggtccgcaactaagtgccggatgcagcagcgtgcatgggtagtatagacttgctcgttgcacgcacgtagtaatacatggtgaataagaaggtagtgcatgtgtatgtatgtacgtatacgtacacattgcactgttatcatgatccaataccaggactccgttctggtcgtgtttttgttt

SEQ ID NO: 58283 - DNA, 472 bp, Triticum aestivum
  Clone ID: PAT_TA_58283
gccggggaagcacaagcatcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaactacctatttccccccactcttatgaaacagctccagcgcctgggccaccgtcatcccaccgggcacctggacgaacagcaggatccccagggt

SEQ ID NO: 58284 - DNA, 513 bp, Triticum aestivum
  unsure (1)..(513): unsure at all n locations
  Clone ID: PAT_TA_58284
ctagggcatcagatgctacgtcggctgtgcctacggcgtccgcggaggacctaaaaaactgggatgccaatttcgtcaaggttgacaaggccaccatattcgacctcatgctggctgcaaaccacctcaacatcaaggggcttgtacacctgacttgccagaccgttgccgacatgatgacgggaaagacaccagaggagatccgcaagatcttcaacatagatgacaaattcaaacctggggaggaggaggagatccgcagggagaaccagtgggcctttgagtagaggaacatctaggccccgctgaagtaatgaacgcttagtattacccatgtctacatttcattgtgctcgtttatgtcataatgggttgtaatgaaccaagcgtccataaggtgttgttgctgaacttattcagtggttatgtttgcaaaaacaaaaaaaatggtggtcattaattatcatctgtcaaatgagtcattattgtcnnnnaaaaaaaannnaanaaaaa

SEQ ID NO: 58285 - DNA, 596 bp, Triticum aestivum
  unsure (1)..(596): unsure at all n locations
  Clone ID: PAT_TA_58285
cccactcgtccgaattgaatccttttgtgattcttatatttcaactcaaaaaaaaaaaaaaaaaaaaaaannnnnnnnnnannnnnnnnnnnnnnnnnnnnnnaaaaaaaaaaaaaaaagggaaaaaaaaaaaaaaaaaaaaaaaacaacccctctaaaaattccaaatttacatccccttactttcggcccccccctttttttttcccaacctttcttccccttcccctccccctcttttttcttttttttgccccccaaatccctttccttccccccttttttcccctgcggactttccaattcccccattttccccaatttaataactttccaacccatcccccttttcccacttttggactatcctaataggcccttccacaccccccttccccaaatttttcccccctaaattttaattggtccccccccttttgcccccttttcttcccccccccctatgggcccccccccctcggtttacctcccttcctttcccgccccttttccccccttcccccggatagcttcccttcctttccccccccttaagccgccttttccccccctattctttaacctgggcccccctt

SEQ ID NO: 58286 - DNA, 497 bp, Triticum aestivum
  unsure (1)..(497): unsure at all n locations
  Clone ID: PAT_TA_58286
gaagctcaagaagacaaggaagaccggcggtatcatgaagggtggtcccagtctctaccaggtcgaccccagtggcagctacttcccgtggaaggcgacggcaattggcaagaagtgcggcgagcgcaaagactttcctggagaagaggtacaccgagggtcttgagctagaggacgctgttcaacattgcgcttctgacgctgaaggagacgatcgagggcgagatgaacggtgacacggtcgagtataatttaccatcaacagccagccagccctatgattgacaggatgaatatagcttggcaggcagtgccatgtgttgctgtctttgtttgcagcccctgatttcctgctactgctcttgaaagccatggagcgtctgcttgcagtgttgactttttgagagaggaaaaaaaatacacctggcatacgtgctggacacctcattggttctgagggaaaaaaaanaaannaaaaanaaaaaaaaaaaannagg

SEQ ID NO: 58287 - DNA, 274 bp, Triticum aestivum
  Clone ID: PAT_TA_58287
cagcgctaatccgtgaatccagggttgattccaagtacctccgtggctactcccttccactgtagtaagaaaggtcatttggttggttgagctgagtagaatgtgtaggcgacttgtttcttctttggtaatgtgttgacttgtcgaataaattgttcttggttggtgcaagtcgaggtttgcccatgtattgcaccaacaagcagaataagtacatgcctccttgccttgcattgcttgtaattctgtaactgtcagttggaaccatctgttg

SEQ ID NO: 58288 - DNA, 461 bp, Triticum aestivum
  Clone ID: PAT_TA_58288
aaaaaaaaaaaaaaaaaaaaaaaaaaaaaaaaaaaaaaaaaaaaaaaaaaaaaaaaaaaaaaaaaaaaaaaaaaaaagaaaaaaaaatataaaaaaaaaaaaaataaaaaaaaaaaaaaataaaaaaaaaaggggggtcctttttagagacctaaatttaatttacggggcgtggctaaaaaataattttttttttggggacccttaatttaactaacttggccgggttttaacaaatccggttttggaaaacccgtgggtttcccaaatttaacgccctggtagcccttccccttttttccacttgctgaattaaaaaaggggcccgccctgttgcgcttttttaaaatttgcgaacccttattgttaaatgaaacccccccttacactggcctttaacctagggggggggggtttttcttcctagggtaactttttcatttggaagggcctttttcccc

SEQ ID NO: 58289 - DNA, 269 bp, Triticum aestivum
  Clone ID: PAT_TA_58289
gctagcctccccctaccctggtctcacacatagcagaaaggccgccacgccctaaggcgggcagagcgtgcacaaaaccagcgacacagctgccaatactgtgagccatagcagcgggcgaagcacaggggggtcaccagggtagaacactctgaaagtgcatgggcttaggatgctacaccttatgtatccataaacatgacgcagtgcacagacatgatgttctacagaagacccataataatgcagataaaaagcttctccagact

SEQ ID NO: 58290 - DNA, 431 bp, Triticum aestivum
  unsure (1)..(431): unsure at all n locations
  Clone ID: PAT_TA_58290
ggagatggatagtacagggatgccagggagtggcattggagaagcgatgagagtcaatgaattgctcgagccacgtagaagtgtgagactaagacaactttatgaagaagaagaattcgattctgaagaagaggagtttgatgatgatgaggagatgcattcagatgaggagaatgactattgataattgaggaggcccaaatgcagggggtcttttcttaagtactttttttatcacatatctttatgtcattgagtcaaactgttcgtgtgtgtgtccgtgtggaatttccctttttgattgtgagagaaggcttcccaataagattctaggaattaaagaacttcattttgatgtgtgaactggtgagctcataatttataaggctatgctaattggggcttggggggnnaaaaaaaaaaannaaaaa

SEQ ID NO: 58291 - DNA, 290 bp, Triticum aestivum
  Clone ID: PAT_TA_58291
tggtttggtcgttgtagcagtgaaaaaataaagtgacatgcactatcatgtaagaacccgaactatactagttcaaacttgggaataaaagacaaacacaggtcttgtctaaaaaaaaaaaaaaaaaaaaaaaaaaaaaaaaaaaaaagaaaaaagggtgtaaaggtttaaaagataacaaacttagagaacgcgaacatgaaaacgaaatagggtggggcatagttaaaaaaaaaaaaaaattcactggccggaatgttaaaaaatagatattttaaaaagccacccaa

SEQ ID NO: 58292 - DNA, 525 bp, Triticum aestivum
  Clone ID: PAT_TA_58292
taagtttgtctttcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttttaaagaaccaaattttactacccggggctgggaaggtaaaattttttttttaggggccccaaaataaaattaaggggccggggtttaaaaacggggggaggggaaaaacccgggggtacccaaaataaatgccttggaaaaaaaccccctttttcccagggggggaaaaaaaaaaaaggccccccccgaccgcctttccaaaaattggccccccctaaagggaaaagggaaccccccttttatggggcattaaagcggggggggggggggggttccccccaggggaccctttaattttgcaagggcctaaagccccgtttttttggttttttccccttcttttt

SEQ ID NO: 58293 - DNA, 722 bp, Triticum aestivum
  Clone ID: PAT_TA_58293
acaagcacaagcatcaaaaccaagcaacactggttaacaccaatccaccatgaagaccttcctcatctttgctctcctcgccattgtggcgacaagtgccattgcacaaatggagaatagccacatccctggtttggagagaccatcgcagcaacaaccattaccaccacaacaaacattatcacaccaccaacaacaacaacccatccaacaacaaccacaaccattttcacaacagcaaccatgttcacagcaacaacaacaaccattatcgcagcaacaacaaccaccattttcacaacaacaaccaccattttcgcagcaacaacaacaaccattatcgcagcaacaacaaccaccattttcacaacaacaaccaccattttcgcagcaacaacaaccaccattttcacaacaacaaccaccattttcgcaaccacaacaaccatttccccaaccccaacaagcattcccagaacaagcagaacagataattccccagcaaccctaacaaccattccctctgcagccacaccaacctcagcaaccttatccacaacaacaaccatctggagtagcggtataggcatcaggggccaatgaaacgaagagctatagtactagaccggtggatcatcggcgtttagtcaatggagtgttcagtgtaacgatgataaataaaagtgatgtgtaccatcatgtgtaacaccgacctatactag

SEQ ID NO: 58294 - DNA, 503 bp, Triticum aestivum
  Clone ID: PAT_TA_58294
gtgggatggatcacaggggccgtctctcggagaatcatttcaagatgggacgacgctctccagatgtacgccatctccaccttctacatgcgcaacacaggcaatggccaaaggctgtacatcatatgcacactagacaccgcgaatagcagcaggcttcggacctaatcagtccttctatatagaggggggagggaaacagacggctgcgctggccgactggaagccaaacattctggtgaccggtgtcaacaccacttacgacgaattgcttggagtctgacccgtgcgaaccgctggcctgtttagagtcctacgcagcgatggccgggagcggagggatagagcatggacagggagatgggtgagaaacaggaacggagagcgagccatggagaccaatgacgagagcacgactgcgacaacaacaaacgcggtagcagaagcgggcagtccactaggacttgcacgtggacgaaactggcgaacaaggtcattggact

SEQ ID NO: 58295 - DNA, 172 bp, Triticum aestivum
  Clone ID: PAT_TA_58295
gcaatatgctttagaggttcctagacctcgtatggtgtacatacatgcactgatgtacaagaaaccacccaacgatgcgccccaggtggtgttgggttaatcggtagtttgtggtcgtgcctttgtaagtttcactgtttcactacaatcaattgaaaggcaattactaatt

SEQ ID NO: 58296 - DNA, 751 bp, Triticum aestivum
  unsure (1)..(751): unsure at all n locations
  Clone ID: PAT_TA_58296
actatagagatcatagtggaactaaatgatggcaaagtatgcatattagattccttgcttctgggaataattataagtgcttgaagaaaatagatctcatgcattcagatttatatatttcttgcactctccttctattatagtaaactaatatggctccacactatttacattgtttagtacatcctgaagattggcgagggagatgctactaagtgcatcagtggattcgtagctatggacattcctcctccccgtggtcctatctggtaaaattatgcatgtcttatgttctcatatatttttcctatatatatgagatcgatgttaatccttttcaagtgtagaacttaagtttcatcatacaattgtgttagttttgttggataatggaacctttcattactacatcatttattagaaagtcgccaaacaatgatcttacccgaaagtgggaaagaagccaacaatactagccaacataagaagagtgtaatatgacatccaagattactctcaatactaggaagcctaacattgacactccatccaaatcgagacataaacttgttggtaatacactcgaggttcttagtgacaagctccatcagcccagcgttgcaccttctgtagcaacacccatgaccacaactaactgctatgcgtttaccaagaattattccgatanaatgacattctcatccacctcaacatgatgtagctcatctagggaaacctgatatcacatgat

SEQ ID NO: 58297 - DNA, 528 bp, Triticum aestivum
  Clone ID: PAT_TA_58297
gggcgtgctgtgttttccctgttacacggtgaaacacggtagacattggattctgacccatgcgtgctgcggaggcgcatgcatgccactgctgtgccattcatgactggacgcacacgccgaaccattgctcagtggtacgtatctaacggccggatgcactaaggcatgtgagttagacttgctcgttgcacgcacactaaaatacatgtagaataagatgggagtgcatgtgtatgtatgtaccgtatacattcacattggactgatttcatgcttggggtttgtcggttgatgatgtgtcgaaggggaaaaatggatttactatgttttctttttaatgtgtgccatcatctactcgatcgtcctacaagaacaacaacatggtcagggtttcaaccaacctcagcagcaacaaccccaacagtcggtccaaggtgtctcccaaacccaacaaaaccgaaagcggttggaaaggggttttttcaaacaacctaaccaccaccaatgggttaatgggcctaaaaa

SEQ ID NO: 58298 - DNA, 133 bp, Triticum aestivum
  Clone ID: PAT_TA_58298
gctgctggaaatgacatggttcttcttccttggttcatcgttggatggttgggtgttgataaagagtactagtgctactagtgtggagattggaactggtttgggggcaatatagctgcgtgtttggttacat

SEQ ID NO: 58299 - DNA, 421 bp, Triticum aestivum
  Clone ID: PAT_TA_58299
cacaagttgaataaaatggtgtatgcgcctatgcgaaatgcatcattaatgaataaaagcgaagttccctgttgatcgagaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaggggggtttaatttaaagggatttaaatttaatgggggtggattggaaaaactttgtttttttttaagtgaacttaatttaaattcatgggcctttagttaacaggggggggaaaagaaaaacccggggggaactaaatttaattgggtgggaaaaaatttctgtttggagggttggtgaatttggggaaagaccaggtggggtggcttttt

SEQ ID NO: 58300 - DNA, 569 bp, Triticum aestivum
  Clone ID: PAT_TA_58300
ggaacatgtacgccttcgcctgcgtcacgctcgcctccatgaccacaatcgtcacgggctacagtacgtgagtcgccgtcgtccatggctcgaatttgtacgtcaccgatgctctgccgcgtgatcgtgtgcctccactgcagatctcgccttgatgagcggcgcggagctcttcatccgcgaggacctgggcctcaccgacacgcaggtcgagctgctcgcggggtccatgaacgtgttcatgctcgcgtccatcctcttctccggctggacggccgacctcctgggccgccgcgtcacgcttgtggtcgccaacgccttcctcacggccggcgcgctcgccatgtcccttggcggcggctacgcggcgctcatggctgcgcgcttcgtcaccagcatcggcatggggctcgccctcgtcgtcgcgccggtctacaacgccgagatctcgccgccgtccacgcgtggcgtgctctcgtcgctgctcgacgtacgtatgtgccggcgtctcatggacaggaacagggttcgatttgactagtgatgaaggagcttaatctgttcttctt

SEQ ID NO: 58301 - DNA, 680 bp, Triticum aestivum
  unsure (1)..(680): unsure at all n locations
  Clone ID: PAT_TA_58301
caacgcataggccgggcatcttggtgaccgcatggacttgaggattgttctaacaattggcatgattagcactgccatattcactgcgctctttggtgctggatattggctaaatattcacaacttctactactttctggtctttcagatgattgctggcttatttcattcatctggatggccttcagtcgttgcagttgttggtaactggtttgggaagagcaagaggggattgattatgggtatatggaacgcacatacttctattggaaacatatccggttcgctgcttgctgcatctctgctgaaatttggatgggggtggtcatttgccatccccagcatcatcatggctcttgctgggttggtggtgttctttttcttgccggttagtcctgatgtaatggagatagatattgatgatggnggaggtaaactcagacaaggatactgcgaaggagccccttttggaaccaggccaagaagtgaaacataaggcaataggattcctggaggcatggaggattcctggagttgcaccgtttgctctctgcctcttcttctccaagctggttgcatacaccttcctgtactggctacctttttacatcagccatacacctattggcaacgagtacctctctgatgcgatggctggcagcttgtcaacagctttcgat

SEQ ID NO: 58302 - DNA, 579 bp, Triticum aestivum
  unsure (1)..(579): unsure at all n locations
  Clone ID: PAT_TA_58302
cggacgcgtgggttaaatcctcttgtcttatgcccatattgtccaaattacgttcattatgctgcctaccagaatattcaagtctttgaactacgtgctaaactgcctgccatcactaattttcaggatcacaatctcacttggatgcttctgccccagatttggagcttaacgctgcaaagatgttttctatccagtgcatctcgaacttaactcactcgcttgtccctccacggcagccaacctcttgatccttgcttttctgggtcttgaagtctatcgagcatagataacatgttgttgcaagttatttgcagtagcagatacttagcctgaccaacaatgcttgtacatgctgatttaggtattctgctagctgtagaaattttagatgtggtgtattttttttaattctggcttgaaatcaaccatgagtccgatgtatgtgtcattgtatgttgaattttggctacaatttataaattggaattatggctcgggattgaattgtttgaaaaaaaaaaaaaaaaaaaaaaaaaannnnnannnnnnnnnnannnnnnnnaaaaanaaaaannn

SEQ ID NO: 58303 - DNA, 742 bp, Triticum aestivum
  unsure (1)..(742): unsure at all n locations
  Clone ID: PAT_TA_58303
ccacaaggaatgtgtttgatgccaggtgtgtgttcaatgcttcaagggcatcccagcatcagttactgcatgacacaatataagctcgagtgtctccagatgtggtgaggatgagagggccttcatcccctcatcatcaaagaaattggcggtgtttagcacaagaacacgaattgggcaggactgaatgagtgccagaaaacccttctttgtgaatcctatttctgatggccagtcacgggaacatcctgtaaatttgaggtctacgatctgaagcataggatagttgagggctagagcgtaaatgctgttatcagtaaatgacgtcctggtttcacaatagccatcttcactacaatagcgttgtaggttgagcccaactgagatgcttttaaggttgctgcagctccggaataatgcaatcatgtcattgtcatttagtgcataaacatactcaagccaaaggttctccaatgctttacacttccctaggacaacacgaagtcctatttctggccaggttttaatatgcgccaaccttaaatccttcaaactctcacaggagaaatcatatatatctgtgctgtgagcatcatacgagggatcatagaagtcatatcctatataatgatcatgtctttctcttttcctctcanactcaaacttctggagcttcatccatcctgaaccaaactttaggaggtcatgatgattgattccttgncattcttcactacaagct

SEQ ID NO: 58304 - DNA, 614 bp, Triticum aestivum
  Clone ID: PAT_TA_58304
gtcgatcacacgctatagacaaatcctgctgacctgcacactgtgccaggatttctgtacataatagtgtgacctatggtcctctactgaatggacccacaacaactcgtttatcgagggaactccatactagccatcgcaactgaatggcgttgcagacactatgccgacttataccagggtgacaatatatcatacaggaccaacactaatgccctcactaacacgtgatgattccgagtgtgtaaagcgacactctctgaagcgtctcataaatcgaggaagtgggggtgagcacactacatccaactcgcgttgacacttgccagtatactatcgcccgctactttagatgccttatattacactactcgccacgagactgaaactgccgcgtctatcactacacctttacctgcctctagggctcagatacaatgatctactacatctccttcctttgaaacacaatcagggagatgggacaaataaggacccataatgactgtagactgcagtgcataccttgacataaagaactcacggcctagagctgtactcactctgcatgctgatacagacagtaatcatacatcatactataaaccatgact

SEQ ID NO: 58305 - DNA, 371 bp, Triticum aestivum
  Clone ID: PAT_TA_58305
aggggaagggggcaaattttaactgtgattagcataattttctgttcgtcgaccagttttaaagttttaataatgtggaaatgggatactgtagttttcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaactaaaatattaaaaaaaaaaaaacaaaaaaaaagttaaccaattttacaaattataaaaacgagaaaacttaaaaaaattaacattattaaaaatattttgccacattgcacattttcccatttttccgaaaatgacaaaagaggaaaacacttcccccctt

SEQ ID NO: 58306 - DNA, 434 bp, Triticum aestivum
  Clone ID: PAT_TA_58306
caactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtggagccaggtctcctaccagcagcctgaggaacaatatccatgaggccagggctccttgcaggcatctgagcaaaacccacaggcccagggctgtgtgcagtctcaacaactgagccaggtccaggaaataaggaacttaacgctgcagacgctgtcaggagtggggagtgcctacatgcctgcatgttggtggaccacgattggcgttcggggtgtgggggg

SEQ ID NO: 58307 - DNA, 348 bp, Triticum aestivum
  Clone ID: PAT_TA_58307
ggaaatgcatcaaggtaatgccatcctccttctctctccagaaaaaaaaaaaacattcctcaataaaaaaaggaagggggttttagatttaaaaaattaaggttcccgttcttgggaatccaaatttttttttttgtgttacctaaattaaattttttgtccggggttttccattttcatggcggggactggcttgtccttgcccatcttaatgtaattgccttggatccccctttccctttgtgtggcagtagtaaaaagttcgggcccggtcccttttcccataaggtccgcatcctaagggtttttgggaacgggccctgcccttgtagattaagctcacccgcc

SEQ ID NO: 58308 - DNA, 759 bp, Triticum aestivum
  unsure (1)..(759): unsure at all n locations
  Clone ID: PAT_TA_58308
ggaggacgccggaggaccgccttcgttgttttccgcgcgcgcctcgcctccgtccgcgccggagagctgctgtccgcgcgcgcctcgcctccgtccgcgccggagcgctgctgtccgcgacggaggttgttccgccgtcgacatgaatcatacagatgcaggctttgcctgtgccccctgatccttgtgctccggtgccggcacctatccctatgcggtgccgtgctcaggaatttggcgaaaaggcggctgccgtgcttgcgcgcgagaagggcgccggaccttgttggcgctgcaaagggggcacaactcaggttgggtacgccgtcggccagcgccggcggcgagcacgctccactgtgacctgtccgccacagccagtcctctcccgtctcccccaactccgtgcccttgtccaatgcaaatcaatggagctgccgacccagattgttgttggctgctataagaagggagggtcctcgcctcgaatctacatcaggtcagttttggacgaagcatccaatgtcgacaccgagttcgccgcaggaagaagtgccgagttcgccggaggtagaagaagcgccgagttcgccgaaggtagaagaacagccgtcgagctgtccaatgtcccctgcgtcggctacagcagaagaccttaagatcagcgatgaacatacgtcgagccgtccatatttnctgtggcagcacaccagagaaatagatgacatcactgaactgacattgcagaggattttgata

SEQ ID NO: 58309 - DNA, 503 bp, Triticum aestivum
  Clone ID: PAT_TA_58309
ggaagacgcccctgaggataatgagatggagaagcatggtatggcaacccaagaagtggacaacgagagcgaccttgcaaggaccctttcgtcactgaggaggggaagcacggatccggcgactgacccggcaatgcgcgagcgagaaaatggcgatccggctgaagctagtgcaaagtcaacatcctccgcggtcaagaaattttacatgagaagaaatagcagccagagcttcaaaaaataatgtaaagcagatgcagatcacctgtgacttgattgttgagaggtagtagtactgagttgtactgtagatgaaccagataataaaaaggtgcaagagatgcacgccagtttgtgtgtacctgaataaacgttggtttatgcaatgtggcttgacatttgtgttaagttatttggtgtgtacgtagcaaatggacgaagatcattgtactgatgcaacacatgatgcctcctgtaagcaatgaatatcatcgaggtcagaa

SEQ ID NO: 58310 - DNA, 172 bp, Triticum aestivum
  Clone ID: PAT_TA_58310
tcttcctaggtgctgacaacacaattcttgcaacagctggtaagtactttgttgcaaaacttgtgatcttccatgcgctaagttgtgttgctgcaatacaacaactgattccatgcagggatgttgttttgcaccatcacagcatagcgcttggtagttcacatgtttggct

SEQ ID NO: 58311 - DNA, 395 bp, Triticum aestivum
  Clone ID: PAT_TA_58311
caaggtttttgttgacagtttgtagtgcagtggagccatgtatgtagatgtatgtaaccaagcaagcacatcggttctagcttgattgttgcttggtgcatttcttgtagtttgctgtggtttgacatgtggcgggcttcagtagatgattttcgatcgccggagggccactcttcacagtgattctatccatcttgcatgctcaggcctgttggtagtatcaactgattctgaaggttcagtcatgatgaatatgcatggactccagggatttgtgcacagacatgaaacatcaatagcagtgttggaggtcgaaaacacgcacacccgcgcggatagtgaattcgatcaaagaaaaactaggaaaaataatgaaataatgaaatcttggtaca

SEQ ID NO: 58312 - DNA, 486 bp, Triticum aestivum
  Clone ID: PAT_TA_58312
tgtttaccacccttatcgtcctcttttacatttattgcaggatgctggcgtaacagacctgacacagtttgcctggggccttgtcaatgatacttacaaaatggaccttattctcgtacagcctccctatatgattgcattgtcttgtatatacattgccagtgttcttaaagataaggatacaacttcatggtttgaagaacttcatgttgatatgaacattgtgaagaatatttcaatggaaatactggacttctacgaaacctacaaggttgacccccaaaggggtctctctgatgaaaagatcagccccataatgaacaagctgccagcaaaggcctaaagtagatgttgttctagttaatagtaaattcttagactaatattgcaagtgatcagaatgaagaaacccatgatgatagggaatagttttggatgcgcttgtaatagtctgtgattcttgacatttataactgttgtatttac

SEQ ID NO: 58313 - DNA, 130 bp, Triticum aestivum
  Clone ID: PAT_TA_58313
cggacgcgtgggctgtgctgcattacatttgtgcggcagtccctttgtatgattttatgtatttgaaaaaccgtatgttgtgtacttgtgagacctgcatttagaagtatctgcatctgtggaattagat

SEQ ID NO: 58314 - DNA, 547 bp, Triticum aestivum
  unsure (1)..(547): unsure at all n locations
  Clone ID: PAT_TA_58314
caagggcagcaaccaggacaaggacaacaaggtcggcagccaggacaagggcaaccagggtactacccaacttcttcgcagctgcagccaggacaattgcaacaaccagcacaagggcaacaagggcagcaaccaggacaagggcaacaagggtactacccaacttctctgcaacagacaggacaagggcagcaatcaggacaagggcaacaaggctactacagctcataccatgttagcgtggagcaccaggcggccagcctaaaggtggcaaaggcgcagcagctcgcggcacagctgccggcaatgtgccggctggagggcggcgacgcattgtcggccagccagtgatagaactctctgcagctcgcatggtgcttaggcatgcatgcactttagctatacaataaatgtgacgtgtgttcacagtttttcatgtaactagagtaaagcccagtaataatgcaaaatgaaaagcttttctggctaaaaaaaaaaacaaaaaaaaaaaaaaaaaaaaaaaannnngggggggcgcggtttaaaa

SEQ ID NO: 58315 - DNA, 283 bp, Triticum aestivum
  Clone ID: PAT_TA_58315
taaaaaaaaaaaataaaaaaaaaaaaaaaaaaaaaaaagggaacaacgacctagaggaaaaagagcaaaaggacgtctgaaatgagaggaaaaaagctcttatatattgacacctgagatgcgtttggtggccgccgttttaccccgtccggatggggaacgccttttggtggcccaactttagggtcttggagtgcactgccgtttggcgagctggcgtactaaggaagaggcccctacgggtcccccttgcaaacagttgggaagcctgaatggtgaacgg

SEQ ID NO: 58316 - DNA, 555 bp, Triticum aestivum
  unsure (1)..(555): unsure at all n locations
  Clone ID: PAT_TA_58316
tttatctgtgaaaatggtcaatgcacagatggtgagtgggtacttggacaattcgttcaatgcactcgtggtttctggtggcggtgagagtgntnatggatggnttggatgtcagcttnttgttgctctngagcctatactgatgcntgatccacttggtgttctacaatgtcccttctccactatgggatataacctaaagataacagtcattataatattctcccgctctgatagatgcatacataacatatccttagctcttattatacagcatcattctttcagacagactttcccttatagatgtttactgctgtgcactttattattagatgctcataccggctcaccttatgccaattggctaaaattacctgctcctgcttatagcctgatgggccactggctgtgaacaactgccttctaacctcgcttaccacttatcgctgcacagtcaaatccttctcgccatggctgacaccttattcgtgcctctactccccaaggtaagatcgcctgacataacctggtgttgtcacctactcgtttctg

SEQ ID NO: 58317 - DNA, 237 bp, Triticum aestivum
  Clone ID: PAT_TA_58317
cttgttttataatgtcagaaaactattcttgatggttttgtaggttgacggcggatacttgagagtatttggtttatgtaacttctgagcatgttcattgattctagagttgcggccttctgttatgtgtagatgtaaatgtaaaagaaacagtaagtaatctccctttcttttcatttgtatttgttatgattttatataacatgtcttattgcagctatgcattgctgcaattgt

SEQ ID NO: 58318 - DNA, 771 bp, Triticum aestivum
  unsure (1)..(771): unsure at all n locations
  Clone ID: PAT_TA_58318
ggagtctatttgttcttaaaatgcaaaaaagtcaagcctatatggagggaactgcagctagaaggagaaaggctcaacatgtgtgcaagcagagatgcaagcgagagctcatgggggcgacgctaaggctaccggagtataaaagagtgttaatcacatgcttactctggagatggtggacttggcgaaataaaataaacgcgggcgaaaaggtaggatcaggagagcatctgccagctgaaataaatacctggacaacggattctctgaatctatgtgccaaacatagtactgacgaacctgcaaaggtgttgcagaactggaagaaaccaacgggggacattctgaaaattaactgtgacggagctttccaggctgctgatggaactggtgggtgggnggtttgtgatccgggacagcgatggagacgtccgagggtcaggtgctggctgcctgcctcacgtggcatctgcaattcgagccgaagctgaagcttgtgctgcagctctgcaagaggcgtcaggatggggcatggtgaacgttgtggtggagtccgactgcaatatcctgatcaacgcactcaaaagcaaagaatctgatcttgcgccggaaggaataatcttcaaagagattcgagagtttgctcggttaaatttctctagtatttcattttttgtttgccccacgggcctgtaataagttagcacactgcgttgcggcgtttggcgctcgatcccagtagacgccaagtctgggcggaaagcttactga

SEQ ID NO: 58319 - DNA, 223 bp, Triticum aestivum
  Clone ID: PAT_TA_58319
tcggtgcttttcatttcactgccccgtatgcctacgatcgatgttctagcttggtgtcaacggatcgagtagcgttcactaataaaaaaatcaccatgatcaatgtcaaccccgctgctacagagtacagacactatgagaaaaacatttgttgtctcgtgtttcgccgtaagccgagtgtaatttgtcggccgctcggcctatatcaatgtaaaccgggtac

SEQ ID NO: 58320 - DNA, 573 bp, Triticum aestivum
  Clone ID: PAT_TA_58320
tcgctgctttgacgctcggtgccggcctcgccatggaaaagctgtctgaatggatcttaacacatgcatgctactgtcccgaggcttacagactgtgatatacactaggacgtccagcttgagattcacgtatggaggcgacattccacttggactctccaatgatcacaatatgcaagccatagcactcatgctactgtgcatatgcccaacacacgcaatcagcacccatctgcaagcttattagcactaggaaacccaacgttgacgcagcccaagaactgggcggactttcttaacgcactatccagccacgcgcgccgactgctgctaccataccatctgcatcagtgtggacatgcaggctactttgagaacggcttagcccgcgagccgaattcctcggtcttgaaacgactcatccgtggacatgcatcctgacagaccagcttacgactccttctgaccagcgcgctccacatatattgaggaagactatcaagcacatccagtgataggataaactggaagaacagcctatccatgtgactgaagaaaccggccgcgagatgc

SEQ ID NO: 58321 - DNA, 457 bp, Triticum aestivum
  Clone ID: PAT_TA_58321
tggcggtcgagatggtgcaggagcctaacagtggtccttgtagctggcgcgatccggcgacgggctacaaggtgagcgcactcacgggctgccggtccctggagaagctccaccgtgtgggctgtcaacagcccgacgctgacctaagagattgctgccagcagctgcccgacatcaacaacgaatggagcatgtgctgtgtacctcaacaccctgatgcgtatcgatcactcatgagctcagagatgcgtgaggggatatagaggctgcctcccaggtcagcgcggaaggagggtgatgacagctcaccgtggcgagcgtgcctgaggactgcaaagtgcccattaccaacccgcagacagacagagcacgtgtctggtactgtgccgcgtatgcggacgtctactcaagcagaatctgcatcttaatcggagcggcgcgtgcgcacaagatagat

SEQ ID NO: 58322 - DNA, 701 bp, Triticum aestivum
  Clone ID: PAT_TA_58322
cacaggcgggaggcgatgctgggttctgtaggtcgccggcggtgaatcggcagcgtggggcggagctccgggcatccagggtggttgttggcgcgcgtgtgctgtgcggggcactggaggcgggaccggcggcggtagaggcgcgcctggagagggccggcgggcgcggctgcgtgcgagcgcgcgggctgcctgcggagcgcctggaggggattggaggctacaggcggcactgctctctcccgtgaagaggtgcgcacgcgcgaagtgctcctggtgctgcgggtgctactgtgtgtggcagagggcagaggaaggaggcggctgcgccaggggagaggccaagtactggctggtttgctgcttgtgcggctggcttgctggtgctggagaaagactgagaacagtctgcagttgctgctgcttactgttggtgcggcagagggtgctctttgcactgctgctgcttgtggctgctgtgtgctggaactgctgttgtttgcagaggagaaggaggaagatgctgttgttgctgcttgcaagtgctgctgctgactctgttgctgctggtggtgtactacagtggagttagcagagaagaggaggtaagagctcctggattgatttggtgctgctgtgtgaggggctgctagatagcgtactgaggaagaaagaaagttcttgcctgctgtgattgaggc

SEQ ID NO: 58323 - DNA, 274 bp, Triticum aestivum
  Clone ID: PAT_TA_58323
ggacttcatggcgccttcgtcggcgcctgctcccgccccggacacgggcgcggcgagcggcaccgctccggcctccgcccttgccttggtgtctttcgcgctggtgtcgctgctgggggatggctgcgtggctggatggatggggtgctgcgtgtgatggatggatggctgcgtgggcatacgtgggctgattgattccaatattgtatgtgtgcttacctagtacatgggctgattgatttcagtattaaaaaagaaaacttggtacagcact

SEQ ID NO: 58324 - DNA, 711 bp, Triticum aestivum
  unsure (1)..(711): unsure at all n locations
  Clone ID: PAT_TA_58324
cttcaatgcaaaatctttgcctgttgatttattttgcacatactctaccaactgagcataattagcagtttagtatagatcaaaaaaaaaaaaaaaaaaaaaaagggcctgtcaaaacaaatatggcgtccaagtccaactgcgttctcctcttggccgccgtcctagtctccatctttgccgccgttgccgccatcggcaatgaagattgcaccccatggatgagtactctgatcactccactcccaagctgccgtgactatgtggaacaacaagcatgtcgcatcgaaacgcccgggtcgccgtacctcgccaagcagcagtgctgtggggagcttgcaaacattccgcagcagtgccgatgccaggcgctgcgctacttcatggggccgaagtctcgtccggatcagagcggcctcatggaactccccggatgccctagggaggtgcagatggacttcgtgaggatactcgtcacgccggggtactgcaacttgacgaccgttcacaacactccgtactgcctcgctatggaggagtctcagtggagctagagacaattctctcgctcatgaataaataagcatgttgcgaccatacatgtgtgacatgcatatatgcatataggacgagctccgcgcgctcatcatgtgtggtgctatgtgctacatatatggataagaataaaggggatcattnttcgcttcttta

SEQ ID NO: 58325 - DNA, 555 bp, Triticum aestivum
  Clone ID: PAT_TA_58325
gaactacggcgtgacctgcgacgccgaggtgctcgacatgctcgacaccgccgcgcgccagctcgaggtaccttacttttttgtacatgcgcgggaggtgttccgatcgatcctctgatttgatcgatcgagcatggaggaagaagaacggactgactgcttaatgttggtctgatgatcagctgaaggtggtggcgaaggtgtactggggcgacgccagggagaagctctgcgacgcggtggaggagcagaggatcgacaccatcgtcatgggcagccgcggcctcggcaccatccagaggattcttctgggaagcgtgaccaactacgtgctgtcgaacgcgtcgtgccctgtgacagtcgtcaagggagaccgttaggtttgccatcggtgtgcatcaggatgcgcttcatcgttctctgctccgttgctgcgtccgaataaagtatggagcctgttgtgttttctgtatgccggaccttggcagattattgtagtcgtgtatgtttctgaacattcgggttcaaattcagtaaagtgtcgttctttttttt

SEQ ID NO: 58326 - DNA, 782 bp, Triticum aestivum
  Clone ID: PAT_TA_58326
gccggccggtcaccgacactcccaattgccatcacatactttctcacaatggctcaacccaaggaaaacctcgcaaatctcctccctccctcgtgttaaacttcagtcacagcttggctcgccgaagacacgccctccttcgactacgccggcttcgtcgtcggtgacggcccccgcgtcgctaccctctggggcaaatcaagcggtgtcattgccggccgccccttcttcgacgaggtctttgtgcaatgcggttgcacagtcgaatggcacgctgaggagggaaacgatgtcgatctgagcagcggcaagcaccgagtcgcaactgtcaagggccctgtgcgtggcattctccttggagagagagttgcattgaacacccttgcgcgatgctctggcgttgcgaccaagagttcaaggcttgtatccattgcgcgcaaggctggatacacaggcgtgattgcaggaacacgaaaaacaacaccaggattccgccttgttgaaaagtacggcatgttggttggtggcgccgatgctcacagaatggatctcagcgctatgattatgctgaaggacaaccatgtctggagccggggcagtatcaccgatgcttaaggctgccaagtcagtcggcggattcagcatgaaggtcgaagttgaagtgcagagcgaggccgaggcggacgaggcgattgaagctggcgctgatgttgtcatgttggataacttcactggtgatggtgtcaggggtgcttcacgtagtcttaaggagcgctggcaag

SEQ ID NO: 58327 - DNA, 632 bp, Triticum aestivum
  Clone ID: PAT_TA_58327
ccaccaaacatcaccaaccatattctccaatggctgctaccaccaccacaagcgcccctgccgacaccttcaagtttcctcgggaataccacttcccagcattcttcacccgccaaacaaacctcaccacgctgcacgcacagcacaacaagtgggccgatctcatcctcgcatacgcccgacataaccgcattttccgactctccctctccgaagctgccgactcggatttgtttgtcaatcgcaaactcgatcgccgtctgcaattcgatgatattcgggatgtcgtgtcctttatgcacaccgatggacgtgtagagtatgtcggaggtggaacgtcgggcgacgttgtctttctgtactggagaaagcccgaggagtgggctgagcttgtcgagaactatgttgaagagtctggacaaaaaggcagtgtccttacagtctacgagcttgtcgaaggagatggcacaaaaggaaatgatattcacggcatggacacagatgtcctactaaaagctctcaatgtccttgtcaaacgaaacaaggcccaaatatttggccaggacgactcattaggcgtgaaattcttctaatcgctctcaatccaaaaaaaaaaaaaaaaaaggccccta

SEQ ID NO: 58328 - DNA, 730 bp, Triticum aestivum
  unsure (1)..(730): unsure at all n locations
  Clone ID: PAT_TA_58328
gccggccggtttctcggagccattcgcaactccatctgcaactccatcaccatcgactctccatcatcgcatcaccagcagtcctcgaacctagtaccacctctctaccccccacgaccgattcgattgctgtatttccacgcttttatttaaacacgacatcatgtctgcccagaactcggccggcatcaaacagcttcttgacgctgagcaagatgcttccaaaattgtccagaaggctcgagagtaccgcaccaagcgcatcagggaagctcgcgatgaagccaagcaagagatagccgactacaaggccaagaaggaggaggaatacaagaagttcgaggtcgagcacagcaagggcaacgagcaggccgaggccgaagccaacaaggacgccgagactcaaatcaagagcatccaggaggctggtaagaagggccaagctggagtcgtcaagaacctcctcagcgctgttttcgacgtcaaccccgttcctcccaccaacaccaagtcttgagcggttccccggcggagtcacggtgtttataatcacgagcgttgttagctctgcactttggaagacgatagattaggtacgaggaggatttgttataagagagcaagaccatgcgttctataccggtcaccctgcggcgttccacctggacgcctttttgatcattaagtttactgaacaaactctaaaaaaaaaaaaaaaaaaggcccctan

SEQ ID NO: 58329 - DNA, 656 bp, Triticum aestivum
  Clone ID: PAT_TA_58329
gccggccggtctcgggatgagacctccagctccgccgagtccaagaccaagacctccacccacgcttccaaggctactggtgactctcactctaccggtactttcgtcactgccactgcctctgccaccaacggctccagcgacagcgaggactccactgccactggcactggttcttcctccaaacccacctctggctccggctccggttccagctccgagtctggctcctctggctctggtgacgcttccgagtctggctcctccggctctggttcttctggctcctccggctctggttcttctggctcctccggctccggctccagctccgagtctgtatctaagtccgaggctggctccagctctgagactggtgccgccgccgctgagacccccagcactgtcaacggtgctgctggcttgaccttctctgctgccgcccttgccttcttcgccatgcttgctctgtaaatgtcctaaatggattctggggtgattgacgcccattagcgtgtcttttttacttttttctcgcacccgagatctgtttcttgtaatattttatggatagattacggatagacaaatgttggctatttttttcagaaaaaaaaaaaaaaaaaaaacaaaaaaaaaaaaaaaaaaggccccta

SEQ ID NO: 58330 - DNA, 818 bp, Triticum aestivum
  unsure (1)..(818): unsure at all n locations
  Clone ID: PAT_TA_58330
gccggccgggtcgggactcctctctctatactctcgactactctctctagcaaagacctcactctactagaaaaatgtcttccgctcctctcaagaccctgcacctgcgagctcgcgaggccagccgcaacgcggacgctgttgcccgagctctggaggcttctcctctggtcattgctgtcaactaccccggccttgactcccacccccaccgacacatcgccaagaagcagcaccgcgacgctctcggcggcggtatgctctctttccgtatccagggcggccacgctgccgctgagcgcttctgccaggtgacaaagatcttcaccctcgccgagagtctgggtggtgttgagagtctggtggaggttcccagcagcatgacccacgctggtatccctcgggatcagcgtgaggccgtcggtatcttcgacgaccttgtccgcatcagctgcggtgtcgaggatgctcaggatctcaccaacgatgtcctccaggccctcgagaaggctacctccgcagctaaggctaacggtctcaacggcaacggcgttaacggctccaacggacactaaacatgttttttttggataattccaattgcgcgcggttttccctttgtttattgtttattttatagaagatgatctatgatgacatgttatgaaaaactgtttcctttgtctgaggatgcttcaagcaaaacaaaaagagagagagagagggtatcttattcaatttcctatgggaaggcattttatacagcggctagggttgaanatgatgcaatcgcatccgtttggtattgggcttgataa

SEQ ID NO: 58331 - DNA, 517 bp, Triticum aestivum
  unsure (1)..(517): unsure at all n locations
  Clone ID: PAT_TA_58331
ctgtgcggcgctcgagccggccgggccgggctcttctgtggctggtgttaacgcccgcaagcgagacaagcctctgcctcccatcatcatcgatgatcctagcgacatcgttgccatgaagcgtgctcgcaacactcttgccgcacgaaagtctcgggagcgcaaggcgatgaagatggatgaattggaagacaagattgccaagttggaagaagagcgtgatcactggaagaggatcgctcttgcgcaatcaggtgtgcaataatggattaaaagtggaattactttctttcgccaatatcgggataccgtcggtttctttttatgagttttgtaatcaggcttcattgatttttttcttccccccccccccccgaccgntacgaatgggaggaccagaagatcttgcccactgcccataaagcttagatgcgtggctacttgggctggagctccctatatgacaccagcattccaagaatgcatgggatgaatacctttgtgactatgcgactaa

SEQ ID NO: 58332 - DNA, 795 bp, Triticum aestivum
  unsure (1)..(795): unsure at all n locations
  Clone ID: PAT_TA_58332
gccggccggtcccgggaccgccatggctcaagaaggtatcttcagcgccaacctcctctctcccgaggtcaaggccgctctccctgagggctacaccctgcgcgctttgcgcaagtccgacttcaacaacggtttcctcgactgcttgcgcgtcttgaccacggttggcgatatcaccgaggccgacttcgttaagcagtacgacgacatggccgctgctggcagctactacattatcatcattgaagacacctcgcgcaaagaaaaccctgtcgtcggtactggtgctctgatcactgagcgcaagttcatccactcccttggcgccgtcggccacatcgaggatatcgctgtcgcaaaggaccagcagggcaagaagctaggtctccgaatcatccaagcgctcgattatgtcgccgagcaggtcggctgctacaagagtatcctggattgcagcgaggccaacgaaggtttctacgttaagtgcggtttccgacgagctggtctccaaatggcccactactacgagggcgaaaagggcagtaaaatctagagggatgtgataaactcggatggtagatttggcgatggatcatagacgggtttccttgcatctatgagctcttttggttatggtcagtggcgaacattggtgagctgttgcaggtgactgagtaaataccgcgagtagggccctctaagcggctgtgcgactggaaccataagctgagtgaggttgctgatccggcttccgacttacgacgggcgcccaatataagtatncaggtctctatc

SEQ ID NO: 58333 - DNA, 164 bp, Triticum aestivum
  Clone ID: PAT_TA_58333
gtgcggcgctcgagggcggcgggtcggtttagcatcaaagaggattactgctagtgttttggctgtgtcgggcgatttttggaagcaacgtcttgtgattattccatctgtacgactttttatgaagcatagagcttgaaaaaaaaaaaaaaaaaaggccccta

SEQ ID NO: 58334 - DNA, 184 bp, Triticum aestivum
  Clone ID: PAT_TA_58334
gccggccgtgactcgaaaagagtctgctactgaaccattgtgatgactcctttataccataccaagatctctgatactacaaaggttattggatggtagcgagtctacggatagttgttaatgacttcacgtatataattttattaacgaaatatcacaaaaaaaaaaaaaaaaaaggccccta

SEQ ID NO: 58335 - DNA, 607 bp, Triticum aestivum
  unsure (1)..(607): unsure at all n locations
  Clone ID: PAT_TA_58335
gcggccgcttcgaggnccggcccggttcgcngaaaaaaaaaaaaaaaaaaaaaaagtgtacctgaattaacaacagcagcaaccgtcaaaatggtcaagaagagaaagaacaacggccgaaacaagaagggccgcggccacgtcaagcccatccgatgcagcaactgctcgcgatgcacccccaaggataaggccatcaagagattcaccatccgcaacatggttgagtctgctgctatccgtgacatctccgatgcctccgtcttcgcggagtacaccgtccccaagatgtacctgaagctgcagtactgtgtctcttgcgccatccacggcaagattgtccgtgtccgatccgttgtcggccgacgcaaccgtgcccctcctcctcgcgtccgctacaacaaggacggcaagaagatcgtccctactgcccctaaggcttagatgggttgatacttgggatggagtccggttatgatagcagcattcaaaaaatggatgggatgaatacctttgggattatgagactaagaaattccaaaaatcaactggacgacgtttgatgtctacgcgtctttgacaaaaaaaaaaaaaaaaaaggccccta

SEQ ID NO: 58336 - DNA, 447 bp, Triticum aestivum
  Clone ID: PAT_TA_58336
gccggccgggttccggagaccgcacgacgcgcaggcacggtagcgcaagcatggccgccaccatgaagctgtcgctcaccttcgtcctcctcctctccgcgctggtggtgttcggggacgcgcaggcgacctgcgacatcatccggtgcaaacagggagggtacatcacctgcaagaactaccccggccagaagctcgacgggtgcgcctgcgtgtgcgcgcccgacgacggcaagggctgcgtgctccacctcgacgacggctccaccaacaaatgcaccaagtactgaaccggattacacgcgttcgtcattttcgtctctgctctcgtgtttgagttctatttaaataaagctgtatgtgtgtaacgaaagaaatgtaagcttgtgtcgtggaatgaatggaatgcaatccgttgatcaaaaaaaaaaaaaaaaaaggccccta

SEQ ID NO: 58337 - DNA, 445 bp, Triticum aestivum
  unsure (1)..(445): unsure at all n locations
  Clone ID: PAT_TA_58337
gccggccgggtccgaagacaggcggggcagttcgaggtgtccgccggccagtccggcgagggctgcagctgcggcgacaactgcaagtgcaacttctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttatcnttttaactactcctaaatcgctacttcggttaaaaaaaaaaaaaaaaaaaaaaaaaaaaaaaaaaaaaaaaaaaaaaaaaaaaaaaaaaaaaaaggccccta

SEQ ID NO: 58338 - DNA, 579 bp, Triticum aestivum
  Clone ID: PAT_TA_58338
gccggccggtactcgaccaaagacgagccgtctactacttgcaaagctgaggagcagcagcaatggcggccggagcaggaggagacgacctgaagctgctgggcatgtgggcgagcccggccgtgctgcgggtgcgcctcgctctcagcatcaagggcatcagcagctacgagtaccaagaggaggacctcgacaacaagagcgagctgctcctccgctccaaccccgtccacaagatggtccccgtgctgatccacgccggcaagcccgtctgcgagtcgacggtcatcatacagtacctcgacgaggctttcgccggcgacgccctcctcccggccggcccccacgagcgcgccgtcgcccgcagggacggagccaggaatttgacatagggggggcgagtttcagactagagctcttatagactgatgggcatcggatgatcactcagaactttaaagtgtgcaaagaaacataatcccggactcgtattttcgttagtgtaaacagctaaagactacaaaattattatgaaagtattcatctttgacagaaaaaaaaaaaaaaaaaaggccccta

SEQ ID NO: 58339 - DNA, 535 bp, Triticum aestivum
  Clone ID: PAT_TA_58339
ctgtgcggcgctcaggcggcgtctcggacttcctcttctcagatcattatggccggctcacatatgagccacgacgagttcttcgccaagctaggtgagctcttcgaccatcgcaagggcagcgaccatggctctatctacctgagccagaagcgattcacctatggtcaagatattccccagccctcagaagaagaaccatcaccagacatcaaccctggcaagcctctacccctcattatcaaggcaacaaacggcaagggtaagagggaccgttccaaaaaggtcaaactgtccacggttgtgaaccccgaagatttggaggcattttacgtgcggtacgccgatgtgtgcaagacaggcatgacagccctgaagccgagagacaggagcaagaagaaggcgaaggcgaagaagaagaaggccgcagcatgatttgacttcaaagttatggggttccgcagattaagagataggggttatatgatcaattaatgaattattgtcctaaaaaaaaaaaaaaaaaaggccccta

SEQ ID NO: 58340 - DNA, 539 bp, Triticum aestivum
  unsure (1)..(539): unsure at all n locations
  Clone ID: PAT_TA_58340
gccggccgggtcgggacacaggcatccatccgttcctctgttcctaagtcagcagggcttgttcatcgacggtcgttcctttcgtcgtcgccggtatgcagcggagcagctcgttcgggacgtcgtgggcggaccagtgggacaccggcgccgacccgagcccgcgggcgcgcggcggcggcaacggtggcggcgacggcaagaagggcggcgtggagaagaccaaggcggccgcggccaccgggctgaagaaggtcaaggccggcaccgcgcaggggttccagtggatcaaggacaagtaccagaagaagagcgccggcaagagcggcaagcagggtgttgtttccgaggtggccgccgggtactgaccggtcatctgagacgtttggatatgtatggaatcgtcatggaccgatgatgttcttatagtttataagttttagaactttttctaatcccaactaaaaagtctctagtgcttaanaaaaaaaaaaaaaaaaaaaaaaaagaaaaaaaaaaaaaaaaaaggcccctaggga

SEQ ID NO: 58341 - DNA, 419 bp, Triticum aestivum
  Clone ID: PAT_TA_58341
gccggccgggcaccggacaagtgtctcatccacgaaagacatcctcgatcaagatgagagccaaatggaggaagaagcgggttcgccgcctcaagcgcaagagaagaaagatgagggccagatccaaataaacgcatcgcacttgccgttctggcgcctctgggatctcccgcaacgcattgagctgggatttgactttgggaattacgtcagggtggttgaaccccgcacttgagcggctgatgtggcacacaatgaatattatggtggatgggattatgacaatcagatggtcaggtacaaggcggtgttggatcgaccactatcaaatgctcaccaatacaaagcatcacaacaacattcaaagataaagaaatacagagattcctctgccaaaaaaaaaaaaaaaaaggccccta

SEQ ID NO: 58342 - DNA, 656 bp, Triticum aestivum
  Clone ID: PAT_TA_58342
gccggccggtccgggtggagtgccgagaagtgcgatgatagctgtggctacgcccgtgccaaagatgtcgcatacaagggcttctccggttccatcaagatcttcctcttccagttcaagatgcctttcgacggcaacaccggcttcaacggcgacatgcccgccctctgggccctcaacggccgtattccccgcaccggccaatacagcgagtgcagctgctggaagaccggctgtggtgaggtcgacatttacgaagtcctcgcttcgggcgatgacaagtgcaagagcacttttcacatgaacaacggcgctggaagctccgactacttcaagcgtcctgtcgataaatacatcaaggtcgccgttgtgttctgtgagcgaacctcaagcgttgctattaagcagctgcccgataccttcaactttggctcgtcgttgagtgatgagactgttcagtcttgggtcaaggagatgacttctcacaagaagggcagcagcatattccagatcgcagcttaggtaaatgacatgtagattttgctatacttgtttctttgtctttacttagatagtgttaccttttcttcgtacctatatttagataccaattcacattcgaaacgccaaaaaaaaaaaaaaaaaaggccccctag

SEQ ID NO: 58343 - DNA, 570 bp, Triticum aestivum
  Clone ID: PAT_TA_58343
gccggccggtctcgggacgcccatatatacagctccctgtagctccagactttgcttgttacgaccgattgcacgactcaagccaaaatgtcctattccaccgttgcccgtcctcctcccagcgccatttccaggccgctcagcgagtctcttcttaatgagaagtgggaccgctgcctctccaatctcctcgtcaagtcatccctcggtctcggttttggtgtcgtcttctctgtcctcttgttcaagcgaagagcatggcccgcatttgtcggcgttggcttcggtgctggccgtgcctacgaggagtgtaacttcagcctgaagcaggctgcaaggtgacttgaagaagcagaccgcgtaagggaactgcggagtgggcgtcgactaagagacgagtcgtttatttgtaccaagaacaagcacgccagaacatggcggcgtgttaaaaaagggcacggagagctttgccgtgggctccagggagaaccaatgccaaactaggacgtttttttccagattcaatagaggtatcatgtacaacaaaaaaaaaaaaaaaaaaggccccta

SEQ ID NO: 58344 - DNA, 235 bp, Triticum aestivum
  Clone ID: PAT_TA_58344
gccggccggttactaaatactgctgcttaagcataagatattcttagcatctagcgcgcactgccatcacaggtgaaagatgagcagttccagttcacttctatgacaaccattttgagatatctttaccatttacgctatccattggatatgcaaattgaattatttttgcccattaccacatgacgtggttaaatgggacaactgctaaaaaaaaaaaaaaaaaaggccccta

SEQ ID NO: 58345 - DNA, 490 bp, Triticum aestivum
  Clone ID: PAT_TA_58345
gccggccggtccggaccagacatcgtgcgttacgcgatctctattaagttctactttatcatacatctacaactttctttcaagtttaccctacttcaacttctggctgtctgccaaacccccaatctttccaccctcagctttcgcttataccaacacccattcgatgggagaaaccgaatctaaatccgcgaatggtgcagttcacgccactaccacgtcggactcgtcgaccgtcgctgccggtcaggacgaccagcctcctatagcggagccccccgacctagctatagagaagccaatccttccccacacgctctctgctcatcgcgtcgctcaggacctcaagtccgacgtcgacgatggtttgagcagcgaggaggctgccgcccgacttgctcgggatggccctaattccatcaaaggcgccaagggtatctccctctatgagatctttatccagcaaaaaaaaaaaaaaaaaaggccccta

SEQ ID NO: 58346 - DNA, 347 bp, Triticum aestivum
  Clone ID: PAT_TA_58346
gccggccggttccggcccgcccgatcatcatactgtggctcagacagccaatgttgataaccacccaagtactttcgcattcgcggccgacaaaggtccgctcaagcttccaccaacacctgctgcagaccctgtccctgcctacgaatccatgtcagatcaagaaggcctaataattaatgaatggaaggatgctgagatggcacacggcgagcaggatcacatgagcttcttggagaaggaattcaatggctacttttgactggtattgctggatatatatacatgaaactcagaataaaacgataaccgatttcacccaaaaaaaaaaaaaaaaaaggccccta

SEQ ID NO: 58347 - DNA, 551 bp, Triticum aestivum
  Clone ID: PAT_TA_58347
gccggccggttccggaataacacaccaaaatgtctggaatacagaacaaatcaatctcgataccctggagccccagcagctcgctcaagtaaagaagcaactcgatgaagagctcgaacatctgacgacgtcgtttgcgcaacttcacgcagcccagaataagttcaaggattgcctccgatgcgtaaagagcaggtccggtgctcctgaaggagccaactctgtactggttcccctgaccaactcactatacgttcgtggggaattgtcagatgccgacactgtactggtggacataggtactggtttcttgattgagaagaaactcaagtccgccgaaaagttttacgagtccaaggtcgaggagctggggaccaacctcaaagatctcgaggttatcgtgcaaagaaagcagacaaatgcacgaacaattgaagaagttctgagacaaaagataatggctagccaagggcaggatgaccaacaggcctaggcgaaaacaagtaaatgatactatcttcctggaaaaaaaaaaaaaaaaaaggccccta

SEQ ID NO: 58348 - DNA, 353 bp, Triticum aestivum
  Clone ID: PAT_TA_58348
gccggccggtccggggacctatagaaggccggccggaccgggatcttcacaatggctggcgactgtggctgctctggtgcctcttcttgcaactgcggctctagctgctcttgctctggctgcggcaaataaacaacttgatctttgatcattcggataccacttgttctaggcccaagcttgggtcaagatacatcctttgacgacgaatcacggacggagttatgaagggcggagttgagatcatgatgtgattgggatatgcgcttggatagttagctacagattaagcttaaatactacccttgtgctgagtattctcttgagaaaaaaaaaaaaaaaaaaggccccta

SEQ ID NO: 58349 - DNA, 807 bp, Triticum aestivum
  unsure (1)..(807): unsure at all n locations
  Clone ID: PAT_TA_58349
gccggccggttcgggaaaaactcatctctccatcatcaccatccacaatgtccgactcaaagaaagaaggcgcctacggcggcgcaccatcaggcgacaccgacttccgtaaaacatgggatctcgaagaatatgccgccaagggcaaggaacgcgaagcaaaggagaaggaagagggcaaggcgcgttacgaagccaagctcgcgggcaagaaatacttcaagcctttgaccggcgacgaaacatatacatccgctagacgccatgtgatagatttcacgcaacagatcggaaagacgcagctcgtccctggcggtgcaggcgttggcaagcgtggccgtggagctggtcaatactgtgaggcttgcgacctcacgttcaaggacaacagacaatacatcgagcatatcactacaccacagcatttgatgaatacgggccaaacgatgaacgttaagcgcgcaacagccgaggaagtccatgagcgcatcgaggcatacattaggcgacaagaggacctcgagaaggagaagcagaccagtctacacgaacgactacaattacgagaagaagaggccgagaaagaggctgaggaacggcggaagaggaggagagacgagatggaaaggaagagactcaaacaagaggaggcaaccaaggtgaagacagagtacggagaagatgtgcgcatcgaaggcgagcatgacgaggatgacatgatggcttcgatgggctttgntggatttggaacgtcaaagaagtgatggatatctgggatttgttagtgatacccatgcttgacatgac

SEQ ID NO: 58350 - DNA, 275 bp, Triticum aestivum
  Clone ID: PAT_TA_58350
gccggccgggctccgaatcagtgtgttcccaactaaatggtagatccattaaataagtgtggtgagactagaggtctcacagaaggggccttttcttatgagaaggctcgttgatgtattcattggcatcctgtacccggtgctcgacccttactacacctattgtcttctctgtatatatttcatatagatagccttttgtcagcgacaaactggctaccaacaatcaacatacttgttcgcacagcgaaaaaaaaaaaaaaaaaaggccccta

SEQ ID NO: 58351 - DNA, 690 bp, Triticum aestivum
  unsure (1)..(690): unsure at all n locations
  Clone ID: PAT_TA_58351
gccggccgggtccgcggatactctagagtttcnttggtactcaacaacgcgattacctcatcgaccactgccaagcacggtagattatcgtctctataaattcgatatatattcagctattctacgcgcacatatcaaaccgccgccatgttgctattctgcccccattgcgcaaacatcctcaccgtctccctcacaagcacgcggaccaaccgactcgagtgccgtacctgccctttcgaacaccacattaccgagcctgtcttttcgcgacgattgtacgagcgtgtcgagagggaagatgtctttggtggtcccggcgcctgggacaatgcgcagaagggtcctgctcagtgccctgctgatggatgtgatggcgaagaggctgccttcttccaggtccagattcgcagtgctgatgagcctatgacaagctttttcaagtgcatgtcctgcggccaccgatggagagaaaactaggttcaaagaagggttttctttgagttgcaagtcaatggattgttctttgtatgcgaggagaatcggagttgggccattggatgcttgtcttttttatacagttcagtcaagaataatgcctgtagtaccaatgcatcattgctatgccgcagcggtagcacgcaggctggttttatttcttcttgaaaaaaaaaaaaaaaaaggccccta

SEQ ID NO: 58352 - DNA, 616 bp, Triticum aestivum
  Clone ID: PAT_TA_58352
gccggccggttcggacccggaagcctgagcaccccactcctgagcaccccgagaagcctgaataccctactcccgagactcctgcccagcccgagcaccccgagactcctgctcagcctgagaagcctgagtaccctgctcctgagcaccccgccaagcctgagcaccccgagactcctgctcagcccgagaagcctgagtaccctgctcctgagcaccccgctcaacccgagcaccctgcccagcctgagcaccccgagactccttccaagcccgaggagcctgctaagcctcactaccctgctcctcctgctgccgagactgacagcggctacaaggctcccgctcccagccagccttctgccaccgtcccctaccaccagcctactggcaccgctcccgccgttgaggtcaccgctggtgcctctcgcttcggtgtcgagatggctgtcgccgctgctggtatctttgccattcttctgtaaatgcatcatggaacataaaatcttcccttgctgttcattatttattacaacataataagcttcactatgtatatagtatgatttagacgacttcagcgcttgccacgtagtggtaaaagaattgctatgaa

SEQ ID NO: 58353 - DNA, 202 bp, Triticum aestivum
  Clone ID: PAT_TA_58353
actgtgcggcgctcgagccggccgggtcgcggatctacgtgcgtttgattggatgtgtttcattaaggcctcacatcatgtgtactccttgatgtgatggagagggcaacatgatatctgagctccaatgtgcaaaaggcaaatcactttagaaccaaatctagaatgacaaaatcaaaaaaaaaaaaaaaaaaggccccta

SEQ ID NO: 58354 - DNA, 365 bp, Triticum aestivum
  Clone ID: PAT_TA_58354
actgtgcggcgctcgagccggccgggtcgggcattggctggttggcttatggtgttaacatcaccgagaccaacaagtcacccctgctgttttccgatacgaggatggtggacacaccaaccctgactttggaatgggaggtggtcctggcggtcctccccgttcagaagaggacactgctgataacgctgcttaaacagttactacagaagctgttttaatctcagtggatagcgagttttcgggcaggatacaacttgagatatttgtttatcttacatatcttagtacagtgtatagcttctaagtagttagcctacaggcaagacgttactaaaaagtaaatccaatactgcctttcaacg

SEQ ID NO: 58355 - DNA, 188 bp, Triticum aestivum
  Clone ID: PAT_TA_58355
gccggccggttcggatttatcctactttcattggcgtcgttggtttggttatttgatctccaaaaaatggaagagcatagtttaggcaatgaggatcgacagccatgtatagaaagcagaatctcagtatcttgaccaaaaaaaaaaaaaaaaaaaaaaaagaaaaaaaaaaaaaaaaaaggccccta

SEQ ID NO: 58356 - DNA, 503 bp, Triticum aestivum
  Clone ID: PAT_TA_58356
gccggccgggctccgggctaccctgccttcggtgtcggatccgagatccttgccctgacaatggagtacggtttcgactatctcgatgcccccgctgctcgagtcactggcgctgaggtccctactccttatgctcagaagctcgaggagatgtccttccctactgagaagttgattgaggactacgctgccaaggtccttcgcctgtaagaaaaaaaaggagagcgaaatgagtgctgagaaagaatccggtccatctgcttgcacacatcaggacagcgcccatgttaatgtgcccagcgtggcagtgcatgtcctacgctgctcgttgtaataatcgggattgagacacagatgaaaatctggtccaattggcgtatttgatggacactacctttgatagacgtgcggaaggaaaggaaatgtaattttatcgcgtgttgccatgtatgttaagggcacggcacccgtcttattaaaaaaaaaaaaaaaaaaggccccta

SEQ ID NO: 58357 - DNA, 568 bp, Triticum aestivum
  unsure (1)..(568): unsure at all n locations
  Clone ID: PAT_TA_58357
ggccgctcgannggccggccgggttccagaacatcaacaaacaaattgaacaaactcaagatcaagacatcctcatttcccatcatcaaatccaaaatgaataaagactcctccttcacctttgttcacatgcaccgctcacgcgacgcagacctcttcgaggacttttgcaaggacaggctccctgatgacgagatatacgtccctcctatgcatcagcctatcaacccagaggacgaagatgatgttgtccccgatcagcacgccgcttttggtatccagcgagctacgcaaaagtccaaggagcccgcctggaaggatctgggtctctcggagctgatgaacaaggggcccagtattggaacaggtgggaagccaaagggtgcaggaagtacttttcctcgatagaaagatgtacggtttgcagtcatcatgttttgagcaaggcgttggggggtaacatatcttcatacaaggacaagataactagaaccaagatagttcggtattaaattcaatggcaagatatcacatcgccacacaaaaaaaaaaaaaaaaaaggccccta

SEQ ID NO: 58358 - DNA, 332 bp, Triticum aestivum
  Clone ID: PAT_TA_58358
gccggccggtccggactgaggacgtataacgctcgatgagctatatatacccctgatgacgatggtgtttgaggtcgcgatcgtgggtcatatgatatgcctagcgaaggcaagggcagtgcacgctgctcagagtgaggatttactggtactcttggggattgtctattataagacaagtattgtatttgcattgggctagaaaacatgcctttcagctgggaacggagcggcggagtttgcatggttttgggacttccatagctagatggtacaaaagataactgttccgtccaaaaaaaaaaagaaaaaaaaaaaaaaaaaggccccta

SEQ ID NO: 58359 - DNA, 386 bp, Triticum aestivum
  Clone ID: PAT_TA_58359
ctgtgcggcgctcgagccggccggttacttcatatcgtggctgcgcgagcgtaattcttcttcctcactctgtttcgttcccgagtgagctgggggaccttgaaagaggtcgtcccagaaaaaaacctgacaaataaagagaaatctcatctgccttgatgatgagaagcactctcttggaatcaatatctggatgtggttcatgacctggcgatggatgaaggtctggactagccattacgaagtatgaatagggtggatgaccaaggacagtcatgagcaatgaatgaataatgaatgaaatagcttagctgtctaggatagatgacgattgaatctattcatgaaatgaaacaaaccaaaaaaaaaaaaaaaaaaggccccta

SEQ ID NO: 58360 - DNA, 820 bp, Triticum aestivum
  Clone ID: PAT_TA_58360
gtgcggcgctcgaggccggccggttctcccatcttcttcttcctcctcctcactcatcaaacaagcaagcagcatccagccatggcggccaagaaccccaaggtcttcttcgacatcctcatcggccaggccaaggcggggcgggtcatcatggagctctacgccgacaaggtgcccaggacggcggccaacttccggcagctctgcacgggcgaggccggcctgggcaagagcggcaagccgctgcactacaaggggtcggccttccaccgcatcatcccgggcttcatgtgccagggcggcgacttcacccgcggcaacggcaccggcggcgagtcggtctacggcgaaaagttcgccgacgagaacttcctcctccgccacacgggccccggcgtgctctccatggccaacgccgggcccggcaccaacggctcccagttcttcatctgcaccgccaagacgccctggctggacgacaagcacgtcgtgttcgggcaggtcgtggatgggtacggcgtcgtggagaagatggaggccgtcgggtcgtccggcggcgccaccgccgagcccgtcgtcatcgaggactgcggccagctcgccgacggcgaccagagctgatctcatgattcattcagcttgtttttttttgcttgctaccactgttgaagctgagacggttaatatggatggatcggagggactactagtttgttttgttaagtgtgtgcgtcgtgcgggtgcttgtaattgactgaatgattgaatgaataaatttacagattcagtttcatcaaaaaaaaaaaaaaaaaggccccta

SEQ ID NO: 58361 - DNA, 331 bp, Triticum aestivum
  Clone ID: PAT_TA_58361
agagggagagaaaacacacacatgctcagcagcggcggcgatggcgtgcgccggcgccccgatgacgaagaaggagctcggcaagacccacgacggcctcggcttcgacgtcaacgacagcgtccgcggggactctcgcggcgaccccgtacaggccactccacgggaggcaagttcatgggaggagaagaagaatgtcgggacggaggccatctacggatccgtctgtcacatccggagggatctcgacgccccaatcctctccacgtaccaaagggccccaggtgcattgccatcctctatgctaggatatgaggccacgacaaggccc

SEQ ID NO: 58362 - DNA, 331 bp, Triticum aestivum
  Clone ID: PAT_TA_58362
ccgccagccccgtccgccaccctcggcatgccctccgcccgtggcccggccccgctctgcgccgcggtcccggacacccccgcccccgccgggacgccgttggaaaatattcgtagggaagacgcgccgaggactttgagagaaggtagccgaccaacgagaaaaagactgatacagattattgacttctacaaaagaggcaacaaagtgataggtatgaatgtgaggatagtcagcctctatgtaacattaatatcttggaatcctgcatgcggataatctatttgatgagattctactactatctgattttgtgtttctaggagtaaaa

SEQ ID NO: 58363 - DNA, 624 bp, Triticum aestivum
  Clone ID: PAT_TA_58363
gcggcgggctccgatcattcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaatttaactagtcctaaatcgctacttataaaaaaaaaaaaaaaaaaagggccctagg

SEQ ID NO: 58364 - DNA, 622 bp, Triticum aestivum
  unsure (1)..(622): unsure at all n locations
  Clone ID: PAT_TA_58364
ctgtgcggcgctcgagccggccgggctgcgcttctttgacaagcagaagagttcttctgcggcggtgcatagcgaaaacgctgaatagcacaagctgaccagacctttaccagaggctacagaattcgggtttttgcacaagctgaccagacctttaccagaggctacagaattcgggtttttgcacaagctgaccaagacctttagaagaggctcccgaattcgtttttttgcacaagctgactggaccttcacaagaagctgcctgccgagttcgggtttttgaggcgatggtgcgtctgactagtgtaccatgagggaggcagtgacatatccagcaggctggttccaggttaccctacctgttattttttgactaaatcccgggggctaaagatgtgattgtagagaataagtttgcgatgcggcgttatgcattcctcaaattagcctctgttccttgtccaaaagaattgtatagaaacaagctgtgaactgcaatgtcaaactctggcaccaacacatgcacacagggaagaaatacatcacatatactattttgngtgagcttcagttcaaaggatggnacgaaaaaaaaaaaaaaaaaagggccctaaggccg

SEQ ID NO: 58365 - DNA, 591 bp, Triticum aestivum
  Clone ID: PAT_TA_58365
cctgtgcggcgctcgaggcggccgggtctccagaaagggaaatcctctgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcattgacgacctcgtgtctgtcgacactcttattgaggaagtgctctgcgagacgcccatcaacgagtatgtccagtcgtgtgacatcgttgccttcaacaagatctagaatctttgttcacccacttgttgctgctggattcttggtactgggatctgtcgatctggaaaacattattgtcgtcccatttagttacccctcttacagaaatgctactggttttgtttttgagtgatgccctggtcttgaatgtctgctacctttaaatagttgaactgctgagcggtttgtaatggcgaaacatctatcatgtggagtaaaattagtctttgataactgtgataggataaaaaaaaaaaagaaaaaaaaaaaaaaaaaaggccccta

SEQ ID NO: 58366 - DNA, 695 bp, Triticum aestivum
  unsure (1)..(695): unsure at all n locations
  Clone ID: PAT_TA_58366
gccggccggttctctcgnacacagcagtcaacggcgttccccactccccattctccctctctccgatcgcccatctccgctcatatggccaccgaggtcctccgcccgcacaacatcctgcagccgcagacgcagaggatccgcgccgcgcaccggaggcccagcaaccccggcaccaccaggaggtctcctcctccaccggccacggcggtctcgacgaccggccggagacaccatggaaggccttcctcttcttcttcctcgtacgggaaggtgacgtctgcggccgctccggcgaggcgccccgcggtggaagtgtacgccggcccggccttctccgccgcgtcccccgagccgagctcgctgccgctgccgcagttcccgcgcgcagcaaggcctctggctcggttttactgtggccggcggtatggtgcgcggaggccgtgggctccgacgacggctgtctggaatgagcacagccagcgatgtgaccatggaccggcgtgatgtaattacaagtagaatcccaagtccaagaatgcctacatatatgcacgaccacctccttaatcccctttgtctctagttagcacgcagatgccaaatggccaaagttaaaggctaagattattttctgttcatgttgattanaagaagtttatgtgttgcaaaaaaaaaaaaaaaaaagggcccta

SEQ ID NO: 58367 - DNA, 789 bp, Triticum aestivum
  unsure (1)..(789): unsure at all n locations
  Clone ID: PAT_TA_58367
gccggccggtctaaccgaacgctgtaagcaccgaggagctcagtcatgtctccgagaacgagtctatggggcgcatgcagaactctcgcaatccggtcgagacctgtcgccccccgaccagccccattcgtcaacgctctcccacggaatcgatggtactcgaacgacggaaacgatcagctcccaaaggcaattgacaacgctcaaaagccccaggactcccaggttggctcggtttcggcaaagagtgacgcccccgaagcgtcgacaggaaacagggatgctgaggtgacgtctgcgccagcctcttccgacgagattatcgacgatgcgacactcgagcaaatattctacggcggccgcacacaatcgagcactatcgagggtggcctgacaccagcgcaggaggatattctttaccgtgagggtactattccttcggctgagaaggctgaagctctcgtcgcccaagcggaacaggctgagttggattcgcctgatagcactgagatgcaaaaccctggacacaagttcggtctgccgaagcgaccttggccggaaggcttcaacttgaagaagcgttaccatcctgtgctggagcaaatcactcgactcctcatgaaggatggtaagctcagtgttgctcaaagaaatatggctatcgtcatgaactacctccgaaccgcaccacctccgatctacagcccgttgtaccccctcctgcccggnactcccccggncacacatctccctctcaacccgattctatacattaccgtcgccgtcgac

SEQ ID NO: 58368 - DNA, 305 bp, Triticum aestivum
  Clone ID: PAT_TA_58368
gccggccgggtcactcaccagaaagcctgctttagcatatagatagatataggttgagaaaactcatcagctcttgtgtttcttctgctagctaaactgatgctggttgtagtagtggttgcagtgtcacacttctgacattcatttctgtgatgtggttgctactgcttcctggatgaagcatttcactgtggggttcttgcagtgaatcgatgatcctgcaatccttttggatgatggatgcactttgcataaatggaaaatgttgtggttgttgccaaaaaaaaaaaaaaaaaaggccccta

SEQ ID NO: 58369 - DNA, 169 bp, Triticum aestivum
  Clone ID: PAT_TA_58369
gcggccgcttcgaaggccggcccgggtctgtcgactgaacataattctggagtttcagagtactgttccatcttagcatgtatctaagctttctaagttctctgtatgaatttcgttgagtggtaaaaaaaaaaaaaaaaaaggaaaaaaaaaaaaaaaaaggccccta

SEQ ID NO: 58370 - DNA, 312 bp, Triticum aestivum
  Clone ID: PAT_TA_58370
gccggccgggtcctgtcctgccggaggagagttggacatggaggaggagatgggcatcgccgtcggccggaagaacgacctgtatctgtatgccaaagtccttgtgccgcttaattagcgcatgcttcatatgtcgcatgctggatgccatcgactagattggctagatcgaacattccagctgtatattacaattttgttaccaaatgtgtcatggtggtaatgtagtaatgattgtattatgttgttttcatggtttattaaaaaaatctaatatttttgtaataaaaaaaaaaaaaaaaaaggccccta

SEQ ID NO: 58371 - DNA, 442 bp, Triticum aestivum
  unsure (1)..(442): unsure at all n locations
  Clone ID: PAT_TA_58371
tgcggcgctcgagccggccgggctcgcggagagagaagagaagaggagccctccaccccgccgtcgcagcgccaaccaaaccctcgtcgtcgtcccggatcccgccgtcgccgccgcagccatgccgttcaccccgggaccctactccggcaagagcaccctcgccctcgtcgccagggtctccgccgtcggcgtcggcgtcgtctacggctccatcaagctcggcatcctcaagatgaccaagcccaaggaggaggcagcagctcatcactgaggacaagtagctccagcgggttgacgccgtagattcacaatgtaccttccatatgtgcattcggttctgtgatttgtgtcttgaaacccaaaaaaccccagacccatgtgggagctgaaccttagttttttgcttgtggaaaataatatcctcggntgaatcgacttg

SEQ ID NO: 58372 - DNA, 403 bp, Triticum aestivum
  Clone ID: PAT_TA_58372
cctgtgcggcgctcgaggcggcaggtctctctatgcgccatctttcacaacctacggcgcaactcagttctgccgtgatggtgtcgctctggtctccattgttgagcgttatatccccaatggctcttctatcctcgacagtttgaccgagggaattcagctcctgagtttaccagttgaggctggggaggcaggcggcttgacactcaaagaagccagtgacagagtatttacggataacgaggaggcgcgcaaggttcttgaggaactgcatctggaagagctgtcaccacagagcgccagaaacattctgcaacgccgtgtagagaataacgaaaatgtgggatggtaaaaaaaaaaaaaaaaaaaaaaaaaaaaaaaaaaaaaaaaaaaaaggccccta

SEQ ID NO: 58373 - DNA, 741 bp, Triticum aestivum
  Clone ID: PAT_TA_58373
ctgtgcggcgctcgaggcggagggccttgaaaaccttttcgtttccattgttattatttattcaaatgtgaatccatccctctcagttcactcaccaactcaaatcaactcatccacacaacaacctttacatacaacctgcacataataccaacaatggcctcttacacacatagccgaagtgcggtgagagctcagcgacgagactcgtcatcatcctcatcttcacacacaatgtcaaaccgctcaagaccacgtcttctacgctcaagcgcaactgagccttcaatcaccgtctccaatgctactggaaactcatttgctggtcccgagtcgccacacagagcaactgatcttctcaaccgtgttgccgtctattctccgtctcccgagcaagcctccaccccagcggcaatcccacgccataacagacccatgtccatctgccgtgatcaccacgagcactctccttccagcagccctggaagccaatccgccgtcatgtccgactccccctctggttactactttagctttcccagctttgaggagtggaaccaggacgacatcaccaaggacaatgatgattgagcggtggcggaaagagatggtgaggggatcgattatcaagacctcaaactgaaaaaacgcacacaacaacatcactccaacaacaacaacattcattcacccaacgcccgctagactcgtaacgagatagcattcactgggcttttccct

SEQ ID NO: 58374 - DNA, 416 bp, Triticum aestivum
  Clone ID: PAT_TA_58374
gattctactcaaacaaacgatccacgtttgctgctgaatatctgatggaacacaacatgtggagaacatcaggtgtccttacacatgcttgtacaaggacaactaatcagataccaaatagaaaactgccgatatactgtcgattttctattgcgtttcttccgcgggaattctgtaggaatcttatatataccgtatacctaccggcgacctccaggacccgacccgccccctattgagcctatatacgcgcgcattatgcgcgctcactgaccgccgcttgactgcgaaaagcactggcaataccctgctgaatcccctcgtaatccatctcgcctttcatcacctgttcgactagtgaagaagtacggaacaatcccgcatcgcatcaccttcgcaacctgagtgcagactga

SEQ ID NO: 58375 - DNA, 534 bp, Triticum aestivum
  Clone ID: PAT_TA_58375
gccggccgggaatcaaccagagcaacagagatcttctccattcctattctactcaacccctcgccgccgccgccgcagatcgcaccaccgaccgaccgaagcgatggccgcctccaccgtcgcgtccagggccgtggccgtcctcgccgtcctgtcggtcgccgccttctccgtcgtcgccgctcaggaggccccggcgccgagccccgtgtcggccgccggcgcagcggcgccgtccctcgccgccgcgctcgtcgcctccggcgccgccttcctcttcgccgccgtccgccactgaagcggccgcctccgccttccccgaccgtccgcccgtcgatggctactcctctacatctacatagtaccgccgcgtagatccgtttagagcgccgctgctgttaccacttaccactagcgatttgatgattgtccttgtccgcttgggatgatatgcttgatactgtcgatgacgatgatgatgatgactattatcttctatgagatacttgtcacacttgcataaatagcctttct

SEQ ID NO: 58376 - DNA, 287 bp, Triticum aestivum
  Clone ID: PAT_TA_58376
gccggccgggtctctcatctcccctgcttctcagcatacatcccgatggatatgcttgcttgcttgcttattcggagtagtatctgctggaagcttgtctgtcgctgcctttgttgattgttgctgcagttctatggatttgaacatctgccaaagctcgtgctcatgttttctttgatttccccggccgtttttttccttattatgaactgttgttctgcatcacaaaacagagcttaaataatttcgacgatgcaatggctggctagagatttatttatttagtt

SEQ ID NO: 58377 - DNA, 621 bp, Triticum aestivum
  unsure (1)..(621): unsure at all n locations
  Clone ID: PAT_TA_58377
gccggccgggccttcagcaaattcgaagcattcccatccacctccgccgccgcagccgcccgccgcattccgagcggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggcgtgctccccaacatcaaccccgtgctgctccccaagaaggccctcgagaaggccgagaaggagtcccagtcgcccaagtcgcccaagaggaaggnccccgctcccgcccccgccgccaagaagacccccaagaagaaggccgccgacaagaagaccgccgccgccgacaagaagaccgccgccgctgacaagaaaaaggccgccgccg

SEQ ID NO: 58378 - DNA, 359 bp, Triticum aestivum
  Clone ID: PAT_TA_58378
gccggccgggccgtgtgctctgtatcatacttggtatcgctgcctacctttacaatgtgcttaagaagtgagtgaggtgcaacggtgtgctcatgtcgcggtctgtagtggtcttgcattggattctctacttgtcatgtcctgctgtgatgggtttcaaacgtgtgccacgagtaattcgtttcgtctcatctgtgtaacatcatggtgttacattattattatgcttgttgaagcagtgatgattatatgtgtgttgacctgatgtctgattgtatgtatattcgggagtaaactgcttagtgagagtacaaacgccattcttttgttctgaaaaaaaaaaaaaaaaaaggccccta

SEQ ID NO: 58379 - DNA, 258 bp, Triticum aestivum
  Clone ID: PAT_TA_58379
agactccggccaacctgcggttaaagagattgatttttctccctctcgaggactcgaaacaaaccacattttaagtgaagcaccgcgaaggtgaccttcttctcgccctcggagggaacacctaaccctctacaagcgaggacaaggccatcttgaccacatcgggtatagacgcagaccacttgctgatgagcaagcttctatgtgagatctcgggcaagggttcccctacgtgaagcggtgatacgtgccccatca

SEQ ID NO: 58380 - DNA, 815 bp, Triticum aestivum
  Clone ID: PAT_TA_58380
gccggccggtctccgcaatccacgcccgtcttccttgcccacctcccggctacgcccatgcccgtcatctcggccacctcccggcgcccctgtccccacggccgcgacgtcccccgtcctaccgcgcaccgtccctccatctcccatgtgcgcaaccaaactagtgccgcacacagctaccgcacgtccttccggcccggctgctccacccgcctccagctagctactccaaccacggcgcggcggccggatccaatctatattgcatgatggcgaccaaatccatgacgggaaagagacccagtggttcccgccgtctcaactaggcatgtctcttcccctcatcccctctcacgagcacctcgatgttgtctcacggatccagccccttcacagccgccggccacctgcagcaaccccaggattgacggcgtctcccagactgccgcacagtcctgctccggtggcctcgagctgcagctctggcacatggtacaggacgcgtcgctgctattcccatgcggatccactgagttgacgatgttgaatcagctgtggcttccggaccattcaaggagttatgaagggcgtccccttccattgtggagatggtttcagttacgctacaagggatttcatttcttcctgaaaattctgccagtccttcctgatttgcacgtgttaatgtaacggttgaacatcagttctctctcatcatccattttgtgtaggtttaaggacatacataaggacatggcagttctctaatgagtagctaactgatcgcattttttttctcggggctctttttttca

SEQ ID NO: 58381 - DNA, 748 bp, Triticum aestivum
  Clone ID: PAT_TA_58381
gccggccgggcctggcattcatcaaacaaattccaatccagcatgtaccaaaccctctctcgcggccaatccatggatcgccgccgccagcaccacgccggagaattcgtgacggacgtggtgctgtggcggcgaggccgggcggagctgagcgcgctgctgctggcggccgccgtcgcctcctggatcctcttccacggagcctcgggttacacggccgtctcgctggccgccgacgtgctcctcctgctgctggcggtgctgtacgcgtggtccagggccgcgcgcctcctcggccgccccgccccgcccatccccgacctgcagccggcggccgacgagctcgccgcgctgattcattcgtgcctcgccgacctcgcctccgccttccgccgcgtcgcgcagggccagcccggctccggccaggtgttcctctgcctcgccgccgccgccctgctgggccgcctcgcgcgcgacctccccaccctgtgctacgcagttgtggtgggcgctctgacgatcccggcggtgtacgagagattgagcatggagcgatacatgaggatggcatctctcaacatgtacagatacgaggtcttgtaccagagcctctccctcacctgctacctcagcaccagggactacctcatcgagctgctcaaggaagcatgatcaattcatgcttttcttttctcttcttctcttccatttttgatggaagattgtgtttgggctttttctttttcta

SEQ ID NO: 58382 - DNA, 602 bp, Triticum aestivum
  Clone ID: PAT_TA_58382
gccggccgggttactgtcgtacgccatgggccggatggagtcggtgtggggcgaggacgcgcgggcgtaccggccggagcggtggctggacccggacccggcggaggcgacgttccggccggagagcccgttccggtacatcgtgttccacgcggggccgaggatctgcctcgggaaggagatggcgtacatccagatgaagtccatcgtggcgtccgtggtggaggagtttgaggtggcggtggacggcggctacacgccgcggcaggtggcctcgctgacgctgcggatggccgacgggctgccggtcagggtcaaggattttcgtggagggaattgagtacgacggtcgacgggatggagggaaaaatcttctttgaacgggatttctcaccgtgcagtacacaagaacgtgagtgagtcaaagatagattccgtgttgtgtccaataatcaaagtggtctactccctccgtaaagaaatataaaagcgtttggtgcgaagagagtatttcttagctactaggtactgtatcaattcttctctttttatgaataaggtactgtatcaattccaaaaaaaaaaaaaaaaaaaggccccta

SEQ ID NO: 58383 - DNA, 504 bp, Triticum aestivum
  unsure (1)..(504): unsure at all n locations
  Clone ID: PAT_TA_58383
gccggccgggctttcctttggtatgatatgattaggagtgagggactggaaaaaggagaggataaggattggggcgtataggaggcaatagttaacgggcaaccatgatggcgaataaggaataaacataaaaaaaaggcgagaggaaacaagaagactagaaaaacacataaaaaacaggttcaaggactagagagggtttggggttatgttatggatgcaccatggttaattggcttgggaggagttgcttgatatcagtaccagagttaaagggttattgggaaggtttatgttgcttcaatgtcatgtatcctaatggagggaaatcgatgctactatgtatgagtaattacaaggaccttgatctatttagttaagtttcccaataacatctaaaaaacacaaagacaaaaagaagattccagtcctaaaaaaaaactggnataagacgctattcatgctcggaatcaagtccaaaaaaaaaaaaaaaaaaggccccta

SEQ ID NO: 58384 - DNA, 559 bp, Triticum aestivum
  Clone ID: PAT_TA_58384
gtggcaggaatccaaaatcaggttaatcataccggccaacctcaagggggggccgggaccccaatccgcctaatagggagccgaataaccggggtcactgggcggcggtttaccaaggccgggatgggaaaaacctgggggtaccccaattaatccgcttggaagaccttcccctttccgccggtgggggaataacgaaaaaggcccgaccgaacggcccttcccacaagtggggaagccggaaggggaaaggaaaatggaaagggtaataatttggtaaaaatcccggtaaaattttggtaaaaccagttctttttttaacccataaggccaaaaccggaaaattccctaataattcaaagaataaaaccaaaaaagggtggagggtggtcccagttggaaacagaagccactaataaagaaaggggaattccaccgccaaaggggaaaaaccgctaatcagggcggagggccaataacgggaaccttcaccttatccaggtttttgggggccaagtggccgaaaggaattaaaccggaaccttaagggaagccccca

SEQ ID NO: 58385 - DNA, 119 bp, Triticum aestivum
  Clone ID: PAT_TA_58385
gcgcgctcactggccgagggtgtaaacgacaggacagggaaaagtctgaggatacagcagcttacggggcgagcttctacccgcttttgcggcagatggcctactagcgaatagtaacg

SEQ ID NO: 58386 - DNA, 644 bp, Triticum aestivum
  unsure (1)..(644): unsure at all n locations
  Clone ID: PAT_TA_58386
gccggccgggtcctcctcttactcatcaatttgtaaccgatagctggaaagaatcgaatcatgatacaaatttccgaaatccttccgtggcactatcagttcgcctttatgattttcgagccaagtgttatctttgctactctccctttgatcccagcatcgccgattgatcacttccactccctcgccccagccgacagcgctggacctttctggtcaccgtctcctctgcatggattatgcgatgcggcgtcggcatggaacactcctcagctccgcggtctctggtatgcattcatgtcggctcttgcctttagtggtgtcattgagccactgctattatatgtggctcggtataaattgcgagacgtccacgatgcagagcaagtcataaaggggcggttttgttcgcttttatggcatttgatgcttttcatgcatctgcgacattagctgtgacaggtataggggcagcacttcctggatctcgcatgaacgtatacgttgtggtcaatgtttgggtccctactgcatggttgcttttgcggacatgtggatggntggtattgcaagaaaggcttctatcaacaagaccgttcccaggaagatcaaggattaattaaccttaactctatttactttat

SEQ ID NO: 58387 - DNA, 521 bp, Triticum aestivum
  Clone ID: PAT_TA_58387
gccggccgggctgcgaagacggatactgataatggaaagcttatcatagagcgggatagtttttatacttaacctgctgttctggctaggtagacatcgacaaacaacaatccgacaacacaacggttcaatcagttggccttctcaaccttcgaccgttcatcgcaaccaagaacattcataatatttccgcaaagttattggataaaattacacaaccagagagccatgtgctcgtcggtaaagatgactcgatttaggcgatgggcgggtttgcgaagttggaggaagaaagaggcgcttacccattcgaagcccgacaccagcatcacgatatcatgacctggactttacgctatctcgatcgacctttcgctaccaatcatgtcgagtgcgctcatataaacaccatggattgactttcttataaaaaaaaaaaaaaaaaaaaaaaaaaaaaaaaaaaaaaaaaaaaaaaaaaaaaaaaaaaaaaaaaggaaaaaaaaaaaaaaaaagggccccta

SEQ ID NO: 58388 - DNA, 455 bp, Triticum aestivum
  Clone ID: PAT_TA_58388
gccggccgggctcttcatcatcacactcacattctcatcaatctactactacaacaaacaccaacttcaactcacctaccacaactcccaaacatcaccatgtctgactacaagcccactgagcacgacggtctccgcaaggatggccagcccgacggccgcgtcggcactggcgagttcgctcacggcaaggttgacccccatgaagctggtgtccagggcggaaagacctctggcagcggcagcagtggaggtctcgagagcaccagcgacgacagcggcgattacaagcccactgagcacgatggccttcgcaaggatggaaagcccgatggccgtgtcaagggcaacaactagatacacatgtcttgacgaagcgtttaacgaagcgttatatgcctagcattgaatgagaattgttaacaacccaaaaaaaaaaaaaaaaaaggccccta

SEQ ID NO: 58389 - DNA, 442 bp, Triticum aestivum
  Clone ID: PAT_TA_58389
gccggccgggctgcgatccattgctattgtcgtttaattttgtttcaattgttaaacaccagcaactatgacatccacaaaaccgacgtgttcgctctgcgatttatcctttgacaatagccaagagcacagagtacatgcgaaaagcgaatcccatgtcgctgctttgagacagcgtgcggttgcttcgggattgatcgatgaaacagttgacgacgaccatacctactccagtcatacacaggtcacgggcgcttcacacggacaaccatcaggcagtgatacagaaaccgctgatgaagtctctgatgaggcattgcccgagtttgagcctgctaaatgcattatttgcacccaaaacaatgaaagcttcgatgacaacgtccagcacatgaagacagcacacagtctcagaatcccatatgagaatcaccctaagtgt

SEQ ID NO: 58390 - DNA, 247 bp, Triticum aestivum
  Clone ID: PAT_TA_58390
ctggcggcgctcgaggcggcgggtccgagaccaattcctttctcttataatttaagagaagatagcgacaacgacaagatcttgccgagcgcatcaagtgatacactcggtactagcaccttttagattatttgtcaagcggccatttgacttagcttattcagatatttaggtacatatttatttatgtgtaatgcatacaacatgtgtttatctcactcaaaaaaaaaaaaaaaaaaggccccta

SEQ ID NO: 58391 - DNA, 405 bp, Triticum aestivum
  Clone ID: PAT_TA_58391
gtgcggcgctcgagccggccgggcctgcactgctgtgctgaactcagccccttccctgcctgcccgccactgccatcccgccccgccccgccccgccccgatccggtgatccgcccaagaacgaaccaatggcgtcggcgcgccgcctgctgcagacctacccgggccagttccaggccgccgagccgcccgacgccctcggcgccgactccgacgtcgtcgtcatcctcgccgcgctgctctgcgcgctcctctgcgtcgtcggcctcgccgccgtcaccggctgcgcgcgctcccgccgcggtgccggcgccaccagatccgccgcctccgacgcgagcaaggggctcaagaagagggcgctcatggcgctgccgaagctggcgtacgaagaccccgtgccgg

SEQ ID NO: 58392 - DNA, 619 bp, Triticum aestivum
  Clone ID: PAT_TA_58392
gccggccgggcctggattgtgaagggcaactttgattgactttttttctccttctgtgtcagccaatttcgtggaagacgcctcaatgcttcgagttcggcgaggactgggctctccagccagctttgcgagcatctatcgaccgtatgtacgatatccccgacaatgtacactcgttcgatcgtttgcgacagaccccaacctggacaatgcctctgaaccacctacagactccaagtctcacactgagaacattccgaacccactcgattctaccccagatatattgcaggaacttacgagcagagcacacttgaaggaggcccaggaagtaaaagagcaagaggaagctgtcaaccatgggagtgtcagtaatgatgccaacttcaatgaagcactaaatgtgatccgaagagtctatggtgtcgaccacaaggaaaagaaaaagacaaccacatctcagccccaggctggagaatcaaatgatgcacaagaaacaattcgcgaagacgatatggttgaaacagattcattagcaggaacccaacaaactgcagtatggacttctctacgcgagaagctacaacagaagatatccccaacatcctcatacacgttt

SEQ ID NO: 58393 - DNA, 788 bp, Triticum aestivum
  Clone ID: PAT_TA_58393
gccggccgggtctcgctccacttgtcgccgccgtggccggacaccaccacgagccataccaccgtgccgaactgcttcgccgtacaccgcagcgttgcctcacgtgacgaatcggatcggagcaccgtagcctactcccgcaagtcgacttccttgcctgcgtcggaggtcgtcgtcgtcaaattcctcaacgcggcgacgcctcagactttcgctcgaccttcctcgccttcgctaccccgccgacgactctcgggacatatcagcgtcaagctccgctaccccgagccccttcccgtcaacgcctgtctgacagctgccgcggagctccacggccacagctcttgagctgcctctcctcctctacatcgtcttcaggaccatggagctacagagttagagttacggaagccgcaacaatcccacgtggtacaaagttagagttacagaaagatcaatgatacatgcgagcaaggaggctccccgcagactctgttctgcaccattggtgggatagtgcatttgaagcacatgtagtgggttagacagatacataccctaggttacagcagcgcaaagccctgcaggtcaccggtttccattcaacgaatctatcttagatgtgcttgaaaatactcgcaaccagcttgccaatgccatggaccacgggagtttggctcaagccagaatgccagattgcccaccaagttgctatgacgaatgatccccatttctccctcgataataacgatttttgatacctccccaccctagaggatggacacact

SEQ ID NO: 58394 - DNA, 595 bp, Triticum aestivum
  Clone ID: PAT_TA_58394
gccgggcttgcaggttgtcggcatcgatctcagccccacacaacccagcttcgttcctcctaatctcacattttacatcgatgacatagaagatcagtggacgttttcgtacaaattcgacatgatttatgctcgcatgatgacaggatcaattcgcgactggccgaagttcatccaacaaagttacgacaatctggagtcaggcggttggcttgaattatcagatattattctacaactccactctgatgacgatactattcctgagggatgtgcagctgccaaatggggtgacctgatgctcgaagcagctgacaagttcggagcccctctggacagctgtctacggtataagcagcaactactcgatgcagggtttgtggatatcgttgagactatctacaagtggccaaccaatccctggccacgcgatcccaagttcaaggagatgggcttgtggaattatgaaaatcttggtaatggagcttcgggtttgagtcttgctctattcacccgtgctttgggctggaccgcagagcagggcgagatttctgtgcaccagccaagctacacatgagaacccgcgacgtgtggg

SEQ ID NO: 58395 - DNA, 575 bp, Triticum aestivum
  Clone ID: PAT_TA_58395
gccggccgggcctgcgagaggatacacaaaggcatgcatgcacgtaggcagctgtagtgctgaatttgcgttctccatataaaacaaagagaccacgcactagaagctgtgacacgaaggagaaagggtcatgaagcgtcccccttctccttcttcgtcctgtgtacgcagcgttgtgatccttgctctcatatgctgtacgtatttctgtgagggatgatgattgatggttcatgcgcatgcatatgcacgcagttgctctagatggaagccgtgagccagagagtcctccgccgccaattgcacggtccccagaagtctccaatggttccagctccaactccaaggcctgcagtgcctaatcctccgccgccaccgtccccgccggtgccggagatgtcacttgcgcggcaccgtaagatcctgcagcaagttgtttggaacgccaattaattatgcatgaaacagtgccgctcatatattatttttgtatacgtacgatggtgctatatctttacctctttacctaataataataaagcacgttaccatggggctaaccatttgttttctgt

SEQ ID NO: 58396 - DNA, 580 bp, Triticum aestivum
  unsure (1)..(580): unsure at all n locations
  Clone ID: PAT_TA_58396
gccggccgggcctgcacatttgcctctgctagcgaccccgacttcgtcccattccactggaagacacgatggttcatccttgatggctggctgaatgttgtctactttgccgatgtagcatggattgcgtatctctggcgccctacgtctaacaaccgtcgcttcgccatgagtgacgaaattgcccaagatgacgatggcaactttgaccttggcgatattggtgttccaggagaggactcagatgatgaggaagccgaagtcgccaagcctcaaaacaactcacagaacgccaacggtctgtcgttctcaagcgcatctcggagcgccccccaacagccaaggaacacccgcaccggtcctcgcaaatcgctagagaacgagaccatctttgccgttggggaggacggagacaagttttcagacgatgacgacagtgacgaagaagacgcaaagcttgtgaaagccaaatgagaaattcagggcgttgacttgngatgaatgcttctgtggccacctctcggcgcattgttttttgtgtacttatatgtctgccannaaagatcanatcttactgatg

SEQ ID NO: 58397 - DNA, 730 bp, Triticum aestivum
  Clone ID: PAT_TA_58397
gccggccgggtcgtcctatcgcaacgcaaggatgatgatggtcgatatcctattcactgggcatcgtccaataaccttgaaatcgtccagttgctagccaaccaacgcagtttcgatgctgacgttcaggacggaagtggatggtctcctcttatgatttcagccagtgtccccgaaagtgaagctgttctaaagctcatcatctctaaagatgccgatgtgaatctcaagaattttactggccagaccgcccttcatttcgttgcctccaagaagaacctcgacattgcccgcattctcattgacagcggtgcatctactcgagttcgcgatcgcagaggccagtatcctatccatcgtgcagccgctgttggctctgtgccaatggtgaacatccttcttaaaaacagaagcccgctgaatcctaccgacaacgagggttacactcctcttcatcatgccattgcagaaggccatggagacacagcagtcgcccttctcaaagaaggcgcagacttcactctcaagaacagtgcagaagaattggccatggatctagctccagacaaagaagtgcgccgatatatcttgcaaggtgctgagcgtgagggtatcgagatgtcagggtaaccaggaattagtgttagaatgaagaacaagacaggcactgaaaccagcgcgagtttgagattgcgtgccgaagcaaaaaaaaaaaaaaaaaaggccccta

SEQ ID NO: 58398 - DNA, 651 bp, Triticum aestivum
  Clone ID: PAT_TA_58398
gccggccgggtctgaggttagaaaaaatccgtatttctcctaaacaaaccgctcagcaaaagcacagcacagcagcgttccactacattgggttcccttcaacacgctacccgcctcacctgccataacttataacatctacgtcttcttattcactcatcgccaatacgtctcacttaaaaaagtacaatacaagatggccccaaccaacgacgcaaacaaccgagccacaaaggctgcgggttcggattcgggggatgccgatttggcccaagcctaccgggaccttgctaggggcgagcaagctgctaccaacctcgagaacaacctcacaaacctcgaaagcagacttgacgccatacttgctgcccttgaagccaacgaaaatatacaggttcctgcagctaccaaggtatctcaggccaactactcttctcaaagcaccagagcaacaggcaaccaagacaaactccaggacggtatcaatgaaaacgtagacaaaaaggacacagcttgatcgactaggaagtgttggggctattcggtttaggtcacctcatgtcacatagtaacttagataatagagagagcgtggtatgccagtcattgatgagaaaaaaaaaaagaaaaaaaaaaaaaaaaaggccccta

SEQ ID NO: 58399 - DNA, 759 bp, Triticum aestivum
  Clone ID: PAT_TA_58399
gccggccgggctcttgaccactttcaattgaagaattgcttcccattcttttcctatcctttatattttaaagtcggcaataattcattgacaatggcttcgagaatatctacaggccagctctgtaggagcatttcacaggccagttcgcatcgtcttgcgctaccccatattgctgctcaaaggcggtatctggccactactgtccatcctgtcacccaagatgcgaccggatccaagggtccaacagctatggtcttcctcaacatgggaggaccttcgactactgatgaggttggcagctttttgagtcgtctttttgctgatggcgacctgatccctcttggtcccctacaaaactacctcggtcctttgatttcgaagcgacgaacacccaagatcatcaagcaatactctgcaatcggaggaggatccccaatccgcaagtggtccgaatgccaaaacgccgagatgtgcaagatcttggacaagatctcgccagagactgctccccacaagccatacgtcgctttccgatatgcggatccattgaccgaggagatgtacgagcagctgctaaaggacggttttggtaacggcaagggcggtcgtgctgtcgcattcacacaatatcctcaatactcctgctcgacaacgggcagcagcttgaatgagctgtggaagtggaggcacagacttgagggcagaccaacaaggagtctggtgacggactattacatggagtgtaattgacgctgc

SEQ ID NO: 58400 - DNA, 556 bp, Triticum aestivum
  unsure (1)..(556): unsure at all n locations
  Clone ID: PAT_TA_58400
gcttccttccctcgccaccacccacagccaaggaggatgncttgctgcggcggcaactgcgggtgcggcgccggctgcaagtgcggcaacggctgcggcgggtgcaagatgttccccgacgtggaggccaccgccggcgcggccgccatggacatgcccaccgcctcccaccaggggagctccggcgggttcgagatggccggcggggagaccggcggctgcgactgcaccacctgcaagtgcggcaccgcgtgcggctgctcctgctgcagctgcaactgatccggcgcacaggaggccggccggcagaggcgagcaccaagatgaggaggagaaacaagcaatcatcatcaccaccaccaccacccaatcgtatcaataccactaagccgccgcatgcccctccgcccgcgctaaataaaataaaaccgccatgcgtcccctagttctggacaaaccaatgtcccctcctcatgcctccacttctaaagaaaatcatggcgcctccaactttgaacgcacccaaaaacaaaaaaaaaaaagcccccaacggccc

SEQ ID NO: 58401 - DNA, 668 bp, Triticum aestivum
  Clone ID: PAT_TA_58401
gccggccgggatcaaaatacgggttgctagtagctaaccttccccccgaacgcgtagtagtagcagcagcagcagcagggtagctcctcagtccagtacgtctcgggtgagcaagatcagcagatcgatggcgctcgagctctgtcgtcgcatgaccgcgtccgccctcctcctgctcttcctcctcgtcgccacagagatggggacgacgacggtcaaggtggcggaggcgcgggactgcctgtcgcagagccacaacttcaaaggcgcgtgcctcagcagcagcaactgcaccgccgtctgccgcacggagaacttccccgacggcgagtgccacgcgccgcactaccagcgcaagtgcttctgcaagaggccctgctagtccgcccactcgcccggtcctgccgagacgtcccatgcatgctactgtagatcatccgtgccgttagctcgttctgttccgttcgccagtgcgtccacgttcgacgctacttgttcgtgtgtcccgctcggtagaactaataaagtagaaaatcaatcggggtctctcgagtttagttggctgtacgtcgtgttggttggcacctgatttgtactccatgtggtgaactggtgatgtaataaatatggtcgttgtttcagcaaaaaaaaaaaaaaaaaggccccta

SEQ ID NO: 58402 - DNA, 370 bp, Triticum aestivum
  unsure (1)..(370): unsure at all n locations
  Clone ID: PAT_TA_58402
gtgcggcgctcgagccggccggctttcgacctggcctccgccgcaacccnatagcatcgcctccctcctcccctctcccgggcgcctccaccccccgcctagcggtgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcctggagaaagctgctgtgcgactatcattttaagcagtgggcggtcggtctgcggggttttcgccgccacccctgccagccacaccccccacccccttttttttttttttccccccccccc

SEQ ID NO: 58403 - DNA, 514 bp, Triticum aestivum
  Clone ID: PAT_TA_58403
gccggccggggtcagaaacaagatggagaacccatcctgtaactcacataccggtgacactagctctacaagtatcagtgatgctctccaaaaacataaaactaaacatgtgatgctctccacaaagaaaggaaaatgaaaatgctctataagtgatgttcaaacgtcagacttgaaatgtgttattttgctgtatcatcttactgtatgtgtcctaccttagctaaggtcgctccctttatgccgtagtttgctccagcttggctggaactgagaaagttattgggacatcgacatcaacacatgaacgttgttgcacaaagttattgaaactgccacattgtttttaccctcactggcaagaccatcacgcatagaggagggggccccaaggcccctcgcccttgtgaactacaggatcccccacgatgaaggaattccatattaacattatcgactcctcttacccccaaaggaggtccaggatccccttcccccgaatgagtatcacatt

SEQ ID NO: 58404 - DNA, 455 bp, Triticum aestivum
  unsure (1)..(455): unsure at all n locations
  Clone ID: PAT_TA_58404
gccggccggntcaggagcggcggccccaaggagaccgttgccgctatgcccgaagatggcgagttctctcctgagatccacgagttcttcaagcgctctagccccaagcacattggtcgacgagacgagtcactcatggtagactcagtgaacgagaagaccgccgcgccttctgatgattctattacgaaataattacgtccctttctgctggatggcattcgtaacgaatcactaccacatacatatgtcatcttactggagcgagcggctgatagcatgggtttggcgttaacggtattcaatgcattgctagtttttatggaggatccaaaagtttgatctgtgtatcactttgatacaaaacccgtgggcagatagtttgttctagaaataactacaaagacaaaatagaacagttcccatcctaaaaaaaaaaaaaaaaaaggccccta

SEQ ID NO: 58405 - DNA, 204 bp, Triticum aestivum
  unsure (1)..(204): unsure at all n locations
  Clone ID: PAT_TA_58405
gcagcaaagaaganancaagnacgncggaagggggggggcggcagccacagcaacaggagacaagacagaccaagaccaggagcaaaccgagcncgngaagaaggcgcggcagcgagaccccaacaagacnccgcaccgaacacggagagccagagcagagccagcagaacggcggagcgccgaccacgcagaaaaacaacagg

SEQ ID NO: 58406 - DNA, 399 bp, Triticum aestivum
  Clone ID: PAT_TA_58406
ctctccataacaccatctcccttggtccgacctcctgtgatgcacccatgacgacaatattctacgccgagtcacctgatacacaaccccagctcgatttactgccaatctgttttaattgcttttactttctgcttttcccaaaaacgacgcaggcgccatgtataccacgttcctttaacgctcgctacaaccgaatcatatcacgttgccatgcaaccacgccaacactccttcaacatcgactgatacacgcgcctgggagtgctgcatcatacctcacactcattaatacccgtcaccaaaagtaaccgacgctccttcaaatgatgataccccatagacactccttcttgatgactttaccacgattccatcgcctatacaattgatttctta

SEQ ID NO: 58407 - DNA, 177 bp, Triticum aestivum
  unsure (1)..(177): unsure at all n locations
  Clone ID: PAT_TA_58407
gccggccgttcttttacttgtctctgaatttgccttagctntgtcgccggccgttcatcagttgaacatatcaaaccggtcggtacgtatttgtgccgtgcgtgcgacgatgagctccacgggaacgtcgccggcggcgggaagaaggcgtcgtggccggaggtggtcgcgctgccc

SEQ ID NO: 58408 - DNA, 446 bp, Triticum aestivum
  Clone ID: PAT_TA_58408
gccggccgggatcaaaagagggagtgatcggatggcagtgacaatgaggaggggaattacttgggcagaagaacaagtggaccaaggctttggagaacataaaggagcgcattgacgctgcgttgacaagctttccgcatagattactgagctatgcagaccgcttacaaagcggcgctgatcgaggacgccatagacaacatacatcacggtgtctccgctcctcggcctcaggacttgatcgtccgccactaccacccccttctgagaccgattagagggacttttcttgtctttggggctggtattgctgtgcccccagcgatgatttgagacttgattgatattttgaacatgacttgttggatgcgtggtgccggtgctttataatatgaagcgtggggaaaccctttatgcgcaaaaaagaagaatgaaagggtccctat

SEQ ID NO: 58409 - DNA, 540 bp, Triticum aestivum
  Clone ID: PAT_TA_58409
gtgcggcgctcaggcggcggtacaaacatgggaagtcgcacgcaaatgttgcatttgtaaggaactggtgctccatgatgcaaggacatgctctaagaaacaaatgacacaacagtagagatgcatgatgctctgacaacaggaaataacaagactacagatggatcgaagaagcttttattcaagtctcccctttctgacaattgagagaagttctatgcaggataaatataactctgttcttgatcatgcatctgtacttgtctgtgctcaactgaatcgtgtttgcttggtgtggtctctcccagcaaagaagtttgatgagcaagtagtggaactggagggaaatgctagagcttttctgttatgtaccgtcaagatagtagatcttatcgttttaaatagcaatgcctgttgagtgatgatcatattagtccttaatactttgtcttgctggccatgtactaaaaatagtgctaccatgtctcatcaagatatgtatgcttgtgaaaaaaaaaaaaaaaaaaggcccctagggca

SEQ ID NO: 58410 - DNA, 622 bp, Triticum aestivum
  Clone ID: PAT_TA_58410
gccggccgggtccggtcaaggtgaacaaccattatctttatacttcccggtcgcggccgaaactttctcctccatcaagagaaacgttgccatgacccgaaccggatacatggaagccttcatccccatcttcttctagtcctcgtcggaccgtcggcgaactcggccatctaccggtggtcttctccccgcattgcggcccggtcaagaatctatcattatccgcttgcgcgtacatcggatcttttcttttctgttgaggcttttatcaaagccgacattttatcttgtttaatctttttcattttcacacaccatcagggtggatcgcatacatggatggagttttacttttattgcatcattaggacatgggacactggatacagtacaggttcttgcatcagtcctcccaacactgggatgaaccagctggtacacacttgggaacgggaacattagggcataggatatgcacccacacacagcattgcatggttaacggcgacatggcatggaatatttagataccttaggatagttcggcggcccagtgcctgccttgattttcaagataccctcttattagttagcatcaacaatcatacttggcatacatctc

SEQ ID NO: 58411 - DNA, 502 bp, Triticum aestivum
  unsure (1)..(502): unsure at all n locations
  Clone ID: PAT_TA_58411
ctgtgcggcgctcgagcggcgggttcggaccgcnaataaaggtatataatgcaacacatgatggtgttagccaagaccacaaccttagttctcgggctcccatattcgccgttgctcttctagtcatggctactggttctttctacgaaggagtgtcagatgaagtgatgagcgatacgactggagagacatgtgtggctgactatgaatgtgatcaggcatcgtgtggagttaggtgccagatcatgaagatggacccaagtgcggcccgttgccgacacagtgcctactccattccctaccgctgctccctcccccccccccccgccccccccccccccctttttcgtgcctttcccccccccccccgcggggggccgggcncgccgcaaaccccccccgccaccccccccaaaaccaccccccccccccccccccccgccccccccccccccccccccccnnccccccccccccccccccccccccccccccccccccc

SEQ ID NO: 58412 - DNA, 388 bp, Triticum aestivum
  Clone ID: PAT_TA_58412
gtcggccacacttttactttcgttattggggaaggaaaatgacaccggaataatttggtaaaaatcccggttaatttttggtaaaaccacttctttttttaacccataaggccaaaaccggaaaatcccttattaatccaaagaataggacggggaaggggtgaatggtggtcccggttggaaccaaaagccaccaataaagaacggggactcccaccgccaaggggggaaaaccggctaatcgggggaagggcccccaacgggaccctccccccaatcaaggtttttgggggcgaaggggccgaaaggcccaaatccggaccccaaaaggagccccctttttttttttttaccgcggaaggcggggggaactggccaaaaaaggaag

SEQ ID NO: 58413 - DNA, 699 bp, Triticum aestivum
  Clone ID: PAT_TA_58413
gtgcggcgctcgaggcggccgggttcagaaacaggtcgaagagtgggtctctttctcgcggcggcgcaggcgtctctctccttctcctccggcggcggcaaggcattttggcatctgagcccaacagctagcagatggcaggcggcagagttgcacatgcgaccctcaaggggccgagcgtggtgaaggagatcttcattggactcacccttgggctggttgctggtggtatgtggaagatgcatcactggaacgagcagaggaagacgcgatccttctacgacatgcttgagaaggggcagatcagcgtcgttgtcgaggagtagttctgaagtgctgaaccagaagttctacatctcgaagtcttttgtcattttggttttgccagtaatttctgaaactctctggagagcatgacagagtgattgctgtggagattgtcatgaaaataagcacaccaccatttgagaacatcgaaccattttgaatttgctttttgtcgtatcaaatatgtcttgtctcatatgtgttgcaaaccaattcagcgattggaaggcttccctctgacatgaatatgatttagatttcactgtcatccttttggaagtgagctaacaagctactccttatgtttgatattatcatgaatggaacaagcaccatcattatgaccaaaaaaaaaaaaaaaaaaggccccta

SEQ ID NO: 58414 - DNA, 485 bp, Triticum aestivum
  Clone ID: PAT_TA_58414
attgcatggagtagaatcacactgatcggcaagagcgctcagaggaagctgcgagtcagaagtagcaaatgatggatgtgctgatgagaatgaggaatagtaggagtagctctacgggttgggaataaataaagaagttgcatgtatcataacctttgtaatagctagtaatgaataaagttggctcttgtgcaaaaaaaaaaaaaaaaaaaaaaaaaaaaaaaaaaaaaaaaaaaaaaaaaacccaaagggccgcagaacgatctacagctaatgcaggccccgaggctccacgatttctttatttatccttaccgacgccggcgacctccaggcctggcgcccctacccccctcgccctatatagaaataaaggacccccgtggcccgggggcttcgatctttcacgtttttcccacccccccccctagaggggcggaccaaaccccccactcccccccatgggccccaatcccccgcccccc

SEQ ID NO: 58415 - DNA, 491 bp, Triticum aestivum
  unsure (1)..(491): unsure at all n locations
  Clone ID: PAT_TA_58415
gccggccggttaccgatgcagcgcggagtgaacagnaattccccaaaaaatactagaaaaattcaaaacatctcaaaaaaaaaatgtggtgaaagatgcgcgcatttgaacattcgacgagttctcagcaaaaaagacaaatatgaggtctgtgaaaaagtttacttttgcactatctggagctgttttttttttttgctgagagctactcggatgtctgaatgagctgaaacttggcatggacatcgcacactcgagcatctttcaccacaaaaaaattggattttgttttgaattttctagtattttatttgaatctactgttcacagggtgtagatgagctcaggagctgaattggatattccccaaagggattttttttcctttttttaccatttaccaatgtaattaactattacaactgccctgtttggtttgaacatggaacacatggaggatggaggctagtcttttccttgagcccccctgc

SEQ ID NO: 58416 - DNA, 724 bp, Triticum aestivum
  Clone ID: PAT_TA_58416
gccggccgggttcaaaaggggtcacctgcctcgcctcatcctcttgctcgcgccgccgcatccttgctccggcgaaccccaccaccagccacgcagggagctgcaacaggaggacaggggagctgtaaccggacactccgggagctgcaaccagcgggcagaggagctacaagccgggaaccaaaccgccgaccatcgtgctggaaacaacacgcaggggtgctgcaaccggcagatcaaagagctacaactgcggttagtttttgctgggaccggtgagaaatttcgctgcatccattgacggtgagcctttctttgctggaaccggctttctttttagctggaaccatgtttttgttttgctggaatcttgtcatgcttgctagtagcttgcagcgagaacacgcatctgctcgccacggacgacgatctgcacgatccactccgctcgcaggagagggcaaccaccatcagaagatgctgcaacctcggcgcggcggagctacaagcgtaggcccggaagctgcaaccagccagacaaataatggaaccggcaacggccgtgctgcgacggcgacggcggcggtcgaccattgctggaaccagctactttttttgctggaaccaccattaagttttgctggaacagctttttttgttgctacatcaactagtgtggtttgctgctgagttttttttgctggaacagcatttgtgattgctg

SEQ ID NO: 58417 - DNA, 799 bp, Triticum aestivum
  unsure (1)..(799): unsure at all n locations
  Clone ID: PAT_TA_58417
gtgcggcgctcgaggcggccgggttgcgagaaccctttcattgctcctcacattcacactcacccatcaatcgatcaatcaatcgcaacagattgtatctcaactcacacctctctttagcttcgctccatcgtcctgtcacactgcactgcagaacagaaacaaagacccctctacctctcttacacaccctaacgcttgcaagccttaccgtctgcgacgtggccagggacacatcatcgcgaagcctagctgtgcgagcccgaaatcccctttgacaaaggacgctagcagccgctgcaggtagccaaatatgtcggattccccccaatcccctcccaaggaggttgaccaaggtgcaccgtcacccgacgacgaagcacaaatgaatgagcaacaagacccacagtccgcaaacgctgcgggttacgagtttgaaggcgtaaaggaacaagaccgctggctccctatagccaatgtcgctcgcattatgaagaatgccctgcctgacaacgccaagatagcgaaggaggcaaaggaatgcatgcaagaatgtgttagcgagttcatatcattcatcacaagtgaagcatcggaaaagtgtcaacaggaaaagcgcaaaaccgtgaatggcgaagatattctctttgccatgacatcccctcggntttgaaaactatgctgaagccctcaaggtttatttaagcaagtatcgcgagcaacagaaccaatcncaccgtgaaagagtaaacatggataacggacagtggggttctggtaccatgatgggcgatgctaa

SEQ ID NO: 58418 - DNA, 588 bp, Triticum aestivum
  unsure (1)..(588): unsure at all n locations
  Clone ID: PAT_TA_58418
gccggccggngtcagacagactaattttcgttttcttctttttcgacccatcaaaaaccgaaacatgacttccttagctcaatcatcaaagcagtctggtttcccaccgtccgcaccgctgtcgccatccctcgtaaccgctactaagattctctcaatcgttcggatcgctacgggtggagcctgtcttttcgcaccacagctcacatgttcgctacatggttattatgtgcccgctccatacgcgctgctggtgcgtatgatgggtgcccgtgaagctataaacggagcccttttgtttactgcatcagatgggaaggagagtgatggagggaacagatttattatgagggccctgtgggttggaatcctggcggattcgatggatatctgcagtgtactctacggatttgctatgggagaggttgggacgtccacggctgggatcttaggtacagctgccgcaggagcaattactatagctgcattaatgctccgagtattataacctagtataggtttataattattataacccttaaagtaataagaaaaaaaaaaaaaaaaaaaggccccctggggccgcgg

SEQ ID NO: 58419 - DNA, 356 bp, Triticum aestivum
  Clone ID: PAT_TA_58419
gccggccgggcctggaagagggtgccttcgtaaagggtccagatggtgagaacatcgcgttaggtatccctgcgaaacagaagcaagctgcgggcgatgctgctttcgcagatattcctcttaggagagcgggcacaccaaccgaggctgcgagtgctatcctagctgtggccagtccgttgttttcttatgtgtcaggacagaccattatggtgactggagggcgtaacatgtaacattcccatactataattgagagacgaagccatgcttcagagatcgcacgactgaagaaacgtggtattagattaaatggtactatacttccccaaaaaaaaaaaaaaaaaaggccccta

SEQ ID NO: 58420 - DNA, 840 bp, Triticum aestivum
  unsure (1)..(840): unsure at all n locations
  Clone ID: PAT_TA_58420
gccggccgggcctcgaggatagagaggccgattacgggatcaaatcaatcgctctcncaggacaactcagttcaatcgggtcacataaatctcgcccaacatggtcggctctatcctccgccaattcttctccccggcgatccggcgtcccctcgctacggccatctcaacaccacccagccgtcttctacaaccgtccctccgaacattcaccaccacaacaccccgcgcttttgctcctacgaccgctcgccccgcgactctgaaccaggtcctgcgtggaattcgaaagggaaagcgcgctcgtcacgctgtttctcctgctctatccaacacacactgcccagctctcaagggtgtatgccttcgagtcggtgtcgttcgacccaagaagcccaactccggtgaacgaaagactgcgcgtgtgaagctctccaccggagctgttgttacggcgtatatccctggtgaaggacacaatatccagcaacatagtgttgttcttgttagaggtggtcgtgcgcaagattgtcctggtgtgagataccatcttgttcgaggcgctctggatttgggtggtgttgcgagccgaacgacgagtcgcagcaagtacggcaccaagaagccccagaaggctactggtggttaagcgaatccnttaataatgaactagatgcgcgactttgggtaaacgatcgatggtaaagcaacgggattagaaccgtgtcgatgatatagaccaggctgaaccatggattgatattgacactatttccagcatttttttttttaaaaaaaaaaaggaaggggacgaatcgaaacaattcttcattctactcc

SEQ ID NO: 58421 - DNA, 683 bp, Triticum aestivum
  unsure (1)..(683): unsure at all n locations
  Clone ID: PAT_TA_58421
gcggcccgctccgaggccggcccgggcctgcgaaagaccctcccacacaactacacaagtcccaaaccatctgcaagcatcattcatcctagctaggctcctaacttacttgtaccttacttattaggcaaggaagcaacggcagcagcaagaataattgaggagaaggaaaggaggagctgataagccatggcgtccatgatgggaggagacttcgtggaggcctacgtgctcaggaatgcctacaaggagaagctcaggcgcatggaccaagccgaagcggcgctcgacggcgcaaagagcggcaaggacaaggaggccgccggcgccgctggagagaagaagactgctggtggtggtggagcgagcagcaggggaggattctttggcctcatgaagaagaaggtgcgccccaaacccaaggcggcggcgacttccccttgaatactgtatttgcgatgccacgaaattgtaggccgcagctttcttctagctaggagcgtgtgtgtgtgtgtaagtttgttctttcgatcgtttagcttctcttggaggagtgtgtaaagcaaaaccttttgttatttggtaaaaaaaaagttgaaaaaagttacgccaagagtaatcctgcatcaattgagttgacctccctttctactaataaaaaaaaaaaaaaaaaaggcccctan

SEQ ID NO: 58422 - DNA, 555 bp, Triticum aestivum
  unsure (1)..(555): unsure at all n locations
  Clone ID: PAT_TA_58422
caagtgatcacgttcgtcggtcgcgatagaaagatcgacctctgcgtcttcgactcatgcctctgcgacaattccacccatgactccactgatacccagcaatcgactccgtttacgcccctcgtcgacatcgacaatccgaccaacgaacccttcttacactgcaaacgcatcgcctcggcaatgcgtgagcccttgtcgaggcgagtcgaatagataagatgcaatcaggttcacgagatagcttggttcgaacggatacatgcggcataattagaagcggcctggcagaagtgtctcagacctggaagacagcgctcgtgatgttgatgccccagcgctgtcagtgtctaaagatcgtgctgtcaaatactcccagcctcgatagcttcaattgccgtagtcttagttagcttcagatcgcgacagaacatgacgactgtctcgtttggtgatatccagaggttcgtanaggcgaacactgtcggattcagcgagtccacttatgaaacatttcttattctccagcaaaaaaaaaaaaaaaaaaggccccta

SEQ ID NO: 58423 - DNA, 226 bp, Triticum aestivum
  Clone ID: PAT_TA_58423
gccggccgggctctgctaaacaaagtagcatgcaatctgagcatagtagtatttgtttagtagtggttctatgtttcattttgattgtaaggttgttggatactgtcatgtctttatgcctgtgactcggcagtacgtatttgagcacgttaatactacagtgcttaaaaaaattgattctatatcaggggtccctttccaaaaaaaaaaaaaaaaaaggccccta

SEQ ID NO: 58424 - DNA, 769 bp, Triticum aestivum
  Clone ID: PAT_TA_58424
gccggccgggccgtcgactagattacctagtatacaacccgtcccgttcgaaaagaagcatctcccctccaccaaaaaatcaaccatggccacgtccgcaaacactctcttccgcgctgcgcgccctctcttccgccaggtcaccattacccagcccgcccgtcaggccttccaccagcagaccttccgacagaacttctaccagggcagcggccgtcgatggcagagcaccgatggcgctcaacagcagcagcagcagggctggttcaagcgcatgtatgagagcgaggttggcttcaagactgtgcacttctgggctcctgtcatgaagtgggctcttgtccttgccggtatctccgatttcgctcgtcccgccgagaagctctccttcacccagaaccttgccctgacctgcaccggcatcatctggactcgttggtgcctcattatcaagcccaagaactaccttcttgctgccgtcaacttcttcctcggactggttggtgttgtccaggtcagtcgaattctcagctacgagtctgagaagaagaagggcctacacggtgtcgttgaggacatcaaggccgatgccaaggagaccatccaggaggttaagccttaaatttgcccttgagcttcgacagactagacaatggccgtaaattaacgtctccaccggacatatcctctcatggtttctattcccataccctgcagcgtccaacaggtaccggctgtgggactctggataaaaactggatgcattgct

SEQ ID NO: 58425 - DNA, 743 bp, Triticum aestivum
  Clone ID: PAT_TA_58425
gccggccgggcctggatcacattacataccaccatggacgcgccggccgcctgcgagatcgagcgcctgccggaggacctcctggtgcacgtgatatcgctcacgtcgccggcgggcgccatccacgccaccgccgtgtcccgggccttccacgccgccgactcggacaccgtctggtcccgcctcctggcgcgcgacctcccgcagttcgccaagagggagctcccccgcaagccgccgtcgaccaagaagggaatgttccggcgcctctccgacgaaccggccctcctcccgggcaagtatgtgcgcatgcagctggacaaggccaccggcgccaagtgctacacgttttcggccagcgcgctacagatcaccaggctaatgatgcacacacgcccttgatctctatttctaatggagcagttggttctcacaagccgctgacatcggccatgttaacatactcaagatatgtgccaagatacagagaaacatgctctctcaaaacataacctacgtggcatacatggtgttcaagctaggacccagattttactgcttcgatttcccgtttcaagaagcctcatttggcgttgttggcacccagtcgatccagcaggtttgcctgcaaggctatgtcgaggacggtgatgggaccggtgttcacctcggaaacacatcatgccaagttcttacaggatatataatcgtgacgaggttcctactcaaaagaacgttgtttt

SEQ ID NO: 58426 - DNA, 663 bp, Triticum aestivum
  Clone ID: PAT_TA_58426
gccggccgggcctggacgacatgctctgcgttaaccatactgtgattttttacctaattcaaactcaagtccaacgaaaaactcatcctgactactaccttgtctacctataatacctagcccgccatggatctcgtcaacagtctcgaaggccgtcttctgtttgctgttcccaagaagggtcgactcaatgctgctacactcaacctcctcgagggcgccgacgtccaattccgccgcgagaaccgcctcgatatcgctctcgtaaagaacctcccaattgctctcattttcctcccagctgccgatattcccacctttgttggcgaaggccgttgcgatctcggaatcaccggatgggaccaagttcaggaacacgatgcttcagttcgcgcctacaaccaactgcgacgcagctcagttgacctgacttccactgaggacaaggttgctggctctgacatggtcatggagctgggctttggaagctgcaagctccaggttcaggttcccgagaagggccagtacaagaccccccaggatcttgttggcaagaccattgggactagctttgttcaccttgctgccgactacttcctcaagctcgagcagggtgagaatgccgacggcgagctgtcgccccgtaagatgcgcaccaagatt

SEQ ID NO: 58427 - DNA, 699 bp, Triticum aestivum
  unsure (1)..(699): unsure at all n locations
  Clone ID: PAT_TA_58427
gncggccgggtacaaaagaggagcctcgaatcagtgccatccccattcccgacggtgcctttggcttgatccgataccacttaactacccagcgcgaagctctggcagttcgcagcaaggaagtcctccctgatgcagatcagcccagtgttgcggcgagagtggaagctctgacatgggagcgacttatgggtaacaaggagattctgggccgctggcaagaggcgttggccgttatggcacagcccagctacgtccccgagtctctaaaagagcttgccaaactctccgatgaaatttggttccttgctggcgacaaagccgttgatccctcatggtataccaagcgcgccaccctatctatgatctatagcacaagcgagctcttcatgacgaatgatcgatcccccgattttgtcgagacaagacagttccttcagcgaagactaggcgaagtcaagtcagtcggcggcatggttgggtcgttcggtcaatgggctggatatacgctcagcgctggtgtcaacatattaaggagcaagggcgtcaggatctaagggggtcacactccctccaagaacggtggagaacgaatcgtttgtaaaatattgtaagagccatgtataccatcgtccatgaatatagaagccttagccggcacaagttgtaatgtcaaaaaaaaaaaaaaaaaggccccta

SEQ ID NO: 58428 - DNA, 640 bp, Triticum aestivum
  Clone ID: PAT_TA_58428
gccggccgggtacagaataagtttcatttttctctttcttttactttcaaatatcaaacagtaaacacatcctgcactacaatatctctttatcagtagtcaatatgaattacaacgtcaaagaagttaacagcacacttgtgaccaataccgatgtgacgcccccaaatgactagacaaacgattacaaagacatgggtggtgacatgcagtggggtgaattcggcgatgtcgccgagttagccaaaggatattgtctcgatggcacggtcaagcccctctttgccatggaatcctacacgggtgaggctatgtcccttttcgagctcagtggaaagcactacctctacaacgccatcgaaggatcgttgtaccaggttaaccagcccaatgaccttcagagtattgtgtcgacaattgatgatccggaaaagtgtttgagtgagcttgaaattgaggccctctagatatagctacagggtcgtgtcgcggggttgaagtgggtttttgatgcatcagggttaccctgtgactggttgaacagatccggaactcgtagatcaacatcccgtattcaactagggcttcctatgtatttacccaatatatgcagcaaaaaaaaaaaaaaaaaaggccccta

SEQ ID NO: 58429 - DNA, 225 bp, Triticum aestivum
  Clone ID: PAT_TA_58429
gccggccgggtacggaattgtttatttttttttccggtgatgatccattggcgtgtgatcgtggtttgtgatggcgtgcttgcgaggtttctgttttttttttctcgatcgggagaaaatagtgtatgcttgcttgttacataatattcgagctcctgtttaagccttgtttagtttgagaaaaaaaaaaaaaaaaaagaaaaaaaaaaaaaaaaaaggccccta

SEQ ID NO: 58430 - DNA, 586 bp, Triticum aestivum
  Clone ID: PAT_TA_58430
gccggccgtttccgggtgtctgttgctgtgtccgtcatcgtcccaactcgaagtcacgtccaacaacaaaatatcggtcggtcaccatgatcatcacacgcgctctctccatcaccaactttgttgtcgccagctcggcgctcagcttccaggttggcgtgctatacccgtggcacaagcagctggatgacgactttgaagcactcaagagagagcatcttcgcgtcctgacagccgtcgagggcaaggtcggtcgaacacaagaacctgctcttcttcaagagaaccgaccgggaattctcagcatgatcggaaacttggcaccgtggaaagcctgagcgcatagccgacttcgggacatatcacgcataacacaacacaacacaatgacaacctcgcatacccccagccattacggcataaaagaacaaatacacgccagacgcaagatctagacggctcgaatatttattcacaacaacgaattacacggtttctcattccctttgcatcaggcgtttcttgtttaggcattcagaccccctcggaatgagtggggccggtaccggtcacggtcgggcaccgg

SEQ ID NO: 58431 - DNA, 353 bp, Triticum aestivum
  Clone ID: PAT_TA_58431
gccggccgggttccgatggtactgttaaccttgctgtggtgaatattcacgaggacaaggatttcgagaccgagctcaagggtttgggtggaaaggaggtcgaggttcacagtgttagtggaacggatgtcaaggttgtcaacacagcagagaaggaagaggttggtatcaaggagtccaagtggaatggtgagggcttgtttaagttccccaagcactctttcactttgttgcgatggaagcagtagatagtctgtaattggttagaaaggaacaaatcgatatagatatctagatgcaagtcatgaattctgaccaagatatgccaaaaaaaaaaaaaaaaaaggccccta

SEQ ID NO: 58432 - DNA, 305 bp, Triticum aestivum
  Clone ID: PAT_TA_58432
gccggccgggttcccttgttttctcgttttattatagactctgctctcaggcatgggcatatcttgttaggcgcttcaggagtacacttgtctatttctcattacctgttcctcatcatggaacaaggagttggcaggagtcagttgggcatcaaagtagctgatcaatatggcatgagatcgtcaatgcaacatgaacgaccgaacatcctgttattaggtggattatcgtatccgatcatacaataaatataatcgttccaacttggttttgttacgaaaaaaaaaaaaaaaaaaggccccta

SEQ ID NO: 58433 - DNA, 691 bp, Triticum aestivum
  unsure (1)..(691): unsure at all n locations
  Clone ID: PAT_TA_58433
gccggccgggtttcanaaagtaccatctcacaaagttttttcacaaaactcaacctcacttctcgcacatatctcacagactctatacgtgtccaccaagcaaagaaaatggctccccagcttgacggtttcttcaagcaagtcgacagctccgccgaccacttcattgagcgtctgcgcaaagctgtcgccattccctccatttctgccgaggatgcccgccgacctgatgtcgtccgcatgggagagtggctcggcgacgagctcaaggctctcggagcttctgtagagcttcgacccctcggaaagcagccccacaaggagcacctcgaccttcctcccgttgtccttgcacgatatggaaacgataagaacaagcgcactatcctcgtctatggccattacgatgttcagcctgccgagaagagcgacggttgggccaccgagccctttgaccttaccgttgacgacaagggccgcatgtttggacgtggatctacagacgacaagggccccgtcttgggctggttgaatgctattgaggctcatcagaaggctggtgtcgacttccccgttaacctgctcatgtgctttgagggtatggaggaatatggctctgaaggcctcgacgacctgatcaaggaggaggccaagaagtactttgccgatgctgaggctgtttgcatttcgg

SEQ ID NO: 58434 - DNA, 340 bp, Triticum aestivum
  Clone ID: PAT_TA_58434
gccggccggtacggaaaagctctcaggcttcaacaatttcctgtcgagctacgaggaaacagtgtacctggcaatggagcgcctaaaagtacattttgagacaaatatcaagaatggacttgattctaacagtagcgaggaagtgctcgttatgcccagtggtcagattggtgtaaagacagatattgtctttcggtatgaacagaacttggaggatggacagggtcatggcagacggatctgaattccgagggcatcaaaatgaatactggccatagaccaaggatatcgcgtcattcgttgaccaagtatacaaaaaaaaaaaaaaaaaaggccccta

SEQ ID NO: 58435 - DNA, 522 bp, Triticum aestivum
  unsure (1)..(522): unsure at all n locations
  Clone ID: PAT_TA_58435
cccctccccccccgagccccccgcccggcccngggggcccagcgcggccgctcgaggccgcccggttcggagcgaggccccgcaccagcgcatttcccacaaacacacacacacaagggcgaaagacccaacacaaacncaacagcaagggcgggcgagaagggnccggcgccgccgaacccccgggcgagcccgnccgggcagcgccgccncancgcncnggcagaaaaaggcccccccaacgagnacgccgaagagaaccncacggccggcaagagcgaccgccacccccgccccaaccccacccacaagaagaccccagcgcgccgccacgacggccgccccgncaacgagccccccagcacccccaaccaccgcgacgacgccgccccggacaccccgnccccccgccccgccgaccccgacgagcgcccgccggcccgccccggggccgaccacgccgacaagaaggccaacgaccgcgccacccggcaccggaagcccaagggcgagccgcacgcg

SEQ ID NO: 58436 - DNA, 399 bp, Triticum aestivum
  Clone ID: PAT_TA_58436
gccggccttttcgaaaccgggcgagatccacagtgtttgcgcgccgtcgtcttcgaaggcgcctgttctgaggcctgcaacgcagtttgtttgccttggctcacactgctatggcactctctcttggatccagggtgtatggttgctcgccttcttctcctccggcggatgctacggcgacggcggtggttggtttgggcgagcgtggatttggtggttgcagggacccggaagggcttgtttgtgaatttctttcttctggggttttctctgtaattatctgtggtgtgatgtctctatggacaattcctgagagaaactacgtgtgctgtacctggctttgatttcaatgaacacgtggcatttctcccctaaaaaaaaaaaaaaaaaaggccccta

SEQ ID NO: 58437 - DNA, 433 bp, Triticum aestivum
  Clone ID: PAT_TA_58437
cgtgcatcaatcgatattaagttcgggggtgctatcagtttagtttatacaggggctgtggtgctgtattatgcctataaaaacacttgtttggtcaattaaacagggcattgaaaattgaaagggcatttttgttttctgttgaacctaagcaatttcatacgcttgacaaagttgatgctttattcttttgctctgctctgctcttgctctgcatgtgcttctcagtttgctagctatatctctaggttcttgattggcttcactagttgattggttgtttgcattgtctgtttgtgctactttcccccgagcacccatgatctatagttcttgttccagacagagagttggtccactagttatgtagtttttaggaaaatgctagtaacttgtgctttcatatcctagttatgtagtttttaggcaaatg

SEQ ID NO: 58438 - DNA, 231 bp, Triticum aestivum
  Clone ID: PAT_TA_58438
gaggacgacgccacccgccatggccgtaaagggccagattcagttgccgctctattaaagatcttgtccactttgtacaagggagaagaggaggaatttctctgcgtcaacccacaaggtggattctctatgcacaatcccccaagctgggtaagtggtcgcatttacttgctcatccgtttagtgttcccattgtcaaatactcagtctgatgacttcaacgcaggaccg

SEQ ID NO: 58439 - DNA, 432 bp, Triticum aestivum
  Clone ID: PAT_TA_58439
gttctgtttttgacagattctgctttacgtatgttgtttgcctattttgatgcatctatggctagtattaagtggtatgaaccatagagaacttggaatacagtatgttcaacacaaatataaataaataatgagttcattacagtaccttatgtggtggtttttctttctttcactaacggagcttatgagatttcctgttgagttttgtgttgtgaagttttcaagttttgggtaaagatttgatggactatggaataaggagtggcaaaagcctaagcttggggatgaccatggcaccccaagacattcaagaatagccaaaatcctaatcttggggatgcccccagaaggcatcccctctttcgtcttcatttattggtaacttaacttgcagctatattttaattcgccacatcatatgtgttttgt

SEQ ID NO: 58440 - DNA, 413 bp, Triticum aestivum
  Clone ID: PAT_TA_58440
ctgtgcgtctaggctggatggtaataggaggcaagggacacgaagttttatccaggttcgggccctctcgatggaggtaaaaccctacgtcctgcttgattaatattgatgatatgggtagtacaagagttatttgttttgtgcaggtacgagggactcgtgcatagcctcctactggattgataccttggttctcaaaaactgagggaaatacttacgctactttgctgcatcatcctttcctcttcaaggaaatccaacgcagtgctcaagaggtagcagacctttccttagaacgtttggtgcaattattgatatgaaggaagggaatattatattccaatttccgttaaggaaaggcatggaacacttccctagaaagaaaaataaattaccttatgaatctattatga

SEQ ID NO: 58441 - DNA, 412 bp, Triticum aestivum
  Clone ID: PAT_TA_58441
tgccctggcaatactgtgctagtttgctataagggtgcgtctaggttgctactactggttgactgttcgtgcagttttcctagagttagctgttcgtgcatcattttttcctttgtgaattagctgttcgtgcgtcagttactcaaaaaaaaactgttcatgcatcattgatgattgtggtgaatcggctgaggtaagattagctcttcgtgcagcttctgcttgttggtgtcgagttctccttttttttaagtcttattttctttttccttgtatttctctgttccttcaaaatagaaatgccgggcatgtcattgcgcatggtcgatgaacatgcgatagacacatatataatcattggcattatgtttttaaaagcaaaaaatcttaagttgcgcattgacagtggacg

SEQ ID NO: 58442 - DNA, 537 bp, Triticum aestivum
  Clone ID: PAT_TA_58442
gccggccggtccgggcaacgaatatcagttcgtatcttgtacctcaaacctacccgcttgttgaagcaatatggctcctctgactatggcagagaaggccaaggccaagctgcaagctgttcttgaaaaccccaatagaaacgatgccacctcttacaaacaaagagtaatgactaccacgacacccgcgaccggctctgactggaccaatacttgggtgcgacgaagcagtaacgatcgtcgagccagtgttggtagtgacggctcaagtggatcgcctgtccgacgtaggtcgagtttccaagagtggctgtatccttctgctcgttaaattgcactgccgtaaaatgaatgggatcaagtgttaggatattttgcttttgatacttctttcttatgcacattggaatactggaagggatacaatgaccaagattggcaatttggacgctttctttttcacaaactatagttataatagtacacgggcttcttattattttatttatttaaaaaaaaaaaaaaaaaaggccccta

SEQ ID NO: 58443 - DNA, 588 bp, Triticum aestivum
  Clone ID: PAT_TA_58443
gccggccggcttcgaaaaaaggcaaaaaaagagaagacagaagcttcatagcattatacccgactggcgattccatccatctatcgacatccaaccaaaacccacctctacgagtctcggcactacattcatcgatactttcacactcaattcactgtcaagtcacaatgtgcaccaaaacatcaatcgagcaccgctgcggacatgtcgtcttgcgcggcaacacaagatgttaccgagaggactgtcctggaagaaaagaagatgtcaccaaagtcgacgacgactgcgcgcagtgtgaaaacaaacccagccgattcagatcttcgcggtggtgctcagttggatgctgcgtttgccagtaaggaaatacgagggaaaagaagagagggtaactagaatgattcgattcggtcggagtaacacgggtttgaatttgggaatacggagtatggagggagggcttttttctgtggcaacgagttgcttggagtttaccggcctctcaatttattacctagttatgagtcgaataatcaactcattccattgttctggtctgaaaaaaaaaaaaaaaaaaggccccta

SEQ ID NO: 58444 - DNA, 504 bp, Triticum aestivum
  Clone ID: PAT_TA_58444
gccggccgggtcgcggaaaaaaaaaaaaaaaaaaaaatatcattcatcacagtcccaattcaatgggttgatgcgaatatggtgatggatgccccgggcaaccctcacgacggaagtgatgaattatgttttctctcctgatcatattccccaagcgcaattccatcttatctttcttcgcttcgctttgtgcaggctctcaacgtatccgtactctctaccaagtattacagcagttttcttcctgcaatgacaaggtcctcacggaccatgtagcttcgggcgacaggcaccatcatctgcatgcgaaactctcaagagtcgatgagaaaaatacgatatactgtatggagtactcgcatacatcatttggcttgagactcagatattacgatgcattgggttgtgagtcgttggcatcgctgttgtcaacgacgtggacatttcaggcagcatttgaaatcttgttcaacgtatcgaaaaaaaaaaaaaaaaaggccccta

SEQ ID NO: 58445 - DNA, 224 bp, Triticum aestivum
  Clone ID: PAT_TA_58445
gccgggcacgtgccaaacagtgagctaatgccccctttcgttctctgagagtaacaatatcagacgtccccaccgctgccccctccaagaggtgcccggtctgaatgtgcgaccgaaaatgggacgcattactattgctctctgatccgcgttatactttggctagatctggtcattcctgtagccaacaagccgaaaccgcttgaatcccttatccctttcac

SEQ ID NO: 58446 - DNA, 334 bp, Triticum aestivum
  Clone ID: PAT_TA_58446
gccgaccggttcgggtatcggtcatcgtgatcttttctcctttcctccactaacacacctgatttgcttgctcaacttcttctgttaattgtcgtttttcgttaatttctttatgttcatggactacagcaggctgaacctgcctcacaggagttgagtgtgatttgcgacagtaatgggattggaatcaaaaatgggtactcggcctgcgtcacttgagttttcttattgctggtcggttttgcgacaaggtcatggaccaaatatggcggcttccggatcattgcaaatcaaacacttcatcagccaaaaaaaaaaaaaaaaaaggccccta

SEQ ID NO: 58447 - DNA, 673 bp, Triticum aestivum
  Clone ID: PAT_TA_58447
gccggccggtccgggaccgacttcttccacgctttcccctccggaccccgtttgccattctactatttcctcctctgtgtcttcatctctggtattacctcactgaaatatcggacacatggcctcctcctacgagatcttcatcgccttcaaggccaacgtgggccaatgtgcactcgctgaccccatcatctctcgttccaagaaccgaggattcaagattgctggcatcacgcttatgacccccggaaaggaacacctcgcagaagcactacgctgatctcgctggcaaggctttcttcgctgtcctgatagaaaacatgaactctggccccatctgcgccatgtactgccacgtgcgtagattcgtgaacactgatcgctccatcctcgaagccaccaatccccttgcctcttcccccgtcatcatcctaggagactacgccatcgacgacagccggaacgtctgacacggttcccactccatagagaacgcccagaaggatattgttctctggttcaaggagggctaagatgacctcctgcaaagacgaccactgcatctgggtctacgagaaggcttaactctgtcattgataccacatcctaactgacggaatgcccaagctcgtagaattgggatgacttcatatctgtcccgatatcctcatcg

SEQ ID NO: 58448 - DNA, 433 bp, Triticum aestivum
  Clone ID: PAT_TA_58448
gccggccggtttcgggattatcaaaagggcgctacaggacatgccgcttatcctggggtctttgctctggtatgctttgcttggggagaacggcagcgtatatgagaggcagacatcacgattggggcgtgtacatgtatttggatcgctacgatcatgatcatcggcatagacgatttttatcctattcggcttttgttttcttcactagctactacaatttcgactaggggacaacggttcatgtttgggttgtatgatttcagcaactactgaatttattgctttctacttgggacttgagagatcctggcgggtaggccagtaggctggcccagaatgagacaggagagagaaagtgcgagcctgtatctagactaggcctttgaaattccgggttcgctattaaaaaaaaaaaaaaaaaaggccccta

SEQ ID NO: 58449 - DNA, 503 bp, Triticum aestivum
  Clone ID: PAT_TA_58449
gccggccggttcggggaagaagaactaccaatcttgccacgtcggtgctgacggttccgtgttcaacaagtacccccacttcaaggagcgtggtgccaaggctctgcgagatattctcgactggcgagaagaccaacaagaaggaagaggatcccattgaagtcctgactgccgaggacggtagcggtgtcggcgccgccctgattgccgccctgacgcttaagcgcatcaatgagggcaacatggcgggtatccttcatcccgagaacttcaaataaatttaaagcggaatcaattaagcaaaggcgtgaggtaggcatcaacgtttaagaatgaaccggaaaataaagacaggcgtgtacttgaatcatagcacgaatagagacaaggggacgttaaaggactaccaaaaagcgggtatgtcacagacaagccccctggttcctgttgatggatatatatatgtacgtttaactcaaaaaaaaaaaaaaaaaaggccccta

SEQ ID NO: 58450 - DNA, 354 bp, Triticum aestivum
  Clone ID: PAT_TA_58450
gccggccggtccgggaaacagaccctactatccctcaaccactgtcagctgctcgaccctacgcgactgtaacatttcgggattcgtggtcaagagcacactttagtaaccttgcctaaaaccatcatcacgagggcccctcgtgcggctaccatgatgcgatgatgacctgatgcaagtgacatatcttgaccttgtttaaaatcctttgtcctggatcaaagggacagacaaaaaggactttagctcttctgagctacgtactgtgatgtgatcctcttttgcatacggattcattgccttgctatgacaatattcttgatggacaaaaaaaaaaaaaaaaaaaggccccta

SEQ ID NO: 58451 - DNA, 788 bp, Triticum aestivum
  unsure (1)..(788): unsure at all n locations
  Clone ID: PAT_TA_58451
gccggccgggccgggctctcacaccattttcctcattttcagaaaccatcataacgacggttttatcgacagtttgttgcgttaccaactcaaccagccacaccacaccagaagaacccctccaacaacctaaaaatggcttctaccaactacaaggaggcttttgccctgttcgacaagcgcggaaacggccgtgtcactgttgacagcctcggtgatcttctgcgcgcctgtggccagaaccctactctttccgagattcaggacctcgagaagaacgttggtggcgaattcgacttcgagacattccagcgcgtcctcaaccgccccggcggtttccgcgaccctggcgagcctgaggaatactgccgcggtttccaagtgtttgataaggatatgacgggtttcatcggcgtcggccagcttaagtacatcttgacaaacctgggcgagaagatgaccgacgaggaggtcgacgagctcctcaaggccgtcgacaccagctcaggccaggtcaactacactgaccttgtgcgaaccatcctcgccaactaaagattgtaaagatatgggcgggttaggttatgcatctacgttgacggaccggcgtttgcttgtttgattatggatatggatggaatcggctacggatacgctgaaatgatgaattattgcttcccttgtacggagcactagcatgtctggatttttggtagataattgggaggcgagtaggagttatgaaataaagctctatatgtctcanaaaaaaaaaaaaaaagccccta

SEQ ID NO: 58452 - DNA, 764 bp, Triticum aestivum
  Clone ID: PAT_TA_58452
gccggccggttccgacagcggataaggtggacgcgattatggacgagctgcgagaacaaaacgccatgagcgacgagattgtcaacgccattacccaaaccccaatgggcgacgctatcgatgatgacgagttggagaacgagttggacgagctacaacaggagcagcttgatgagcagatgctcaagacaggcactgtccctgtgtcggatgccgtacacaagctgcctacgccggcttctgcggagcctgtatcgagcaagaagcaggccgtggaggaggacgacgaggaagccgagcttcggaaactacaggccgagatggctatgtgaggttaccattagaggaacttgatgattgcatagcatttagttggttggaaccaagggtgaaactacactatcagtggcgtctcttgtctcagacaagagacagctgctcagtggtattctgagtttcctgtgccctgacggatttgttgttctattgtgggtgttatgtcggcgtcggcgtctgcggctgttgttgactcttttcgtttaagaaaccatttccatcttttgcctaggaatatggctttggcattgcgctgttgaccttgcgagggacattgttcatgatcatacggtcgagacatatgcacctgatcaggaactttgtctatgtcgcggtcgacaagcctggtttaagggagagtttagatcttcagtgcgaatatatccagtaaagtttgaaaacaaaaaaaaaaaaaaaaaaggccccta

SEQ ID NO: 58453 - DNA, 407 bp, Triticum aestivum
  Clone ID: PAT_TA_58453
gccggccggtccgggaaaaaatctatctaattatcaaaatgcagttctctattgtcagcatcttggctattgccaccgtcgctattgcggctcctaaagccgcttgcaacaacggcggtctttactactctgaccccaagactctcgagccttgcaaatctgaatgtgtcggcggtacttgtgcccttttcggaacttgtactcaggaccccaacgtccctctgctctgcctggccaagtgcacatgttagatgtgtgtctggatatgatgggatggggaaacgatgtctatgattgttggaaagaatatgaatactttgctagcactcgatgtggcacgtcgtcatgatgaaaatatcaacggaaaattcagctatgaaaaaaaaaaaaaaaaaaaaaggccccta

SEQ ID NO: 58454 - DNA, 637 bp, Triticum aestivum
  unsure (1)..(637): unsure at all n locations
  Clone ID: PAT_TA_58454
gccggccgggtccggacacacaacgctgctgagatgactgccctgccaacacagctgagctggcatctgacagcgctgctaccaagtggcatcaaaatgatgctgccgagattgatggcaaccaagtctcaagtgctcgtggtacagcaccacctgagcacgtatatgagatgccagcgcaaccctaccggtaaacgaacatgatgccatgtgactaacacagaggtcactggcaaggaattggatggaatgaagaaagacataaaactcgaaggtggttgatgagactccgcgttaaagatagaggagattaattaatgtcagatactgtacatactgtgaacccatttactttctttccttgcgttttatgagcttgggttgagcggacgagagcgggagatgacatctcccattgattgcatgacgttgtatatcttctattcctaccattatggcgaggacagaattgcggatgatttaaggtgttgattataggtagatatgcatcaatcaaacgatattcaagtcnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggccccta

SEQ ID NO: 58455 - DNA, 831 bp, Triticum aestivum
  Clone ID: PAT_TA_58455
gccggccggtttcgggccatcataacgactttgtacttgtcttcccctcccgtcgattaaatctccattctctattcctatctctatttcaaaatcagtcacaatgtctaccaccaacagcggacaagaatctgaaaaggttaacactaacattgttacccttacccgcttcctcactgaggagcaggccaagcaccccgaggctactggtgactttaccctgttgtgtcacgctctccagttctctttcaagtccatcgcctactacatccgacgcgccacccttgtaaacctcaccggtctggctggttcttccaacattaccggagacgaccagaagaagctcgatgtcatctccaatgacctcttcattgaggccatgcgctcttcaggcaagtgtgcgctcctcgtttccgaggaggaggacgaaatcatctatttcaaggacgcttcagatgcccgctacgctgtcgcctgcgatcccattgacggttcctccaacttggacgctggtgtctcagtcggtaccatcttcgccattcacaagcttcccgaaggctcaaagggctgcaaggaggacatcctgaagcccggtactgagctactcgccgccggtttcaccatgtacggtgcctcagctcagctcgtcatcaccatgcgcggcggaaccgttaacggcttcactctcgacaacggtgtcggcgagttcatcctgtctcaccccaacatgcgcctgcccaagtctcgcgacatctactcctgcaatgagggtaactcgctatactggggatgacagaccatcaactacttcaactcgctgaagcaggctca

SEQ ID NO: 58456 - DNA, 688 bp, Triticum aestivum
  Clone ID: PAT_TA_58456
gccggccgggtcgggatgggccctctgtcaaagatggctggcatgattcctggtatgagcaatatgatgcagggtatggacgacgaggaaggtggtgccaaactcaagcgaatgatctacatctgcgattccatgaccgacaaggaactcgactccgacggcaagattctcatcgaccaaccgactcgaatgacacgaattgcccgcggctcgggtacatcagtacgagaagtcgaagatctcctcacccaacagcgaatgatggctggcatggccaagaagatgggtggcaacatgaagaacatgcagagagcacagcaagccatgggtggtggtaataaggcacaacaattagcagccatgcaaaagagactacagagtatgggaggtgcaggcggtgctggaggtatgcctgatatgggaagcttgatgaagatgcttggtggaggaggaggtggtggtatgcccggcatgcctggcggtatggatatgcaagccatgatgcgacagatgggtatgggcggcggtggtggtatgcctggcatgcccggtatgccaggaggtggcagaggaaaaagatgatttagtctctggcgttgcatgggttggcgttgtggtcgtggcttagaacaggcatgaatgaacttgtcaatgtttgctgcgaaaaaaaaaaaaaaaaaggccccta

SEQ ID NO: 58457 - DNA, 527 bp, Triticum aestivum
  Clone ID: PAT_TA_58457
tcgaggccggccgggttcgggacaacgatatcatctatattcgtcacaatggcttcattagtacagcgtcgtatgctctcaaaggcggatgaggaggcagccgacgaggtcgaggttcgacgtgaggatcaggacaagatcaaccggttcagccgcctacaccagcgagaacttgttttgggcgacgaattgagcgctaagaacaaggagaaggaagagctcgacgacttgtctacagaactcgaactcgccgacgaggacgagaagatccagtacaaaattggcgatgcctttttccacgtttcggtagagcaggcccaggagatgcttgagaaagcaacggagacgctcgaggaagagtccacatcattggaggacaagctatcgtctatccgtgaggagatgacaaagctcaaggtcgatttatatgccagattcggaaagcagatcaacctagagacttgagcagaaaaagaaatcgaagcctgataccccctcgaaaaaaaaaaaaaaaaaaaaggccccta

SEQ ID NO: 58458 - DNA, 620 bp, Triticum aestivum
  Clone ID: PAT_TA_58458
gccggcctgtccgggaaaaacccatcaaaacatcttacaaactcatcaacatattctacttcaccatgaagttctccattgcaaccctcgcagctgtcatcgcagcttcggcccccaccgtcatggccgactcatggcagtgcaacggctcctggaacgacggtggtctcaagcgactttccttcctgttcgatggctactgcgagaaccagtctggccagtgtttcctctctgccctacgaggcaagggtctcactgtacacaactggcaggcctgggatagaggcgatggctggtggcaggttgactttagcactactgctggactcgcatggcaggccaacaatgctattgagcaggttactggctcttggcgtggctgctggcccaaccagtgagtctggacctttggttccaagtcaggaataaatatcgggggtttctttggttaggttcgataacttggtgttggataggtaggtagttagttacaggtagcatgagttgggtatcaagtcaagatgatagttgttatacaatgtcgcagctagaaagttctcttacctcgtaaataccagacaacgattctcatggaaaaaaaaaaaaaaaaaaggccccta

SEQ ID NO: 58459 - DNA, 421 bp, Triticum aestivum
  Clone ID: PAT_TA_58459
gccggccggttcgggtttccagagcatggctcccgagcccggacatgctggttaccctacctttactcctcttctctactgtgctgaggctgatctcagcggcgactgctctcgcgaggatttgggaattggtggtggagaggtttgcgttcagaagtatcttcctggtgatgtccctgacggcacctggcaaatggtcaccaccgactaaatgcacatattagtgcttatcattcggtgaatcatagtgggtattcaggtggcctttatcgtacagttgaatagccagagtcctgtgacttattcacatacccagactggatggaaggggttacaataggaaagcgagatatgtgctagaaatttagaaatttatataccgattattttccatgaaaaaaaaaaaaaaaaaaggccccta

SEQ ID NO: 58460 - DNA, 254 bp, Triticum aestivum
  Clone ID: PAT_TA_58460
ccggccggtccgggatagaagcggaagggtggtgagaggtggaaaggaggtcagcaacacaagccagacctgacctgacctggcattcactggttgaactgaagtggtctttttttgttggcacaaggcgcacctttttaacttattctaatgtgtacaatgaaaggaagcaacacatggcagaaaccttagacttacatgcaaataatgccttttttcattctttccaaaaaaaaaaaaaaaaaaggccccta

SEQ ID NO: 58461 - DNA, 499 bp, Triticum aestivum
  Clone ID: PAT_TA_58461
gccggccgggtctcgaccgcactcagcacagcacaacatcctcagatcctctcacacatacaagatacaacaacagagagatcgagcggatacaagccaatggcaaccaagagccttcttctcgccgctctcctcgtcctcgccgtcagcatggcgccgcacggtgcggaggcgggcaagcagcttccgctggcactcatcaccggcgtagtgccatgcagcgctgggaattccatcaacgcgagacacctcggcgtttctatatggagaagaaacgccacgggctgtggcgttgctaaaagggtcagatcgtgaaatactttcatgtcgagttcattttgtagcaaagattgctgaaaaggtcagaatagtgatttcggcctctgtttggtgtgagtgtgctgttgatgttgtgatttgattgcacaagtgaaaagaatgtggccactgggttcgcaagccatggagattgcaaaaaaaaaaaaaaaaaaggccccta

SEQ ID NO: 58462 - DNA, 272 bp, Triticum aestivum
  Clone ID: PAT_TA_58462
gccggccggttcgggaaggctcaagggacgagcactggtaggactacgcctttgggatatggtgtcaacactgtgggtaacggatggggttattcaaagccgaacaagagatcggattaaagatctgtttatgtacaatgcattttggagtcatgggtggacatgggctttggcaatgtagagcttgtaatgagaaagctggcgactatcaacaccagcgatgtatatcacactccgtttgtctttaaaaaaaaaaaaaaaaaaggccccta

SEQ ID NO: 58463 - DNA, 181 bp, Triticum aestivum
  Clone ID: PAT_TA_58463
gccggccggttccagacgccgcctactctttatctgccgtcgcaacatacggatacagcacgcctgagcaccaccatgacttctcgcagtgggaagcgtcgccattgcgacagcatcgacagcgactcgcctccaccaaccaagaaatacaaacaggcaacttctatcgcttcggatgcca

SEQ ID NO: 58464 - DNA, 306 bp, Triticum aestivum
  Clone ID: PAT_TA_58464
gccggccgggtccggagacctaccattcggcagcatgggacgcagctctcgccccaagggtccttcagccgacagcagtgggccaggaatcagcggcaagaatgactttgagatgggtcgccggaaatacgtcaacatgcctgacccagccccgttggattccgacgatggagaaagtcagcgtaacatcctacacgaaacagactcccactggaaacagtctgctaccaccatcacatctacttctaaatagatagaattgaaattctctttgtatttgaaaaaaaaaaaaaaaaaaggccccta

SEQ ID NO: 58465 - DNA, 441 bp, Triticum aestivum
  Clone ID: PAT_TA_58465
gccggccggtttccggaaagaagtgcgctggtcagagtgaagcgcgagccccctccagggctcttcctgagggcggccgtccggccattcacttacaggaatcttgtcaaggaaattgttctgatgagacaccaaattattgatggagagatagtttagcttcaaaatttcagcaactggagaattgcagagactgcacaaacaaggttctgaagaagtatcttccttggttatttacaatatttagccatatttaggggtgttgatctctctgcagttctgaccctagggaatacacaagtcatgtaattcttcccctgcaaaagtttttaatgaaatttgaagctaatgtttctgataaaaaaaaaaaaaaaaaaaaaaaaaaaaaaaaaaaaaaaaaatacaaaaaaaaagcaaaaaaaaaaaaaaaaaaggccccta

SEQ ID NO: 58466 - DNA, 296 bp, Triticum aestivum
  Clone ID: PAT_TA_58466
ccctgcgttgcctctctgatcacctctgcaggtgacaatagctgtatgcgccgacattgcttgcctgagcgctagactctgaacagattcaagattcaaatcttgactgaatggcgataactgtggaatcccttgcctctatcatcggaagctgtccccgatgccgcttgtcctgactgtgcttatatgtgggatatccattgccccatatcaaccgacattatatacctagaacacaaggcacactggccgccggattacaacaacaagactgggccccaacctgccgctaccca

SEQ ID NO: 58467 - DNA, 448 bp, Triticum aestivum
  Clone ID: PAT_TA_58467
gccggccggttccggtaagaccggtttctccgcccaggttggcaagcgaagaaagatgcagggttaagcaaccccgcgtctttcttcctttctctcagttctgtccccactcactgccaacaacgtccttggcctgtgggtgctgggtggttacgtttgtcttggcggtgttttatcttggctgcgcagctgactctacgctgaaaacgaacaaacggttttctttttgagctgcgtagtctcgacgatggatacagatttcgcacttttggatgaggctccgctgccttctccatacgatctggtccctagggtcaaaaggagtgatgtcggactcgattaattatgaaatcgagtgccggggttatgatgttggcgtatggattatgtacatgatgccggaatgaaacaagactgcaaacaaaaaaaaaaaaaaaaaaggccccta

SEQ ID NO: 58468 - DNA, 727 bp, Triticum aestivum
  Clone ID: PAT_TA_58468
gccggccggtccgaattcggcgagagacgtgcttactctccctctgttcctgctgctcagactctggtctcgccctttgaggagctctctgcccttcccagccctcattccctccgcaagtctagtaccttcactggtctcgactttgcgcctcccaagaggttcaaggattccgacaacatgagcgatgccggaagtatcaggagtaaccgcagtggcatgtctcaagcccagcttggagccatccgcaacggagctggacgtgtcagccgactgcccggcgaccaagtgttcaccgctgatgcactacaagacacgctgaagccatcttggggaatccgaccttgatcaaacaaaaagcagcgcaaacattgtcgtgaataatccgatgtttcggtcatcatagacgtgtcaaaaattctcttagcgttgtccttttggcatttattacacagcgtgcgcgggtcttgtccactttgcacatttttctcttctcaggcgcattttagggttatgatgtcttgcgatattattcttcatactgggaacctgcaggcttgcatattatagaaggtcttggaaaaccacacgacaaactagatgacgactgtcggcttggatgacgtccagccgttgtacataggtcaattggatttgccgttgatcacgtcaacttgggcatcttgtttctataaaaaaagaaaaaaaaaaaaaaaaaaggccccta

SEQ ID NO: 58469 - DNA, 495 bp, Triticum aestivum
  Clone ID: PAT_TA_58469
gccggccggttccgactcactacacctaccttgtcgaattttggccctatgctatgcgatctcgtggtattggtgttcagcaaatctttggaaagctcgccggcttcttctccaccaacgtcaactccattgctctcgatgcgatcaagtggaagtacctggctatctactgtggttggatcgtcttcgagtttctcatcatctacttgctctaccccgagaccagcggccgcaccctcgaggaacttactttcctcttcgaggacgacgagctcaaggaaaaggcaaccgctgctgtcgagaagcaaatccatttcggagacgccaaggaagaggagaacaagactcaagtacagacccgagaggttgcttagacagttactctgttggatggaataaatgtctgtagctggatgggagattgagtttgtacagcacttatgagttaaatactacacgtataaccacgaaaaaaaaaaaaaaaaaaggcccctg

SEQ ID NO: 58470 - DNA, 781 bp, Triticum aestivum
  unsure (1)..(781): unsure at all n locations
  Clone ID: PAT_TA_58470
gccggcctgtccgggttttgacaggacgaggccttgctgctctatcggcacctggacagatttacgaacttacacttaaggagggcgaggaattcgtggctcaccctggaagtgttgtcgcatactccatcagtcgatcccttcctcagcctttccgcttcaagagcaacagcctacaactccaggtgccctcactatcacgatggatctcagagcccgactgggtaaagaccgtccgcagctctgaggtctggaagtacctagcacgagctttctacggcctacgaacagcgacccgcagaactatctggggtgatcgcctcttcctccagttccatggacccaccaagattctcatgtccggccgaggtgtgcgtgcttcagatgtcctctccaacaagcaagtgaacgaaatcgccgactctgagcccggcgtgatctctcaggccgtcgaactgagcaaccagcccaagctcacagatggtgccgagaccaagtctgctgttgttaatgtcgccggacaggggcaagatgataaatccgtaactggaattcatgttgccaaagttgaaaaggacggtaaagtcaagttcgaggacaacaaggacctgaaggagtttatccgatgaaaagaagcacgcagagaaatgtaaaaagcgagtgggcggtattacagagatgaaaaaggagaaggaagacgagcaagatgtttttatacaacctttgttttatgtatgatcacctatattatctaccnaaaaaaaaaaaaaaaaaggcccct

SEQ ID NO: 58471 - DNA, 341 bp, Triticum aestivum
  unsure (1)..(341): unsure at all n locations
  Clone ID: PAT_TA_58471
gccggccgggtccaaaggaatacngggggaactaagccatgctattgggctgctgagggtatcacgaccaagactggcggtgagcagacgagactggacttgttttcccccctctctcggcggagccctccccgcaggtatgaagcaaatccctcgttacggttgtttgtttggattggtactggagaggttttctgtaactcgggacgacgaccatgagcaaggaagaaggtttatttgatattcatgtatagacacgtgagtgaccaactacgtgattcccttgtttcatgtgccaagggaggcattttctttaaaaaaaaaaaaaaaaaaggccccta

SEQ ID NO: 58472 - DNA, 420 bp, Triticum aestivum
  Clone ID: PAT_TA_58472
gccggccggtccggggtcgagtcccccgaggccgctcagaagcgcgccgacgtctaccccggacctcccttcggtagcctcgatgatgacctccaggtcctcatggagcgcttcctcgaggagcgtggcatcactcaggctcttgccatctttgtccccgactacgtcgacgtcaaggagcagcgtgagtacactcgatggttgaacaatgtcaaggctttcatcgacgcctaagtggtcgattgtgttggaataatgaaaagtttttcacaagagggaagagcggaggagtcttcggttcagaaatgatgtgtaaaaaataggaattgccactcttgttgtacgatagtataggatccaccgagatcaaatgcatgttaagatatgtgtaacgaaaaaaaaaaaaaaaaaaggccccta

SEQ ID NO: 58473 - DNA, 219 bp, Triticum aestivum
  Clone ID: PAT_TA_58473
gccggccgtgccgggcctccgtatgtacgtggacttgttctctcggccactttcggactcctattgccgccgtgctggctctgtttggctgggagtcaccgccattgccgttggcggaggaggtcgcggtggcgtagccgtgccgcggtgcatcggtggtcaacagtaggttttcacaatgaattcacaacctaaaaaaaaaaaaaaaaaaggccccta

SEQ ID NO: 58474 - DNA, 558 bp, Triticum aestivum
  Clone ID: PAT_TA_58474
ccggccgggccggggggccaacgtcctgaaccgaaacccgaccttcgaaaacgaacatgggatgttgttgacaagggcctggactcgcttgagtatgactgagcctgtggcacaaccactatgatgaagaggtgccatcatccgctaaacctgtttcaccattcaaggcagctcaactcgtatgggtgtaagatgtcgtgttacgaggcgataccccaatctgactcgagaagcccgattaatggaaacatgtattatgattcgtcatgcaccacaacatgatttgaacactgaactgggatatattcctgtctggtgtaactgtatcgctaatgtggtcgtcaagtcctgggtaatttggagttgccacaacgttagctgctaattgttgatgacttcacagcagaatgacagaagaccgccgaatacggccatatcaatatgatggctcatgacagacttagactcggccatagaattgcaagatcacccggggagtataatgtaataaattcaaccttccaacccggagaaaaaaaaaaaaaaaaaaggccccta

SEQ ID NO: 58475 - DNA, 204 bp, Triticum aestivum
  Clone ID: PAT_TA_58475
ctgctcatttcttgatacctgattggctgtaggacttagcatcagcaaaatgctagaatgacctggttctggtgcatccatttcataaaacttagaagaaaaaatgtatttgtaactaaccaatgtacattttttcatgtatttgtaactaggttgagctaactttagttcaaaaaagaaaaaaaaaaaaaaaaaaggccccta

SEQ ID NO: 58476 - DNA, 586 bp, Triticum aestivum
  Clone ID: PAT_TA_58476
gaacgacatcgtccaatatatcccccttatcatcttcttatcttcaacttccctttcactttctttttccatatcctctcattaagcatgaatctggttagaccctggttagccccatggaggaactattgaggagatgtttaagcgatgtttccgccaaggcccccaacatgcatgctgcgtctacgatggatctaccactgagttcctagaggctgaccagcatctgacaagcatctgctgtgatgttgttgggatgcgtttcgaacgagatcacatagggatatcctagaaaatgcgtagaagctacgcggccgctcatgtggagctcctgaccagccaggaaccggccagcaactagctcgagaccagctagaaacctgccactgaagtgtgactgagggtcgcctctggctctgacgtgacctggacttcacctgacaggaacgtgagcgcatcgtctgaagatcctgttaagactttgctgactgtctacggaatgactatgaaaacacactgaagcttcaccacagattctatcttcagcgtatccatgtctgccgcatgctagccgaaggctatctaa

SEQ ID NO: 58477 - DNA, 876 bp, Triticum aestivum
  unsure (1)..(876): unsure at all n locations
  Clone ID: PAT_TA_58477
gtgcggcgctcaggcggcggtcgggatgtaatctcaagattggtcttccctcccatcaaatgtcccaaaagacacattcgacgacggggaacttcctcccccgtataccgaatcaggtccatcatcagcaccaacaccaacatacgaaccacgacaatcagtaacaactatcttctcatcccatctccaaaacctccccttacgtatccattccgtccaagcagctcgcacatcagcgcgcgatcaaagagacagcgagatcctcacccttctcgttcctcatgtcgaagaaatgctatcgtccatcacagcaaaggatccacctcctagattgacagaaacaatctttgtacctggcgacgctgtcggagaagaatggttctttagcgatgaagatgaatcgcgaacagttgtgcgtgtcagggaagataccaagttggtaggggatcagaagcgaccgcctaaaccagaggttgaaccacgtaaggaaaaggcgtttgatgaatggggaagatggcaagacgacaatactcaagattctttttcagacaacgttctctggtggtcagatcatgatatggctattcgattggcaaagtacatatcacccgaaagagttgatcgacaagtcgtcaaagcacatgtcgaacaagccaagaaatcctcaggatggggttttctcaaaaagagcaaaccacaaactccagaaccgcncaagcctanagtacaggaagaggatccggtcaccatggttggttaagccgaaagagttacgttcaggaaagagaacgcgatgggcatttgggaaggaaagacaggatgggggttggtaattaaagtcaagatacgacaatggatacaattatacgcgagatc

SEQ ID NO: 58478 - DNA, 270 bp, Triticum aestivum
  Clone ID: PAT_TA_58478
gccggccgggttcggctgcccatcagatggagagagagtaaaagagagagagaagctgtcataatccacctagtattatcatgttccgcaatgactgattgttgacctaagcttgggtctgaactctggtgtgctgctgtcccagctgctttggttgtgtgcccatctactatgtaatcgtcctctatcagcctgttgtgctacaatatcttagtcctgtgtggatttgctcctcgtgcttaagaaaaaaaaaaaaaaaaaaggccccta

SEQ ID NO: 58479 - DNA, 205 bp, Triticum aestivum
  Clone ID: PAT_TA_58479
gccggccggttcgggcttcttttcagggcgtagccgttgtaattccggggttaagatatcctcaaacctggcagtgcacgacagatgtacgagtcaaataaaattcagaagtacgattgtaccaattctaaattcctaaacgactgtaaagttctagaaatagagttattgtctactgccaaaaaaaaaaaaaaaaaggccccta

SEQ ID NO: 58480 - DNA, 797 bp, Triticum aestivum
  Clone ID: PAT_TA_58480
gccggccgggtcgggatcacacctcgatacgtgcctctgccatttgttttaaaacgtcttaggacgtgcttcgagccatgtctcaatccctccgaccttacctgcaatgcgtacgcagcagcttgaccgctgcgctcacgctttccaacttcgcttctcaaaccgctgagcgacacaatgtccccgagattgaggcacagacatcacccgaagtcctcctccagcccttgactattgcgcgaaacgagaacgagcgtgtcttgatcgagcccagcatcaactctgttcgtatcagcatcaagatcaagcaggccgacgaaattgagcacatactggtacataagtttacaagattcttaacgcaacgtgccgagtcgttctttatcttgcgaaggaaaccgatcaagggctatgacatctcgttcctgataacaaacttccataccgaggaaatgttgaagcataagcttgtcgactttatcatccagtttatggaggaagttgacaaggaaatctccgagatgaagctatttttgaacgctcgagcgcgattcgtggctgagtcttttcttacaccctttgactagaccctcagctggtatgaggcttggagttctctcttgagagtaccggttgttgcaatgctattttgaccaagcaaaattatgacagtactggcgtgcagaggctccgataaacgagcttcatgctttggagagaagggaggcttaagataacgacattgcctagatataaactttaccgacccaatcgaattgaaatgcgaatcttttctg

SEQ ID NO: 58481 - DNA, 659 bp, Triticum aestivum
  Clone ID: PAT_TA_58481
gccggccggtcccaaaacaaatccaattatctaattcattgtctcatcttatacaatactacaatgaccctctcaaactctaatctcaactgcccgtcacacccgaaaatactaaaccatacttttccacattggtcatctcatccataaggaccccaacccgatgaccctccaccgccagatgctcaagaaccccctcgtcgaacttgtccgtgacagcgtccaggctctcatcaaccagttctctcaccacatgccctctcatatctaccgtacgtagggtgaatctgatcaccctcccagcgtcaattatccgtctccccgtgagaaggccggccctcaggacaaggacccgtaccgagtagaagagattcgtcgcctctaagggaatcaagcccaagacacgctagtcacgccgcaaccttgccttcaacgaatacaccggcgagtgggaattcaagagcggatacaacgacctgaacaacaacgacgaggactgcgccattgtctaggtccaaatggaagccgaaaagaacagaaatgatggcaccaccatccatgacgatggactaagagaaccaaggagagggtcaagtgaaacgaacggttgatgcgcaagaattaaggtattgccaaatatagcatcaacggcctattct

SEQ ID NO: 58482 - DNA, 639 bp, Triticum aestivum
  Clone ID: PAT_TA_58482
gccggccggttccgaaaataaactcaacttcaatcaatcatcaaacatgtcgctatggctgctgtacagcctccgcgaacaagatctgcccgtttaatggctggttttaccactaaaactgcgaatcatgcaccacccgcatcagctactcatgctcatcatgggccttctgctctatcaatctttctgaccaacctcaatcttcttgatctcgaccaacttcaagactggcctgccatttgtgccgagacctttgcgacagacggcacaagcgcgcagggtctaaagaagagagtccattgtgtggaatgggctctgcttcacctcttctcattatgggatcctgaagaaacaaaaaaaaaacttaaaccattctttcctcctctcgatcaaactcaatccgtcaacctccgtgccgccttgttaagagctctcgaagcagccaagaagaatggagtgcttggaagggatgccatcgtgcgaaagaccatgctggacgaatgtcgaggagaaagactggaagatgtccttgctgcgttttcatctgctgttctcaagcatgttattgcccaagaggtagcatcaggcagtgaatacaaagctcttgcacttgaaaaaaaaaaaaaaaaaaggccccta

SEQ ID NO: 58483 - DNA, 745 bp, Triticum aestivum
  Clone ID: PAT_TA_58483
gccggccggttcgggaattcaagcctgatccggattttctcaagactcccatcagcccacctatggcctataccgatttcctcacgaaagccatggctctcaattctcctgctacgagctctggcttaacaaccccagactctcttccggattcggcgaccagtgaggaaaccgacaggtccttaaagcgtgaagcctcccccccttcatcatcggcttcaagcatcacctccaaggcatcaggccgcccaactcctccagcaacggcccccatggcacctcccagtcccttcacctgcgctacgcccatgtctgcacctcccgccggcgctgcctgcttccccagtctcaaggtgccaccgagtcccagtgtgtcgaatatcgactctccaatgagtgcaagcactgttcgatcaccttttagcgcaaggccagtccactcatcagtgtttgactgggatgcggctctcaaggcccgtctactagaaaagaagcagaagtcttcacggactacgacgacactcgaagggggacaaacagcactacactcctaaatggacctgaccaagggaaagaccaggtgaataacctgcagcgacttgttgctctactctctcgaactacacctatcacgaccatataagactcaaatagatttcttgtaactgatgatcaaatcgaacgaaggagacccccccccccagaactgaagctcaatgcggaacgcctaatcaatcctgtactg

SEQ ID NO: 58484 - DNA, 146 bp, Triticum aestivum
  Clone ID: PAT_TA_58484
gccggccggttcggtacgtgtaagagatgtgaacatgtgttgtgacagtggtcaagtcctgtaagagtgatctgcactatatggttatgaatatcactttagctacttgtaagtttcctcaaaaaaaaaaaaaaaaaaggccccta

SEQ ID NO: 58485 - DNA, 768 bp, Triticum aestivum
  unsure (1)..(768): unsure at all n locations
  Clone ID: PAT_TA_58485
gccggccggttcgggttcaggaccggttcggtgtcgagggaatctgcgaattctacgctgctacagaaggaacctttgcgactttcaacctaagtaaaaatgacttcgccgctggcgctattggtcgaaacggctggatttacaatctcatcttgagtcaatccgtcgctctcgtggaagtggactgggataccgatcttccaaagcaaccccagcacaggaagatgctacaaggcacgcacaggcgaaccaggcgagatgctcttccgcctcccctcaggcaaccctttccagcgattccagggctactacggcaatcgcgctgctactgaggcaaaggttcttcgcgacgtgttcagcaagggcgatgtgtggttccgaacaggtgatgtcttgcgatgggacggtgaaggccgcgtttacttccacgatcgcattggcgacacgttccgctggaagggtgaaaatgtctctacggctgaagtgagcgacacgatgtgtaaacacgccagtgtcaaagaagcgaatgtctatggtgtgagccttcctcatcatgatggacaagcaggatgtgcagccgtccatctcgcgtctgatcccacccccgagactatgcatgacatagccacgcatgtttgcacagaactgcccaagtacgctagacctttgttcctacgaatcgcgactgagttgngtggtggacaatcactggaacaatgaagcagcagaagcatgctttgcgagaggcaggcgtcgaccctgctgaaa

SEQ ID NO: 58486 - DNA, 491 bp, Triticum aestivum
  unsure (1)..(491): unsure at all n locations
  Clone ID: PAT_TA_58486
gccggccgggttcgggatgtaacgtcatccgacacagtcacagtttctgtcaacgtcagcaacaaatctaagcgcgatggctccgaggttgttcagttgtacgtcaaagacatgctttcctcagtcgacgttccccgataccagctcaagggcttcaagaaggttgctgtcaaggctggtaagaccgaaactgtcaagatcgatctcaaggttgaggaatggggtctctggaaccggaagatgaagtatgttgttgaacctggagactttactgtctttgtaggaaactccagcgagaattttatgggcaatgtgacggtcactgtcgcctaaccctaattataataggggaagagatgtcacgataattaagtaaacttgccgatccaggcttgttcnaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 58487 - DNA, 498 bp, Triticum aestivum
  unsure (1)..(498): unsure at all n locations
  Clone ID: PAT_TA_58487
gccggccgggtcgggacctttttatttgcacacagatcaacctntcgggatcaaacacaatgacaacccacacactccaatccaaactccgtgctctcaaagtcctggagggggcgtcatatgccaagacggactttaaattattcccgaacaccccgcatcaggcattcgaaacatggctggacgaagccatagaatgcggagtctcggagccgcatgctgtcacgctctcaacgattgatcaagatggtcgacctgatgcacgcatccttatcctcaagaatgttgatgaccgtggatggcactttgcaaccaaagcagatagccccaaaggccgacaaatttctatgaacaacaacgtggccctcacgttttactggcctgggatgggccgccaaattcgtttgcgtgggaaagctgtatcgttgtccagaagtgaatgcgacgccgacttttccgctcgaaaaaaaagaaaaaaaaaaaaaaaaaaggccccta

SEQ ID NO: 58488 - DNA, 526 bp, Triticum aestivum
  unsure (1)..(526): unsure at all n locations
  Clone ID: PAT_TA_58488
cgactactgggactttntgggggatttttctcaagatgtaccaacaactcacaaccatgattatacaaggagggaggcattatatggagacaaatgatagcccaacacggccgtgaaagtactgtgagtatcagctcgaagggatgaagacagtcgtcatgatgagcctcatcgtagagcgaacaccgtctcacggggcttgtgactgagacggaccctctcacgatactcacagtccaagaatgcgtcgtacaccatagcattcgtgcacatgctcgaggaacccttcttgagaccataggcgggtcagcaacgcgaggagtggacggtatggcccaacatccgctgggacaatttgtgagagagtgcgtggagggagtatgccctgcatataatggctgtacgtaacgacgcatccctgacacaggacgcctttttcaatacctgtatctgaaaggtacgggaaccgaatggaggccatgccaccaaagtcatcttccaaaaaaaaaaaaaaaaaaggccccta

SEQ ID NO: 58489 - DNA, 757 bp, Triticum aestivum
  Clone ID: PAT_TA_58489
gccggccgggtcgggaaccacacaagaggaactcgccagctccacgagcagaggagccgacaccacaagaccaggagcgagacaacatgcgtccatcgcgggacctccgactggccgtgttcctcctcctcttctctgcctccgtccttctcccggcagccagagcccagcaggaaaccgaggaggaggaggagttcagctactcgctggacgcggagaacgggccggcgcactggggcgacatcaaggaggagtggtcggcctgcggcaagggcaacatgcagtcgcccatcgacctcgccagcccgcgcgtctccctcgtgcgcggcctcggctacctcaaccactcctactccccggccaacgccaccatcgtcaaccgcggccacgacatcatgctcaagttggagggcgacgccgggagcgtctccatcggtggcacgccctacttcctccggcagttgcactggcactcccccacggagcacagcgtcaacggccgccggtacgacatggagctccacatgttccacgagagcgccgagggtaaagccgccgtcatcggcgtcttctacgaaatcggcgcccacgacgccttcctacacaagctggagccatacctggagatgatagcggatcggaaggacagggaggagaagatggggatgatggacccgaggggcgccaggggaaagggcagcgtgtactaccgctacgtgggctctctcacaccccaccctggacagaaggggtcatc

SEQ ID NO: 58490 - DNA, 504 bp, Triticum aestivum
  Clone ID: PAT_TA_58490
gccggccgggtccggaaaaccaccctcgatctctcgtcaattgagtcatcatgtccgccgcacccttcttctggcgagctcccctcaagtactgccgctgggcagcccgcgagcgtcccgccctcttctggtccgtcatcatcggcgctgctggtcccgttgccatgcccattgtacctccgatccgacactactttggcgatattgatgcgcccccggttcctgtgacctaccccattcccaatactcccaggaaacagctcaccggctacgacgattaagatctcgaattaaagaggaaggaaataacacggctcggaacagaaaagaagaagcgagcatacactattgtacaaactacggcgtcaccagagaaagcgctacagcggagggggaggaatatcatagaggaattaagggacaagagtcgacgtccaaaatttaccagcaaaaaaaaaaaaaaaaaaaaaaaaaaaagaaaaaaaaaaaaaaaaaaggccccta

SEQ ID NO: 58491 - DNA, 323 bp, Triticum aestivum
  unsure (1)..(323): unsure at all n locations
  Clone ID: PAT_TA_58491
ggccgctcgaggccggccgggtcccnaaatatggagaacgtgccagccgatgcagagaattcagtctgggcgcgacgaccgtgagtgatagtggaggaatctccatcgctggactattgagcatcgtgatggagaccaagctgtgcaattaccaggtggcacatgggcgggactggtgtcaacgcatttcagcacagggtcagtagagcaggcgtttgagcgatgatagagtggtttgactgtagatatggatcggctgcgggtttatagaagctctgatatgcattacgcgtttcgaaaaaaaaaaaaaaaaaaggccccta

SEQ ID NO: 58492 - DNA, 202 bp, Triticum aestivum
  Clone ID: PAT_TA_58492
ggtcggcgttaccgccattccctgctagagcgaggaggaagtatccctgagatggagttcttgaaggagttccttggccgggagcctagctcggaagctttctacaaggagcttgggctttcgtcatctacttcctagaatgattgcagttaacgaatagaagagagaataccacgaaaaaaaaaaaaaaaaaagggcccta

SEQ ID NO: 58493 - DNA, 624 bp, Triticum aestivum
  Clone ID: PAT_TA_58493
gccggccgggtcgggaaaagctcgcctcgagcgtatcgcttctaaagacagcgcgacgccgctgagaaagctactgcgcacgctcgaaaacccgttccagtggcgactgcgcatccctccgtcaacgaccatccccatctccaaggactggtaccacatatcatactcgacgccaaaaaggccactggcaaggaatctcgctacctatcgactatcgcgcgtcgcttcaacgacgaaaatctagcaaacagctggcaaattatgtgcaagtatttcgatggacgctgcgcgcttgaacgcatcgccttgcaagaggacatgaagcggaagctggtgtggaacacactaacagccatgagtgagtatcttctctgcactcgccattggtgaccagactttgcttctatatttagatgatatcatagcacttgtagtctttggcattggatatgtgtacagccacggacgaaaaaattgtaatgataggaatctcgctggtggtatctaggcagtaaataacgatgaaatagcaggcgcaagattgtggcgaatacatcgagccaggcactccgccagacaaataaaagatctacttctcaaaaaaaaaaaaaaaaaaggccccta

SEQ ID NO: 58494 - DNA, 751 bp, Triticum aestivum
  unsure (1)..(751): unsure at all n locations
  Clone ID: PAT_TA_58494
gccggccggttcgggataattatttcttttatagacagatgtcgtcgtgttgctccagtcaaccatgtcgactcaaagagaagctgtcaatcctctgaggccgtactatatccctccctcaattggagcccccgctgagacagccgccaagtcgagccctagcccaaacccattcccagatggacgacatgtgactgccgctggtgaacgatatgcctccaaggcacgcgatatcctctccgacctcgaatacaatgattacctaggcgacacctcgccgtctatggttcagaatgcgaagagccttatcgatgagctgctatggaaatacagctcggttcttatggcccagccattcgaggtagcgaagacattgttgcaagttcgaaaccaagatgaaaatgctgtatatggacttcctgcggagccagagccccctaagaagccggtctctccaccgagaagctccatgtatgattttagagactcggactctgagggcgaagagcccaattacttttcatcgaacgataaggccgagttgcaaataaggcaggaattattgataactagtaataagagcgaggggggaaagtcggtattggagtttagaaatcgtgagaaaccaccaaataactagtaatggaggaactgttgtctactttgcgaataaatgctcacaaggtcttgngatgtttagatttgtaattgaacagcattgcaatgaaaaaaaaaaaaaaaaaagccccta

SEQ ID NO: 58495 - DNA, 243 bp, Triticum aestivum
  Clone ID: PAT_TA_58495
tgtggcgattacgaaatgtgggaaaagaaggaaacgaagcgccttgatggctaatgagcgaggaaccgaatttgtcttgggtagatacgttggatatataacggattttcttggtgtatattttattctggaaagacttagacaagtttgggagggtatacgaatctttgatggaaacatctatattattaacgaatttacgatattataatggttgaaaaaaaaaaaaaaaaaaggccccta

SEQ ID NO: 58496 - DNA, 625 bp, Triticum aestivum
  Clone ID: PAT_TA_58496
gtgcggcgctcaggcggctcaacaaaacttcctcaccccttcatatcaacctccaaatgtcttccttcgccgtagtaaaagacatcgaccacctcgtcctaacctgccatgacgtccaagctacaatagcatggtacacaaagtacctgggcatgaaacacgaacccttcggccccgaatccagtccccgtcacgctttgaaattcggcacgcacaagatcaacctccaccagcgcggtaacgaattcgagcccaaggcccaaacggctttgcctgggactgctgatctgtgctttatccttgaggaagggactgatttgcaagggttaatcacggagtttgagaaggaggatatcaaggtccttgaggggggaggggttgttgctaggactggtgctatgggagggattaagagtatttatgttcgtgatccggatgggaacttgattgagttgtcttactacacctcttgatagccccatgaatgctttcaagacacgttttatatcgtgcacatcaaagcgacagccaactgatcttccatgtgctctattaaaaatctatcataaacaagtacaagccacataagttgtttacacaaaaaaaaaaaaaaaaaaggccccta

SEQ ID NO: 58497 - DNA, 751 bp, Triticum aestivum
  Clone ID: PAT_TA_58497
gcggccgtaaccgcattatttttgacgatgcagatcttgagcaggctgccaaggataccatgtacagtatccagtggaacagtggtcaggtctgcatggccaattctcgcgtttatgtgcaagactccatcgccgataacttcatccaagcttgcaagaaagcactgtctgccgcaaagtcgggtaatcccacagagaagggcatcaaccacggtcctcaagccgacaaggttcagtacgagaaagtcatgtcttacattaacgagggcaagaagtccggaacgctggagctcggaggaaatggaaatcttgataagacaggtggtttcttcgtcgagccaaccatcttcttaaacacgcctgaggatgcaaaggttatgaaggaggaaatctttggaccggttgtcaacatcaacgtcatcaagacagaagaggaggccatcgaaaaggcaaatgacacagagtatggtctgtatgctgcagtatataccaagaatgtcgacagggcgatgagggtcactcagaagctcaactctggttacgtaggcatcaattgtaccagtcctaccaccgcgagggatctgccctttggaggatacaagtcatcaggtcagggccgagagggctggctttacagtttggacaacttcttggaagtcaagagtgtgatgatgaaagtagacagcggttccaagttataaaacaggccaaattgttcataccacgaaaaaaaaaaaaaaaaaggccccta

SEQ ID NO: 58498 - DNA, 477 bp, Triticum aestivum
  Clone ID: PAT_TA_58498
gccgtcaccctcttactatcaacaacttcacaaactcgataccatttaccatatacccctttacctacctcgaaccctacatcctgattaagccgatcagatcccaaatcaagaacaatggaacaacagccaatcaacacccaagaggccactacgcagcctttgaacgaaactcccgtcgttggctctcctcctcaagaccgcagggcaagtgatgcagcgtacgaccgaagaatgagtgatgagtgggacgcatcaaaggtctcccagccgcttccagaagcgcaagggatccatctatgctacgcccggttcccgtgacggccacgttgacaggaattacgcagacaagtactggaacaagatgaccgagaagaattggggtagtagtagtaaataaactccgaacgatggaaataaaaaaaaaaaaaaaaaaaaaaaaaaaaaaaagaaaaaaaaaaaaaaaaaaggccccta

SEQ ID NO: 58499 - DNA, 216 bp, Triticum aestivum
  Clone ID: PAT_TA_58499
gtgcggcgctcgaggcggccttactcgaagaacttcctagcgagcttgaggtattatacgagtccatgtggtccagactcaatgccaaaaacaaggtgtatcggcaaactgcagcgatgtatttccatttcctgttagccaaaggatggaattttaaagtcatttatcctgatgttgaagtgccttttacaaaaaaaaaaaaaaaaaaggccccta

SEQ ID NO: 58500 - DNA, 426 bp, Triticum aestivum
  Clone ID: PAT_TA_58500
ctgtgcggcgctcgaggcggccgtacacaaatggcggatgcccctttggaaaataacaaaaaaaaaaaaaaaaaaaatccctcttgctactactccagcttgatgttgaggcaacaacacctatctgctatatctcccttttcttcctggttttttcatccaaaatggcgtcccgccccatctttactgccacgcacccccgtgcatgctctacggcttttgagcgagtcttcatggcccgccgcgatatcctagagagcgtccacgagcctttcggagatgccttttactacggtcctgaaattctcagtgatcgtaaaaaaaaaaaaaaaaaaaaaatttaggtgacactatagagagagaaccttgataggttgaaaaaaaaaaaaaaaaaaattaaaaaaaaaaaaaaaaaaaaggccccta

SEQ ID NO: 58501 - DNA, 842 bp, Triticum aestivum
  Clone ID: PAT_TA_58501
gccggccgtgccgggacccatatcacatatcaccacttcataaaactcacaacaaaatgcctcctcgtgtccccacagaagaagacttctcccccctcaaatccaccctccctcacaccctccacttccccgaccccccggaatcaacaaccacattcctcattctcttccatggccttggcgatcatgacgtcccctatgcaggcttcgccaagaacctcaacctcccaggcgtccttggaatttccgtccgcggtacttccgtcctccccgctgcgttgatgggcaccgatgtccccggctatcattttggcgatgatctcactgttgaccccaacacaggagatatcgctgatgattctggtttcgagaaggcgcgcaagctggtcatggagaaattgatcactgaggttctcatcgagaaatgcggctgggagatgagagatatcatgttctttggtttcggacaaggcggctcgcttgccctcggtcttgcggcttctctcgacactacttctcgtgtcacggacgtcacagaaggcgagaacactacagctgcaggcaacaagaccttcaaaggtctcatctccctcggtggtcctttgccacaatcgatggtgtcgactgttaccaaccgtcgcaagagccgcacaagcgtgctggtgtgtcaactggacgaagacgccgtcgacgctgtgaagcaggaatttgacgatgttaaggtggtgcagtggaagagacgccagttgagcatgccgatcgacagagacgaggttctacctctgatgcagttctttgccgataagctcaggaacgaattttagattaatcgccagacatct

SEQ ID NO: 58502 - DNA, 831 bp, Triticum aestivum
  Clone ID: PAT_TA_58502
gccggccgggtccgatcgagattgacgttgcttggctcagaagaacgccacctctgtccagaacatcaagccccaggttgaccgcttcctcatgcccagcggccgccacatcatcctccttgctgagggccgtcttgtcaaccttggctgtgctaccggccactcttcttttgtcatgtcctgctctttcaccaaccaggtccttgctcagatcatgctttacaaggctgctgacaagacctttgctgagaagtacgtcgagttcgccaagaccgacaagctcgacgtcggtgtctacgtcctccccaagatcctcgacgaggaggtcgcccgtctccaccttgctcactgccaggctgagctctccaccctcagcaacgtccaggctgagtacctcggcttgaccgtcgagggtcccttcaaggccgacatctaccgctactaagcgaacataatcaatacccagggatccttcaactggatccctacgtgtgacgaactttccctcttctgtcgacatgataatcggcaaaattctagtttcaacagcatgaacttgcatggcatatgggtcgggagagttactaggacatctgcggttttctgattttttttacctttctcttctttgtttctgcttatttgggtttacttctcctctcagaccgaagagaagactcctcgcagggtgcagggaggggcaaaaagatctttgctttttcaacaaaatggcgttggcttttttgctaatcatgattccccccttcgagatataaaaacggatgatgaatggaatgagtatggacggatatgaccaagacgagacctccc

SEQ ID NO: 58503 - DNA, 433 bp, Triticum aestivum
  Clone ID: PAT_TA_58503
gccggccggtctcgggcaacgatcgcacgctcctccccgtggcatgctcggtgagggcgagcgcgagcgacgacctttcggccgtggccgcggtggtgaccgaggtgaccgtgagggtggataccgacgaagggatgctggcgagggcaaggagggtggtgctcccggcgagttcgctcctcagttccgtggtggatttggccgtggccgtggcgctgcccccccttcttaaacgaacccattttatcatctaggtggtcataaatgagaagcatggcgaagggtatcggcatgtactcataaaaaatggagggcaatttctaccatgggtttcgctcgtgtgacaggggttgcgtgggggatccgtgggagtttgagggttttagaacctcggaatcatttgcaccaaaaaaaaaaaaaaaaaaggccccta

SEQ ID NO: 58504 - DNA, 681 bp, Triticum aestivum
  Clone ID: PAT_TA_58504
gccggccgtgtcgggatcagccacttcaagccaggcattcatcaatccagccccgtatcagcaacagctgctcaaccgtacgcaccgtacgtgtgtgctcggagacagagagctcgactagggacacgtatatggcgacgatggtgagggcggtggtgctggccctgctgctggtccagtgctgcaacgtggtgctcgcggcgaggctgctcgagggagacggcggctggctgcacggcgacgttggcgccgccggggcgcttatcatgcagaccctggccggccactcccccggagcaggagcacccaacccctgcacccacgaccccgtcaacaacaacccgcctggcgcggtatgccacggcggctagccgccggcagagttccgctagtcaattgcatgcgtacatgcgtagttgaaggaagttggtccggtttcattgattttcttcgttcatttgttcgttcattctgtacatgtaattatagggcttgcatgaaacgatggaaccctggtagagtagttgtttcaaatttggttagttttagtacgtgaatttgtaataaagtagtctttggtgttggtccgtaacaactgaccaaagtgtataaagatctccatatttctattcgtatgatctcgtatccatgagcgaaaaaaaaaaaaaaaaaaggccccta

SEQ ID NO: 58505 - DNA, 326 bp, Triticum aestivum
  Clone ID: PAT_TA_58505
gccggccgggtccggtgcgatacggtgcaccacaatacagtacggtacagcgcggcatgtgacagtattgtactgtggaaacatggagggtgggtcgtcatgggaaagtgcttgaatagcatgaggaatatgacatttgcatcatcgcgatcatcgccgatgatgtatgtatcgcatcagcttgcaattcgcggagctggtgccgcacccagcttgcatgtatcacaatgcgacgctatccatagctaaagctacaccgagcaacagcaccacagaaaagaaagaattattaattgtcacaaaaaaaaaaaaaaaaaaggccccta

SEQ ID NO: 58506 - DNA, 372 bp, Triticum aestivum
  Clone ID: PAT_TA_58506
gccggccgtcccgggtttaggtgacctatagaaggccgtccgggacgagaagtgggagcccagcaactgcaatggcaactcttactgctgcaagactgacgcccctgttggctctttcatcaacgttgctctcctcaactgtgtcaagttcctctagaggaccagttgcattagcagctcgcagctctctctctgagtgctaggatgtgcaggatgggttgattggttggataatgggaacatggtgtggaggatactgacggggaaggcctctgctagctactccgtgtcaatagggtcttcacttctactataacttggctcgacttatatactattatttctgaaaaaaaaaaaaaaaaaaggccccta

SEQ ID NO: 58507 - DNA, 390 bp, Triticum aestivum
  Clone ID: PAT_TA_58507
gccggccggtcccggccgaaagaccatgttcccccagacctcccgaagggccctcgagaaggtcagcctcaagtggatcgacacctcgtccgagttcggacacggtgctttccagacccctgccgagaagaagcagtaccagggtactctcaagaaggacctttcttccgcttaaagcggcagtttgtttctttttgtatcttaaccaatcattccattgcatcggtgtcaagggttggttcgttacgcctcgcgtttgggctgggtcaggtatgaactggcatggagcataaaaaaagtccagctagaagagggatggtgatcaaaaattctaacgagattcccaatgttaatatgactctaagaaaaaaaaaaaaaaaaaggccccta

SEQ ID NO: 58508 - DNA, 806 bp, Triticum aestivum
  unsure (1)..(806): unsure at all n locations
  Clone ID: PAT_TA_58508
tgtgcggccgctcaggcggccgggacanaaaatggaatattttgttctgttcttctgcaaaagtgttcatcatgacaacgtacattccagccctcactttgccagactcggtcttcctcaagccggctctttcggttttactacccatcggcctcggcacagctgttggcttcagcgctactcaaacccaaaagacatatcttgcgttgaagaagccctcggtgcaacccccaccatggctattcggacctgtctggactattctctacggtgtcatgggatatgccgcctaccgagttgctgacattggtctttctcccttctcttctcctgagactatcgtcaacacccgacaagccatgactgtttactccattcagcttggtcttaacctcatctggacacctctcttcttcggcctataccgccccatcgaggcctctgttgacattataacactcctcggagtcaacggttatctcacctatctctacagctccattgactctactgctgcttggtgccaggtcccctacctcggctggcttacctttgctacctacctctgcactactattggacacttgaacaactgggacctcgcaagcagcgagaccaacaagaaggagtaaggtgatccggcagaaaaatattgtaaagttcaccttttgatcacgagcttcgaatgcagctacactgaaacttcaagtctaacgcactctaatcgtctttttatcaaaagtcttatgtaactgtctatcttaatcaccagttgagaaatatatctcaaacttatgctccaaaaa

SEQ ID NO: 58509 - DNA, 324 bp, Triticum aestivum
  Clone ID: PAT_TA_58509
gccggccggttcgggcaagcttcagagctacaccattgattttggcgaggagagtggttcggccgcatgcccgttctaccctgatcagaagcagtaccacatgtggatgaagcaggtcgccgctggattgaccgaggttgctctcaaggctgccgataccactcctgaggtgaagaagtgcccttattagataatgacgacgtacatgatggagcgtttttgacttagatgtatataattaaaagtcataggtcaatcctagacttactcacaaatgataaccaccaacaaataacccaaaaaaaaaaaaaaaaaaggccccta

SEQ ID NO: 58510 - DNA, 820 bp, Triticum aestivum
  unsure (1)..(820): unsure at all n locations
  Clone ID: PAT_TA_58510
gtgcggcgctcaggcggcgtctgggattctcccacccttcttcatcttgtcctacttcgataactcactctacctagtcatcaacctagaacacagcttgacacaatacacaatcactatggaaacaatggcaccactaaaacaggccctgccctctctccagatcttcctcagccaggagcaggctcaggagctaggcatgacgccatggttcagctactctgtcacacttcccgagcgccccatccctggcgcttccgaacgaaaatccattgagactgagcgccttgtcgtccgccccttcacaatgaaggacctagaagctttccacgagcttcgcaaactccaagagctccaagtctactcaacagcacgtggtcgcgccaacaaagacaaggacgagtccgaacgacaactccactctctagttcaagacgaccaatgccactggtggttcggcgcctttctcaagtctaccggcgagcttattggcgagggtggtctcccagatgttctcgccatgtcttcttcaatttccggctggcctgaagccgaattccttatcaagccccaacactgccgtcaaggatacggctcagagctctggaccgccattatggattcctggtgggacctgccccgcgagaggagacggcatcagctcatccccctcgttgctcctggtaaggaacccggcgacaaggtggacgagtgcgtcgtcttccagtgggaggncagcaacgaggtcgccagaaacttttttcgccaagatcctggcacaagcacccggtgctgcgcagggtggctgcgagagtattga

SEQ ID NO: 58511 - DNA, 675 bp, Triticum aestivum
  Clone ID: PAT_TA_58511
gccggccggttttgggatcctacccagtcccatcttcatactcttccaaatcacatcaacacagcttaacaccccattatcttcttctctacttcattccccagccaacatgtatactgcaccaggaatcctcaccctcaccggttccaacaggatgaccctcacgttcattattgacgacgtgcattttactttaacgggaaatattaaccccgctatgccgcctttcaaggcaaaccaagtcatccttacatacaacaatgtccatgagctgagttccacagtatcattcgagggacaaatcggaccaaacaactttaaattgaacctcgaaaatggtgtcaccgccgagggttatcttgatttccctatcagccctgcctcgagaatcagcggatctggtacgtggtcgcagaactaaggctgcacacactacgactttgggcaggccgacgaagcaactgcaacactcgcgctgcctatcaaggaatcttctatatctattcatatttgctttccaagcatgattgccgataaagatctttgaaatgatatcacgacaaggatggatatcggatagccaaggacgacttgggaagtgaagatttagatacttatccgaaaggcaatagaaatactttttttggtgcaaaaaaaaaaaaaaaaaggccccta

SEQ ID NO: 58512 - DNA, 365 bp, Triticum aestivum
  Clone ID: PAT_TA_58512
gccggccgtaccggcatccgccgagatctgcccggcatcacagcttcttcaccgacccaccaaagaactagacctggtcgccgtcgccggagacctcttgtccaagccaagaggaaggaaggaattcctccgcgagatttttttttcccttctgaaggaatacaggaatattgttgttgtttttcctcgaattcaagtatattattcgccatgactagttgtctggctgtacaccattgattgttgtgatcatacacacaaaactcggcctgaataatccctatatgtcttgaggaaaaaaaaaaaaaaaaaaaaaaaaaaaaaaaaaaaaaaaaaaagaaaaaaaaaaaaaaaaaaggccccta

SEQ ID NO: 58513 - DNA, 485 bp, Triticum aestivum
  Clone ID: PAT_TA_58513
gccggccgttcccgatatcgactattactctggcgagcctgaggctgacggcgagcctgttttcttcctcgacgtgcgtcccgctgctactcctttgggctcggccgagcgcattattcgctggagcaccgatacctggtggaaggccattggcggtgacagacacgagcaggaccctcagccttggttccggggctcttcgtaaaatcatttctttggcgcttgggtcacgatgaatgccggtgtttctagggatgtttctagcgtatttcattctcctctctaattgttgtgatgggatgtatttttataacgatggctatgtgggtgtcacttgtacaaacattgggttggatgaaaaattaggaccatttgtattattatacatatggtactgtgattctgtcgcaagtactccctccgttcctaaatataagtctttgtagagatttcactatgaaaaaaaaaaaaaaaaaaggccccta

SEQ ID NO: 58514 - DNA, 291 bp, Triticum aestivum
  Clone ID: PAT_TA_58514
gccggccggtctgggatccctggcggtggcagccaaggtggtggtggattcggaaactcggcgcgacatgtgcgtcttgttgatggaggtcagaggctagagggtgagctgtctcgcgatggtgattgggttctgagctctatcgtccttgacgagcgcatcagaaattataacggtacactggagctggtctagatatatgcgacatagtaacagcgagtttgctgcataatatatttttgttcaaggttaaaaaaaaaaaaacaaaaaaaaaaaaaaaaaaggccccta

SEQ ID NO: 58515 - DNA, 711 bp, Triticum aestivum
  unsure (1)..(711): unsure at all n locations
  Clone ID: PAT_TA_58515
gccggccgtgccgggagatgaatctgtcatgtccctctaggcgaggaaacaccgccaacgtcatcctatacttccctacccatgctctgaacttcactttccgcgacaagtcctataagaagtccggccaccagaaggacaaggatgactacaccatgtggatgcccgtcaaccttgcctacgctggtgctgctggtgccacttctcttctattccactactctctggactactcccgtactcatcttgacaaccatgacaagaacttcaatcccggtgctgaccgtcaagtcaactgtctcgaccacgtctacaagaaaaacctcgcctctgacgatattgacatatctctaccaagaactgcatgcccatcacgctgatgatatcgtcaaccaccgtgaccgctacttcataatgtacgactctatctctcccgacgtcctcagcgataatctccagggcaacttccttgcctctatcgatcctggtagaatcgttcccactggggacactatacacacttaccctcttgacactatccgccanacgcatgtatgatgacctccggtgaagacgtaaagtacaacaacaccatggacgctgcccgacagattgtatccaaagagggtgtctagactctcttcaagggagctgatgccacaatctccgtgctgatgacggtgctgcagtgctctccatctaccatcagct

SEQ ID NO: 58516 - DNA, 580 bp, Triticum aestivum
  unsure (1)..(580): unsure at all n locations
  Clone ID: PAT_TA_58516
gccggccggttcgggacatcactctctattcttcacatctatcacctactacaatctccccacacatcctatcatcatgtctgccaaggtgtatgtcggcaatctgggctggaacacaacagatgactccctccgaaacgctttccaagactatggccaaattctcgactcggtaagccacgggccctttgcgcgttatcgcctgggactaatttgtaacgcaagattgtaatgcgcgatcgagatactggtcgctcaagaggctttggtttcgttacatttggtagttctcaggaagccgagactgcaatcatcagtttgaatgaacaggaacttgatggccgtcgtatcaaagtaaatctagccaatgctcgtcctggtgaggtggtggnanggtggtggttacagtggaggcggtggctacagcggaggcggtggctacagtggaggcggtggtatatgggnaggtggtggttataatgggaggtagtggcttcaattaaggtaccggacataaatctagttaaagtatggatcatgtggtttaagatcacaaaaaaaaaaaaaaaaaaggccccta

SEQ ID NO: 58517 - DNA, 473 bp, Triticum aestivum
  Clone ID: PAT_TA_58517
gccggccgttccgggatcctctctctacctcaactactcacacaaatcaccaacaatggctaaacaaactaccctcgacgagttcaacgccgtcttccccaagctcgaggaggttctcctcgaccatgctcgctcttacaagctcccccaggagcagcttgactggtacaagaagtctctcgaggccaaccctctcggcggaaaatgcaaccgcggcatgtccgtccccgattccgtctctctcctcctcgagaagccccttactgaggagcaatacttccaggccgctactctcggctggatgacagagctcctccaggctttcttcctcgtttccgacgatatcatggactccagcatcacccgtcgtggccagccctgttggtaataccacaggagctataacaagacctctctagaatctcaagggaaagaatacaagcgtccaaaaaaaaaaaaaaaaaaggccccta

SEQ ID NO: 58518 - DNA, 630 bp, Triticum aestivum
  Clone ID: PAT_TA_58518
gccggccgggtcgggtgacgaccactgtaaacctcatctttggatctctactcatggacaacctcactggtgtgattttgaataatgagatgaacgacttttctatcccaggcgttccaaacgaattcggcttcgctccagcagaagcaaactttgtccgtcccaacaagcgtcctctttcatcatgcacacctatcattgtttcgaacaaagacggctctctatttgccgtaattggtgctgcaggaggatcccgtattatttctgctaccacgcaagttgcctggcgcgtcctgacttctccatcttggtctatcgaggatgctgtccgcgagccacgtgttcataaccagctgatgcccaacactctgctcgtggagaaaaagttcagctcatacgatgttccgtcgctgaaggagaggggtcataatatcacttgggttgatgagggattgagttcggtgcaggctctcgtcagggactcggatggtgtttttgagattgctgctgagcccaggcagaagaacagcggaggtgccacactttagactagactatagggaacggtatagagttgagcatcactatggcgattgttgatcctaaaaaaaaaaaaaaaaaaggccccta

SEQ ID NO: 58519 - DNA, 319 bp, Triticum aestivum
  unsure (1)..(319): unsure at all n locations
  Clone ID: PAT_TA_58519
gccggccgggttcggggatatgatcttagcaagactagttaancatcttcttgcgaagagttttatcatacatgaccagttcagtgtataaatctaacaatctggttagccttgctgacaaagttcatggcaccagacctcacctgcttcttttgctattgtaaatagtactccctctgtaaagaaatataagagcttttagatctctaaagtagtgatgtaaatgcgcttatatttgtttacggagggagtacatacattaaaaagactaggtcaggtggccaagttaaaagaaaaaaaaaaaaaaaaaaggccccta

SEQ ID NO: 58520 - DNA, 840 bp, Triticum aestivum
  unsure (1)..(840): unsure at all n locations
  Clone ID: PAT_TA_58520
gccggccggttcgggtcgatattttctcgcttgggctggttttcttttatgttttgaccaatggttcgcatccttttgactgcggtgatcgctacatgagagaagtcaacattagaaagggccagtacaacctggatcttctcgactctcttggtgatttttcccgtgaggcctcggatctcatctcgtccatgcttgaagcagaccctaaatgtcgcccaacagctaaagaggtcatggctcaccccttcttctggtcagcaagaaaaaggctctcattcttgtgcgacgtatcggatcactttgagaaggagccgagagaccccccatcatcggcactggctgagctcgagagccacgcctctgatgtgacaggtgactttctcaaggcactgccgcgcgactttgtggactccctcggtaagcagcgcaagtacaatggggcacgcctccttgacctgcttcgtgctctgcgcaacaagaagaaccactacgaagacatgcccgaggcactcaaacgaaacgtggggggctttgcctgatggctatcttgccttttggacggtgcgattcccttcgttgttgctaatctgttggaatgtcgtctgggcaatacgctgggataagaccgaccgtttccgtgaatactacgaacccgcggctctctaaccaggatccgtggcaacgtctattgcataggacggcattgcattgattgtactgcccgggaaacatattttttggtcgagctagagggagaaattgacccttgggtggtangaaaattggttgctagagcgtaagagatgaaatcgtcagccagttatgtcatttaaacaa

SEQ ID NO: 58521 - DNA, 692 bp, Triticum aestivum
  unsure (1)..(692): unsure at all n locations
  Clone ID: PAT_TA_58521
gccggccgggctgggaaccgaagatcacacctctacctacagangcatttgacatatatatctactcgtctacttcctgttctctcaaagctatgacttactattgtgccgaagacatgcgctcgccagtctgctcgttcctccgtcaacagacagactgatgcatgagccataaaacgactaccgagtgttctacactaaccagctcagagatgacctcgggtgaagccctcacaaagtctgctgataaacgtgatcgctcagaggatttctactatgaagtagctgatcgcgcatgtccccgctcatcagcggcaactccgagattgtcagcgcagctatgaacgtcctcgatctagtagcggcgatcactaagcacaagctgaaggatagaatgccaaaagcatactgcttaacagatagtctccatgcatgagcacatggctactcagaggtcgcgtagtaccacatggtatcacactatgaccaccgtgtgccataagtctccaaggagatactgctcaaactgatgagtccactacttgaacgtgtccaatgctaatgatatgcaatgtgagcaatatcatgttgacaccagcaacatcggccccatttcgaagcataaatagaaacggactgctcgtatcggactgtatctatgatacaaacggcgaagaaagatccataatcgt

SEQ ID NO: 58522 - DNA, 369 bp, Triticum aestivum
  Clone ID: PAT_TA_58522
gccggccggtcttcagatgaaaccacaccattatgaattgtacacagaaacagtaacccactcactctctcactctctctgctatctttacaccaaataataacaccgaagagaatagatgggcagtgcccgtgttgccaatacgtcaggtgataggccagccttgcttggagtagtctataccgctgttttgtacagcacaacacagcaacggcaagttatcagtaccgagtgagaaggggacactagcaattgatcttcatcattgcttcacttgtagatattcgatcatcgctctttactttatccggaaagggctggaattgatggattcgccgctatcaaaaaaaaaaaaaaaaaaggccccta

SEQ ID NO: 58523 - DNA, 845 bp, Triticum aestivum
  unsure (1)..(845): unsure at all n locations
  Clone ID: PAT_TA_58523
gccggccgggtcgagaaacctcggcttacagatcaacaaactgccacgcgattatttacagacgacttttacatactaaaacctctcactacacttccaaattactagtccagcctcctcaatggccgacacaccaggtctctcgccagagcagttggaagccttcagccgggatggctatcttatcctccccggtgccctctccagctcaactgtcaagtctcttctagacgaaacacacaatctcctggagaacttctctctcgatgaccaccctcttacacgtttctcaacaggcgagaagcgtgatcatgttggtgacgactacttcctgacttcaggcgacaaggttcgattcttcttcgaggaagacgcattcgatgatgaaggaaaactcatcaagcccaaagctcgcgctgtaaacaagattggccattatctccatgctttgtcgcctccctttgcacacctgctggaccacgatactagcaaggtcagcccacccgctgtagcgcgcagtcttggcttcaaggatccgcgatgtctgcagagcatggtcatctgcaagcagccagaaatcggtggtgccgttccacctcatcaggactctactttcctgtatactaaccctccttccgctgtgggcttctggtacgccctggaagatgccacgcttgagaacggatgtctcagtttcttgccaggctcgcatcgctgngcgccagtagaaaatagacttgtccgtaaggagggcaatgctggcacagagatggtgaatatggatggacccgagttccccgcgacagatgggtatggntagggatgagcagaagacagcatgacta

SEQ ID NO: 58524 - DNA, 744 bp, Triticum aestivum
  unsure (1)..(744): unsure at all n locations
  Clone ID: PAT_TA_58524
gccggccggttcgggtgacccacatctctaacactagctgcggctaattcgacagcgtcgagacacttgtcgtcctaaaatactaccgatagtgtattcgaattattatctgtgcatgctgactttcgcccctagaatacatcctcacgcgactcgtctactccgccatctgttcatttccacagttgcgtcattggcgcgggcattttacttcctatctactaccacctcttacatccaaccgccatcatggaaacgtttaaatctctcttcgcgaagcctgaccctcaggctcagatgcgaaaatgcaatgcattgatgcggcaaaacatgcgcaagctcgatcgcgacatccagaccgttaagcaagtcgaagcaaagaccaagaacctcatcatccaagccgataagcgaggccaacgcgatccctctcgctccagccaagctcaaaaggaggtccgcgactttgcacgtgagctcgttcgcgctcgcaagcaatcacaacgtctagtcacatccaaggcgcagctctcctctgtacagatgcaagtcaacgaggcctttgccgtgcgaaagatcgaggggtccatccgggcgagtgtcggtatcatgaaggacgttaactcgcttatccgcctgcccgagctggcggggaccatgcaagagctgagcgtggagttgatgaaggcaggcgttatcgaggagatggtcgaggacgtactacccgctgacggngaatgctca

SEQ ID NO: 58525 - DNA, 621 bp, Triticum aestivum
  Clone ID: PAT_TA_58525
gccggccggtcctcgtatcaggggttgagaagcctctactctgtcctaactaaggctactctgtgtctagactgcgatagaaatacacggattgtgtgtcggttgatcaatcgtcaagagtctaaaaaaagtaagcccagacgggcgcatgatcaattaaatatcatgttgagattatggctttgaaaaaaaaaaaaaaaaaaaggccccaagggccggggcggtccaaaaataagggaaccccccggctggcaggaatccaaaatcaggttaaccaaacccgccaaccccaagggggggcccggaccccaatccccccaaaagggagccgaataaccccggtccccgggccgccgtttaccaacgccgggatgggaaaaacccgggggtaacccacttaatccgcctggaagaccttccccctttccccagtgggggaataaccaaaaaggcccgaaccaatcgcccttcccacaagtggcccagccggaaggggaaaggaaaatggaaacggtaataatttggtaaaaatcccggtaaaattttggtaaaaccactccattttttaacccataaggccaaaaccggaaaaatccctaataattcaaagaataaaaccga

SEQ ID NO: 58526 - DNA, 402 bp, Triticum aestivum
  Clone ID: PAT_TA_58526
gccggccggttcggggaccgaacgtaaggagtcaatatcccgataccctccttcctatcccgcatctcactttcactgtcctctactagcatatgcttggtatgcaccagttgagatctgactacaaggtcatggatacctttgctaaaaccataccaagcgggaaaagacaggtcaaagcaagcgaaagtcacaatgatgcgggcaaaaggtacatggtgatgcatactccatttgcggacatggcgggtaccacgagtcgggcgagaagccctgttggtgtaaacggggacagtcgacagcgcctagtcgcagagagagagagaccaggcagggcaggcaagcaaaagcgcccggtgatggcggctttgccgagaaaaaaaaaaaaaaaaaaggccccta

SEQ ID NO: 58527 - DNA, 406 bp, Triticum aestivum
  Clone ID: PAT_TA_58527
gccggccggtccggcatccaaatttcatacactccttcaccaacttcttctcttgtatccctgttcttgatgtatcctcgccgacatcttcttgctgcactcactgctcttgctgcaaccactacatccattattatcccaacctgtgatcctggtgcttacatctacgtccactagaatacgactctgccaacaactttatgacgtcgcgtctgcatgacactgtcttctcgcaagacatactgacgtaggtaacggacatgaaataaacgtctataacagtgcgactaactagctgctgcacacactgttcgatgtgagatcatgtgagataccatattggagattgcctactttgcgatggaaaaagcaatgaaaggtccctaagtgcacgttcgctctattg

SEQ ID NO: 58528 - DNA, 786 bp, Triticum aestivum
  unsure (1)..(786): unsure at all n locations
  Clone ID: PAT_TA_58528
gccggccggtctgggttttgagcatgcttgaacaaaaaggctgacgatggcttcacctcacaggtatcgatctcgaccgccaccacgttaagggcactcaccgcactgcccccaagagcgacaatgtctacctcaagctcttggtgaagctctaccgcttcctggctcgccgaaccgatgcctctttcaacaaggttgttcttcgacgtctgtttacgtccaagatcaaccgacctcccgtctccttgtcccgcattgtcgccaacatcaacaaggagggtgagaagcgaaccgtcgttgttgtcggtaccatcaccgacgacaaccgtctgctcgagtgccccaaggtgaccgtcgctgctctgcgattcaccgccaccgcccgtgcccgcatcctcgctgctggtggtgaggctatcaccctggaccagcttgctctccgtgcccccactggaagcaacaccctgatcctccgtggccccaagaacgcccgtgaggctgtcaagcacttcggcttcggtccccatagccacaagaagcctcatgtcgagtcaaagggtcgcaagttcgagcgtgcccgtggccgaagacgttctcgtggtttcaggtctaagcggtttcaaggtgaaaattattggccttggggtggagttggggccagtttatggggcaaatgatgccgaacatcggcttgcaaatgggtcttgcatggaattggcgtgcctaggtatcacaaaattctacaatgaacttctcgcacanaaaaaaaaaaaaaaaggcccctan

SEQ ID NO: 58529 - DNA, 307 bp, Triticum aestivum
  Clone ID: PAT_TA_58529
gccggccggtttcgggaacaacgtcaataatgggggctcaaatagataaatgagtcaccttggaggaagttacaccgtgttataacccgagatttctgtcatgctcatactattcccttcaagtaagcttggagcttggagctcatatacgtggcgtcagagcttggagctctagcaccagccacacatgacgaagcattcgttgcttaacaccgatcaccactactcttctctgtcatgattctcataattagtgtattgcacttactttgagtgttctaaaaaaaaaaaaaaaaaaaggccccta

SEQ ID NO: 58530 - DNA, 336 bp, Triticum aestivum
  Clone ID: PAT_TA_58530
gccggccggttcggagactgaatggtccacggggaaggcgttcaaacccgcttaaccgtccatcccaattctggtcgtgcttgcgcttccagccctccgccgcgccccgcccgaacgctgcggtggccgcccactcgtgcaggtaactcacgatgctggaacttctgcggccctaagcactggagatgacccttgagggaggtttcactctgcagagatctctcccccgtcgcgtggcgggtgggaacacgttagtgcggggggatttgggatggcaaatggataagatggaacagccaactgtttttttaaaaaaaaaaaaaaaaaaggccccta

SEQ ID NO: 58531 - DNA, 403 bp, Triticum aestivum
  Clone ID: PAT_TA_58531
gccggccgggttgggttgcgaaatgttgttactgaagccggtctatttgccattaaggactacagagagtcaatcaaccaggatgatttcaacaaggctgttcgcaaggtagccgaatccaagaagctggaaggcaagcttgagtaccagaagctgtaaaaggtgaccgggcatgtcattatggcaagatggatatagccacggtagataagcgcatgtgagctccacgaataccggattattatgatggatacatcgctactgggtaatctgtaagactgtgcaatagagccggggccagcagcgttagattggctcagccctagaagcagaaatgcacatggcgtccaggaaagtaaacagaaactgttcacgccaaaaaaaaaaaaaaaaaaggccccta

SEQ ID NO: 58532 - DNA, 426 bp, Triticum aestivum
  Clone ID: PAT_TA_58532
gccggccggtttcggataagctgttggagaaaggtgttctctattcatatcgaaagactcattctcgtggttttcgccgcataaggtcgacaaagctcacctagagaaaggaaatcgctgggtatcatgtatgagtacaagaagtgggcaaggtgacgatgaatgcatcgagtgcgaggttgcggaaccgattgcgccttcagacctggttggaaaatacgagagcgtcgagatcgacggggaaacaattttatacaaggctgaaatttgatgggagcatgtccacggaagatggcaatccaaggtggaacaattcaaatgcttaccagcaaaagtcttgatagagcagatataactcctatgatctaaggacatcaatgatcccctaaaaaaaaaaaagaaaaaaaaaaaaaaaaaaggccccta

SEQ ID NO: 58533 - DNA, 295 bp, Triticum aestivum
  Clone ID: PAT_TA_58533
gtgcggcgctcaggcggcgtttccaaagttctatatctccgtcctgcaataactacatagcaactttatccatacctcccatctcatcggtcacataagtacccattactcctatatcgacatacatctaccttgactcactgaccgcggttctacaattgtggattggcacctcctgaccgcaatcacaccactgtaacgtgcttcatcacatcccgctttcatcaactggatattcatagaagaggtgcatacagattgcccttcccagccatcgaataaactcgaatttatg

SEQ ID NO: 58534 - DNA, 666 bp, Triticum aestivum
  Clone ID: PAT_TA_58534
gccggccggttcgggtcagtccgcgcctccagcgcagccttccatcttcccagtgatcccgagaccaccccaatcatctgtgtcgccgccggaactggtctcgctcctttccgtggcttcattcaagaacgcgctgctatgcttgccgctggccgaaagcttgctcctgctcttctcttctttggttgccgtgaccctgagaacgacgacctctatgctgaggaactagcacgctgggagcagatgggcgcggtggatgtccgtcgggcttattctcgagccaccgacaagtctgaaggttgcaagtacgtccaggaccgtatttaccacgaccgtgccgacgtgttcaaggtgtgggatcagggtgccaaggtgttcatctgcggcagccgagagatcggcaaggctgttgaggatatctgcgttcgccttgccatggagaggtcagaggcgacacaagaaggaaagggtgcgacagaggagaaggcaagggaatggtttgagagaagtagaaatgagcgttttgctacggatgtgtttgattagtcggtatctgttcaggaatcctccgttgattattttgagctaggagcatgatgctgtccttacctattataaagagcctctaatatctgttgtcgaaaaaaaaaaaaaaaaaggccccta

SEQ ID NO: 58535 - DNA, 463 bp, Triticum aestivum
  Clone ID: PAT_TA_58535
gtgcgccgctcaggcgccggtcggatccacagcattcctccaacacaaactcaacacttttttataaccttttcgaagttttcttcaccaacatcttcaacatgtctccctgctcttgctgtaaccacgccggcgcttcttgcaccagcgactgctcttgctgcaagcactaaatccattattatccaaacctgacaacacttggcttacatcacggtttcgtgacaatgtctcatcggagtacattatgaggacgtctctggatcggtctctcatcaagcaagtcagacagacatgggaatggacataatgaaagaaatggtataacatgcggataaatagctgcgacggccacttttcgatggtagcgcatggtagataccaaattggagcttgcatacattgaactagaaaaaaaaaaaaaaaaaaaaaaaaagaaaaaaaaaaaaaaaaaaggccccta

SEQ ID NO: 58536 - DNA, 369 bp, Triticum aestivum
  Clone ID: PAT_TA_58536
gccggccgggtcgggacgtgatttggagacgagctgagtaacctgtctcgttgggattggagaaaaatttcgacggtgcacagcgggcgtcaataaggaagttccagagtggctagcgcgtgtgttaatttcgcaggaagttagtttcaagtgtgatctgccaaggaggtatgtgcattatgccaggaagaagctcaagattgcagaaatcatagctccttcggcagtcccggagcttttctggtgaattttctccaaccctgccggacaaagaaaacaattacttgatatatcaggaaatgaacaaagttgctgatatggtggataatgatcgatttaacttaaaaaaaaaaaaaaaaaaggccccta

SEQ ID NO: 58537 - DNA, 342 bp, Triticum aestivum
  Clone ID: PAT_TA_58537
gccggccgggtcgggcagtaacgatgaagtagccaaaaggcaagacaagaccgcagttttggtcacgacaactccggcttcaggagatgcatgcacggcgttggtttgggaggtcaacaaggcggtaatcacaaaggcgtcgccgtttggcttggagatttgaggaaaatgatagttgatttcaatgctgtaaccagtcaaaatagagagttgtatttgttgaaaattgctgtcaattgctgtcgcttgatgaggcagttgagactgcctttgagagcggtgcaatgcagcagtttatgaataattgagagaaaataaaaaaaaaaaaaaaaaaggccccta

SEQ ID NO: 58538 - DNA, 540 bp, Triticum aestivum
  Clone ID: PAT_TA_58538
gccggccgggtcggggtttcagcatttgaagcagacgctgttcgtcaagttggagcagttcaacacatcacaattcgagtccaagaagcctgtgttgacaacaggcctgagatccggagatttgcgacaagacggctcagacagcgttgcgttggtggagggtccaagtaccgaacgggagatgcacaatgtcaaggaggacctcgggaatgccacgggagcttttcaacaatgaacatcacgtgatgacgtagttgtggtgagaacgggtgaggattcgttttgaaggccaagggtgagaagattcttgctgagcttgagggtcagtaagaggtttaagtattgaagttaatgccgcgggagacgggaggagagaaatgaggacatttgtgtagggcagaggaaacaaggtccaggaggtttctcatgggctccatcaagtctcttttgtgagctgtgtaccaagaaatcaacaaaattcctcttgtagccatataaaacttttctttctacgaaaaaaaaaaaaaaaaaaggccccta

SEQ ID NO: 58539 - DNA, 556 bp, Triticum aestivum
  Clone ID: PAT_TA_58539
gccggccgggttccggaaaaatacgacatctcaacctttcccacatcctctacaacaaaccgcaaccatgggcggcatctcggcagttcttctcatcctcattactatcttcttccctcccatcggtgtatgggcaatctcgggatgcgggatggatctgttcatcaacatttgcctgaccctcctaggatacattcctggtcacatccacgccttctatcttgagtacatctacttcgaccgccgagagcaagcgcgcgagggccgttttgcgactggaccggcgcctggtgtgtattccgacaacgtgcagactggaggtcagggatacggaaccattggacgtactggttaggaacgacgaatgtgagagagatggtgcagagggatttgtgttgttgaagaataaagctgaagtggttcgcatcacttcgagtggccagaccaccgatatcggaattagcgacatggtgggggctgtagagatgttaccacggaccaagaattaatgatagatgtattatccacagaaaaaaaaaaaaaaaaaaggccccta

SEQ ID NO: 58540 - DNA, 230 bp, Triticum aestivum
  Clone ID: PAT_TA_58540
gccggccggtttccgaagaaaacatcgatactcatttaacacttacacgtgatcggactcgacgggttttttacctacaacgctgcaacccaggtcatccgcaatgtcggtatcgcacatttgtccaagacaattccatatgatcgacagtggataagtcaagagaaggacaaaaacaaacccaatcggaaggttcttgctacgaaaaaaaaaaaaaaaaaaggccccta

SEQ ID NO: 58541 - DNA, 367 bp, Triticum aestivum
  Clone ID: PAT_TA_58541
gccggccggttcgggttttcttctttaatccttcacctttgtaaaaagcaggacgtgtccctgggcaaaggacactttatttaattcatcgcgagcatcagtatcgcattgcacactcatttcaagcatggtaaaaataggaggatgggtcttaagggtttgcacttaatgtcgtggatgtgggtgtttgtcattttactttctgttcctcatgtatatattattacacagtttcgattgcaggatattatggaagtatttggataaggttatgataggattagtaggtagttaatctgacgatggttgttggtataaaaaaaaaaaaaaaaaaaaaaaagaaaaaaaaaaaaaaaaaaggccccta

SEQ ID NO: 58542 - DNA, 480 bp, Triticum aestivum
  Clone ID: PAT_TA_58542
gccggccgggttccgattccactattgtcacattctccctcgccatcaataactcgacctgcggcatcaagtcgctccgccgcgcccttttttctacttctctgttttccttaggcgcctaagcccgtaactcgcgtgactgacgacctccgattaactcgatctcattactctcacgcgacccccgacccgtccgtcgctcaagattgttccgaataacgtgtcgctggtgtgctcttgtcagggcataatcgctgggacgtctggctaacataaaggttgctggttcagtggtttaacgagcgtggtgtctggaaagtgaggtggagcttgagggttgtttctcttctggcttgtttttgccagctgtactccttattcattgcacccatttcttttttgaccctattgccactattgttccctcaaagtacaatcaaaattgattatttccaaaaaaaaaaaaaaaaaaggccccta

SEQ ID NO: 58543 - DNA, 169 bp, Triticum aestivum
  Clone ID: PAT_TA_58543
gccggcccgggtgcaaaaacgacatgtttacgtctatttcttaccggattgcattaaagccgagcaggcttggaagaaggttgacggatttccttcacttgttgatacctcagtagtacaataccagagcacattctacattcaaaaaaaaaaaaaaaaaaggccccta

SEQ ID NO: 58544 - DNA, 171 bp, Triticum aestivum
  Clone ID: PAT_TA_58544
gccggccgggttgggtcatatgaggccacgactatttactttctacagcatgcatttccaaatacctactacttcttacattggtacctgcctgtgtacacctttacattttgtactttaaagtatatactcgattttctccttcaaaaaaaaaaaaaaaaaaggccccta

SEQ ID NO: 58545 - DNA, 513 bp, Triticum aestivum
  Clone ID: PAT_TA_58545
gccggccggtccgggacgatgtttctagtcgtactcagcaactgaaccagtcccagtggtcattctccaagagcttcgacggggctctccctctcggccctacacttgtcctgaagtcgttgattccagacccttccaaacttcacatgcgaggtcttaagaatggcgaggtgtaccaggagagcggaactgatgatctcatcttctccgtcccaaagattattagctggctgtcgcagggcaccactcttcctcctggaaccgtcatcgttactggtaccccggcgggtgttggaatgggcagaacaccaaaggatgctctgaggcaccgcgacgaatttgcagttgagatcctgccacacattggaacacttaccaacattttcgagaatgagaagagcgagttcatgacgaagctgtaagcatttccagttatataactatccaactcatatataataatattacggatatgtgtattccttacaaaaaaaaaaaaaaaaaaggccccta

SEQ ID NO: 58546 - DNA, 226 bp, Triticum aestivum
  Clone ID: PAT_TA_58546
gccggccgttccgggaagctgcgttcgatgatctgacagacgttagttaatttcttcgtttatatccattcgccacgagatagagattgttccacaattggcgacttggcgacttgtcaggcattcatggccaacaactgcgcaagcgggctagccccagatctactgaaggttattaacaaagatccgcatttacttccaaaaaaaaaaaaaaaaaaggccccta

SEQ ID NO: 58547 - DNA, 366 bp, Triticum aestivum
  unsure (1)..(366): unsure at all n locations
  Clone ID: PAT_TA_58547
gcggccgcttcgaggnccggcccggtttcggaaaaaaaaaaaaaaaaaaaaaaaaaaagcttaacgtcctgacccccggcgacactgtcgtcgttgtccagggttggaagggcggcatgggtaacactaacaccctccgaattgtcaaggccgaccccgagcacctcggcattggccagcttcagtaaagaaaaaagtctcttaggatgaatcaggagtgatggggaattgtttaatgcgcaaattaatgatagacaggtcaatgattgtttccaaggtcagggtactggattacgaataagtcacgtaagaataaacagggcaagaccctttacaccgaaaaaaaaaaaaaaaaaaaggccccta

SEQ ID NO: 58548 - DNA, 877 bp, Triticum aestivum
  unsure (1)..(877): unsure at all n locations
  Clone ID: PAT_TA_58548
gccggccgggtcgggggcgtccagaagctcaaccttcacctcatagcagagacacttgatccagtgaccacaaagcctgtggctatgaacaagttcgactcgagcttcttccccaccgtcccaccgaccaacactttcgacgacgagctggaccttgatcttctcatcgttcctggtggttctggcgcccgaaacccgaacctgcaagctgttactagctatatcgcaaagatgttccccaaggtcaagatcctgatgaccatctgcaccggtgctggtgttgcggccagatcaggtgtcttggatggacacatggcaacgaccaacaagaatgcctgggccacgatgaaggagatggggcctaaagtgaattgggtatcccccgcgcgttatgtcattgacgggaaaatctggtcctcttcaggtgttacttctggtctggatcttatttttgaattcatcgccacgttctggggcaaggagcagtcagagcgtctcgctggcatagctgagcatgtgccgcgcgaagcgactgatgatcccttttcaaagcactacaacatcacacccactgaggcccagccctgccctcaaccatgagcgagcatttcgacaccttgatgcacctatgatggacaaatgagccgccaattacctagcgtgtattgttatacggttggtatggcccggtttgcttttcgtatactacaatatttngttggatgcgctgtggcatcagccgttggaaatcaaagctcatcaatggcagttgtaattctgggctctactcgttttctgccattaaaggaaacagcgtattcgtcaacagactgtgatttttagtaacataatagcaaaaaaaaaaaaaaaaggccct

SEQ ID NO: 58549 - DNA, 527 bp, Triticum aestivum
  Clone ID: PAT_TA_58549
gccggccgggtctcgggagaacaagaagctcatcaagaagctcgctcgcaagtacgatgctttcgtcgcttccgaggctctgatcaagcagatcccccgtctcttgggtcctggtctgtccaaggccggaaagttccctacccccgtttctcacgccgatgatcttaccggacgtatcaacgaggtcaagagcaccatcaagttccagctcaagaaggttctctgcatgggtgtcgccgtcggcaacgtcgagatgagccaggagcagcttgttggtaacatcatgttggccatcaactaccttgtctcccttctcaagaagggctggcagaacgttggaagccttaccatcaaggcttccatgtctccccccaagcgcctgtactaagcgtgtttctttggcctttgcctgagatggttcggcaactgagttcgccgaaatgcggaccgtacagcttagactaggatggcaggaaaataaacacaaccgagacaaaccgcaaaaaaaaaaaaaaaaaaggccccta

SEQ ID NO: 58550 - DNA, 234 bp, Triticum aestivum
  Clone ID: PAT_TA_58550
gccggccggtccggcgaggagtgtgttggtactgaggtcgagcccagactggaggtctttggtgtcgccaaggaggcctttggactgtaaattatggaatgggtcgggttgatatctgttgggcagacggagcgtgtttatgcagcatttcttttctacagcctctttcgtaaatagcactcttgtcgattctatttacttttataccaaaaaaaaaaaaaaaaaaggccccta

SEQ ID NO: 58551 - DNA, 443 bp, Triticum aestivum
  Clone ID: PAT_TA_58551
gccggccgggtcgggggagactgcacgttctgggtggctccgttgctacaacgttgttggccgacccgttcagtggcaattcatgaaggacaactgggatgctcatcactaagctcggtaaccccgtcgttgtcgaccgatacatgaacctcagtctgagccgcttcaccgatgtttccgctgttgaggacattgagaagttcatggccgacaaggacaccagcagcttcaaccgtactcttggtaccgtcaaggacaagattcgcggacgtgctgcttaccgcgagcgtgactctgagaagctcaaggagtggctcagcgcccatggatacgcttgactgtgtaaactataaatattgcgaaatgagcggtgactatatcacaagaatttctgattaaataaaagttaaatttctgaaaaaaaaaaaaaaaaaaggccccta

SEQ ID NO: 58552 - DNA, 618 bp, Triticum aestivum
  Clone ID: PAT_TA_58552
gccggccggtccgggtattggacgtgtcgacattgtcgagtcccgattcattggtctcaagagccgaggctgctacgacacccccggtctcaccatcctccgacaggcccacatcgaccttgagggacttgtccttgactccaaggttcgagccatccgtgaccgtcttactcaggactggtctgcctgcatctacaacggcatgtacttcagccctgagcgtgagcttgtcgagcacgccatcaagttctctcagcgccaggttgagggtaaggtgagccttgtcgcctacaagggcaacgcctacgtcgtcggacgatccagcgagacctccaacctctactccgaggacgagagcagcatggacaccctcgacatgaactggactcctcaggacaccaccggctttatcgccatccagggtatccgcctcgagaagtacggcgccaggaagatcaaggacggcgagcctcttgccccttagagttgaagtgggagatgaaaacaaaactcaactcaactcgtattgtacagcagttcattctcgcgtttaaagacataccaaaaataccaatactgttaaattatctagaaaaaaaaaaaaaaaaaaggccccta

SEQ ID NO: 58553 - DNA, 671 bp, Triticum aestivum
  Clone ID: PAT_TA_58553
gggacttgacgtgcgacctcgaattaacaacagcagcaaccgtccaaatggtcaagaacagagagaaaacggccggaacgagaggggccgcggccacgtcagggccatccgatgcaacaactgctcgcgatcagccccaagataaggctaagggattcccatccgcaaaggggtgagtctgctgctgtccgtggcatctccgatgcctggggtctgcccggagtacaccgtccgcaagatgcacctgaagatgcagaactgtgtcgcttgcgccatccacggcaagattgtccgtgaccgagccgttgtcggacgacggaagacggcccctccgcctcgggtccgctacaagaaggacggcaagaagatcgtccctactgcccctaaggcttaaaggagttgatgacttgggatgagagtctgggttagaatagcaggattcaaaagttggaggggatgaatacctttgggattatgagactaaggaaattcctaagatcaactggacgacggttgatggctacccgtccttgactaaaaaaagagaaaaaaagggccccgaaggccgcccgcgctcgaggaacaggaggatcccccgggggtgcgggaattccatatcgaccttatcgaatacggcgaacctccgaagggggggggcccggggaacccaa

SEQ ID NO: 58554 - DNA, 218 bp, Triticum aestivum
  unsure (1)..(218): unsure at all n locations
  Clone ID: PAT_TA_58554
gccggccgggtcgggtatacacactattatctaggtagtacttgaaagctagctcaaagtacgttcattacaagggcctntttggggcaagatatgcaagaacgagatatctgcactctcgttatattatatacggtctcgaggcgtctttggatcgaattagctacaaataaaccactttcgttttaccaacaaaaaaaaaaaaaaaaaggccccta

SEQ ID NO: 58555 - DNA, 367 bp, Triticum aestivum
  Clone ID: PAT_TA_58555
gccggccggttcgggcaggtcagcaaggttttgttggttgttgttgtgctgctacacgctggactgtcgcttgctatcaagatcctcttctttgctcatggcagccccgtgtctagcacaccagacaagagcaagggtgattaagggactggttcagagaatttgattaaaagatatgatgggatggatataagggtttgaatgacacgttagagaatatgtccttggccccaactgtagccacagtgtaaccaaaacggagttttggggaaacatatcgttttggcattgtttgtacaataagttagaaggcgcttttatctgatcactattttacctccaaaaaaaaaaaaaaaaaaggccccta

SEQ ID NO: 58556 - DNA, 315 bp, Triticum aestivum
  Clone ID: PAT_TA_58556
gccggccggttcgggattggtcttccggtaacaagcacgtcgaggagctcgacgaggcccgtgatgagaagaagcgctatgctgatgaggctaatgccactggcattgagctcgagcaccagcgcaagcaagatgcttaaatgtttaaatggttacaagcggaaaattggcctggcggaaaaggtgccaggaccttggtaaatagtcacgaatcctatgaatacgaataagtaaaattttattctttaaaaaaaaaaaaaaaaaaaaaaaaaaaaaaaaaaaaaaaaagaaaaaaaaaaaaaaaaaaggccccta

SEQ ID NO: 58557 - DNA, 280 bp, Triticum aestivum
  Clone ID: PAT_TA_58557
gccggccgggtcgggggcatcgccgccctccggatctgaacttgctgtttcagtgtttcgtcgaggtcaatgaaatgacttacttaatccaacttctcgagaggcctcacaagagttaaagtctttatcactaatgtcaagtgagattacttgatcattcttgcacaagggctcagaccagcaatccattgtttacattcaatacaaatgtctcagtctcatactgttgcaaaaaaaaaaaaaaaaaaaaaaagaaaaaaaaaaaaaaaaaaggccccta

SEQ ID NO: 58558 - DNA, 608 bp, Triticum aestivum
  Clone ID: PAT_TA_58558
gccggcctgttcgggcttagagagctcgaaacatctatactaacaggacttatgaacaccgtatcacctcttttgcgagatcgaaaccgaggccttcaagttgtggattcttgggctattcttacagagacgcgatctgacaagggtcgtcaaggaaaaggaaaaaaatgaaaattattcggccacttattggatttgatagcgtctacgctgggttgcttgcatgtgtcatccaacccacaaggcgtttttgtgccaggacatttaatgatatccaattcttttctcacgcctatttgcctgtttttgttcttctggctgtggctgttttggccattgttttcggtgcattattgacgatggtggtttgatgaacggaggggggaggagtattggttactttgtgcacgttgatgaaagaaaggcgttgctcgctaagatgactgtttttactccaagaggtatgggatgtctcttttttacgcctcgttgacgcgagacttgcatcattgcgcatacgcatatattgccaacttaggtatccagccaagacagtatcggcaaatgtcatgtcgttaagccaaaaaaaaaaaaaaaaaaagccccta

SEQ ID NO: 58559 - DNA, 520 bp, Triticum aestivum
  Clone ID: PAT_TA_58559
ccaaactaccaaaaccaatcccatcccaatcgaaccaccaagaccgcacaaatgcctgccgcgcggagagccgatggtcttacctgcaaccgatacctggacatcgccgcccgcgataggcgggcggcagaagtgaaagacggcgaaagaatcggggccgagcggcgaggggagaaggatctccgatgttccaagaggaagaaggggaaggaaggggagatggcagaagcttggcagggacaggatgccatcggcggcgagagacggcggtaaaaggaatttgacacggatggatgattgcggacgggatagtggaagcatggggcctgagaggggattgctcgaaatgggatgagatggaacttattcaccaagagccggccgatcgcatgaacctgggggccaatggagcataaatggattgctaacaatacagtcaatcaagttcaaaaaaaaaaagaaaaaaggcccgcctaaggccgcggagcgggtctagaaagctagagggatgcccccgggg

SEQ ID NO: 58560 - DNA, 256 bp, Triticum aestivum
  Clone ID: PAT_TA_58560
gccggccggttcggttcggttttgtcgtaacgaagccttgaggcatcactccaccatcagcctcggtcttcctcgcttggtccctgaaaatggcaacggcgtcacaattgccggataccacttcgctcctggtactgttctcagcatcccaatctacactgttcatcatctcaaggaggtgtggggaccggatgcggatgagttcaaaccggagagatgggaggatgtaacgcagcgacagaaacagggcttcatc

SEQ ID NO: 58561 - DNA, 596 bp, Triticum aestivum
  Clone ID: PAT_TA_58561
gccggccgggtcgggaaggaaatcaagccatcagatcatcgtcaatcatcatggcaaagaaggccaaggctcgtctggtgcatgcgcgcctcgtttccatggccatgactggcttcttctataccttcaagcgtcctagaaccgcacccatgatgagcatgttgaaatacgatcccatcgtgcgaaagaaggtcttgttcctcgagaccaaaaagaggaaataaacatccacccaatctcgttcgccgataccttgtcgatacaagactttcgactcctccttctcttgcctgagctagaaacagctcgatagccggctgccatcacgtacgcgccatgtaacactacactaaagagcattgctggagtttgggccccaggatcctcgctctaccgatgcgactcaacatgtacaacatagactacaactatatcctcacgacatggctgcactggcatgccactgaatttaacgatcggaatccaataatgctgtacattctgtatctgtgagctgtgtctaccgattaattacagactacggagcaaatcatcatcccatcctcgtccaaaaaaaaaaaaaaaaaaggccccta

SEQ ID NO: 58562 - DNA, 511 bp, Triticum aestivum
  Clone ID: PAT_TA_58562
gccggccgggtcgggatgctgctgcgaaccttggtctcgatgagcatgctaaccgcatctccaaggccacctacgccgtcattgccgatggcaaggtccgcactcccgacatgggcggcaagtccaccacccacgagttcacccgtgccatccttgacaagctcgagaccgtttaaatgcagcatcttttgtgatatcccccaaaaacaaaacaaaccatgtgtaaccccttttttattttcgtttgtcttgtaccgtgtgatagcgggacaatttggacacatacgcacatcactctgaacccacaccaccattgcctcgatcgaatatacctacgactaggagtctgcggatttaggcgttacaagaggaaggggttggcggcgacgttggagaaaaagcagtggaagacgatatagtggaagagtgaaggagattgtacgtgtaacatgaacttgcgcagtcttgaatatattgtaaagtccaaaaaaaaaaaaaaaaaaggccccta

SEQ ID NO: 58563 - DNA, 301 bp, Triticum aestivum
  Clone ID: PAT_TA_58563
gtgcggcgctcgaggcggccgggtcggggtcatggctgggagctttgatttggatcattaccttctaatgaccgtgtatattcttacaaaagcgaatggacgggcgatagaggctgcacccggatgggcagaggaacagtgatgagtaccaggaagagatagtgatggaaatcatgttggaagtccaggcctgcatcgaagggcccaacagggaccacgttctgtactttttactgtgcaagtaatgattagtaccttttggtttctaaaaaaaaaaaaaaaaaaaaaaaaaaggccccta

SEQ ID NO: 58564 - DNA, 674 bp, Triticum aestivum
  Clone ID: PAT_TA_58564
gccggccgggtcgggctctcgcatccccaccaccaagctccagacgcctcctcctcccccgccgccgccgcacgctccagagaccgcaggcatgggcgtcttcaccttcgtgtgccgcgactccggcgccgagtggtcggccaagcagcacaagggcgagctcgaggcctccgccgccaccccctacgacctgcagcgccagctcgtctccgccgcctgcgccgaggacaagtccggcggcgtccagtcctccttcaccatggtctcccccaagtccgccatcttccaggtggtcattggtggtgcctctgctggtccgatcggtggtggtggtgctgctggtggtgccgcagcatcaggtggagctgccgctgaggcccccaaggctgaggagaagaaggaagaagagaaggaggagagcgaggacgaccttggcttctccctctttgattagatcttctttactctgttgctcgccagaaatgacatggtcctattgccgcagtaattttgatgccatgccccacaggggttgtgaacctgcctagtttgattgtcaagagatgtatgtgctactttctgttcatgtgaggatattggttatggtattctgcagcattgaatatcctacaaaaaaaaaaaaaaaaaagggcccctaaggccgcggccgctct

SEQ ID NO: 58565 - DNA, 439 bp, Triticum aestivum
  Clone ID: PAT_TA_58565
gccggccgggtcgggtcttccgtagtatagtggtcagtatgcaagcttgctacccccgtttctcacgccgatgatcttaccggacgtatcaacgaggtcaagagcaccatcaagttccagctcaagaaggttctctgcatgggtgtcgccgtcggcaacgtcgagatgagccaggagcagcttgttggtaacatcatgttggccatcaactaccttgtctcccttctcaagaagggctggcagaacgttggaagccttaccatcaaggcttccatgtctcccccaagcgcctgtactaagcgtgtttctttggcctttgcctgagatggttcggcaactgagttcgccgaaatgcggaccgtacagcttagactaggatggcaggaaaataaacacaaccgagacaaaccacgaaaaaaaaaaaaaaaaaaggccccta

SEQ ID NO: 58566 - DNA, 465 bp, Triticum aestivum
  Clone ID: PAT_TA_58566
gcggccggccgggacgttttgcacgcttcagcgtgagtcttttacccagcgaatagccaagaaatcaacttcgcctcgctgggcaccacgttcaagaccaacctcgcagagtttccacatactcaactttcaactacaacctcgcgaggctctggtcgcccatactagacaggatccggcgtccggtatggttccaaaaataatatcgacttctcgtatctctcgtccaggatggactttgatcagatacttgatggtcgcaagaattaacggggaggtttgtcggtcgctcttatagatttggcaatgggggaacttatagaggatggcttatgggatatagaatggttgggtagaacttgagttcaaaagcattctttctataatgtttgggaaagaggtttatatgatcattcattagttaatcctttgtatgattaaaaaaaaaaaaaaaaaaggccccta

SEQ ID NO: 58567 - DNA, 641 bp, Triticum aestivum
  Clone ID: PAT_TA_58567
gccggccggttcgggaagaaatctgttcaacctctaaaaatacactaaatggcgatttctatcatttccccagatcaaactcccttgcagatagacaggaacgggattcaagccacagctactggtttcgggttcctccattcctctcgttgaagtggatccagattcaataacgcatggaaatcttcagctttcagcctctaggtcaaagctctagtagcatgaaccgttacagcacatccaaagaagatgcaagaaatagctgtgtatgcttcgccttgctttcaattgctcagcaacccacaaactgttgacgtgtcatgcttcaaatttcatgcctttggtcagggatacggggtgagtgaggtccgtcaggtgcatactaaggcagttaatgaggggtattctaattgtttccaccaaaagcaattgccgttgggccctcatctcaaagatgacatgaattgtacctttggctaggcaggataaggatgtaattgtgggtgcccagctaggtgctttgaggacctaatcctactgcagcgaagaaaagacccaaaggtgcagggtgaaggtttactagcatcacaaacacatgtcttgcaaaaaaaacagaaaaaaaaaaaaaaaaaaggccccta

SEQ ID NO: 58568 - DNA, 476 bp, Triticum aestivum
  Clone ID: PAT_TA_58568
gccggccgggttgggacaaacctctcaacgaccgaccttgaagagacgagccgcagccatgtcgtcgaccaagaagccctccggcaagactcagcgctccgccattgcggatgtcgtcgcccccgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggaaaaaaaaaaaaaaaaaaggccccta

SEQ ID NO: 58569 - DNA, 371 bp, Triticum aestivum
  Clone ID: PAT_TA_58569
gccggccgggttccgcaggtgacgagaatgatttcttcccaatgactgtccgattcaacaagagcacgccatacattgacgtcgacgtcaacaccgcgtctcttctggaggaggatgaggaggtgacattctccaaagaagtcaagtctcatgccgacaacttcttggtcgaatagatggatctcaaaattcttccgtttcgaaacagccttctgggcaaatttactccataaaaggaaagggatatatgtatttgagcagagctggggatagacatgagtagcagtgtcttggcagtctagaacctaatggcgcaacgacaattgatgtttatgtgttttggccaaaaaaaaaaaaaaaaaaggccccta

SEQ ID NO: 58570 - DNA, 562 bp, Triticum aestivum
  Clone ID: PAT_TA_58570
gccggccggtccgggattcctctcattctctcatatcaccacattcgaaatggctgaccatccttctttcactcttgccgcccttttggctgctggcggcactgccggctacatgcgcacgcgctctactccttctctcgtggctggtgccggactgtgagtttcatatgcctatgctggataccttctcaagaacaacaaggactacgtgctctgagcttggcctgccaaacagtgtcctcttaactggatccgccgttccgagaatcatcaagacgtggggtcgagcgcctgctcctatcattctcggtgcactagcaggacttgctacctactactaccacaataaattccgcgagttccgatatggtgtttatgcgaaacttgactcctgcatattgaccaaaggcaccttcaaaatgggacaaggctgatgtactatactgtaccataggatactctaattcatctcagtttagcgagttcagattcttacaccccggcagccaggctcatccccgaagtacctactccaacaaaaaagaaacaaggacccttagat

SEQ ID NO: 58571 - DNA, 188 bp, Triticum aestivum
  unsure (1)..(188): unsure at all n locations
  Clone ID: PAT_TA_58571
gccggccgggtcggganattaatgaagccggcatcgcatcgacatgctggatgtagtagtttggtggggttgagacgatgtctattaaagaggaacacgatcgccttgttctttgcttcttcaactctcaattgacatagtcaatcaaaatgggtcaattacaaaaaaaaaaaaaaaaaaggccccta

SEQ ID NO: 58572 - DNA, 397 bp, Triticum aestivum
  Clone ID: PAT_TA_58572
gccggccggtctcgggttttttctttctgattgattactccggaatgcgatatgatcgcacggtatggggacagcactgcctgtaatgagcccaggcgggaatgatgagttcggaacagattcgggcacaaccccgtactctggcagatcgccagtgaatggggggtgttggaatatgagggcaagcctgagtctggttcttgatgacgatttacgacttaaatttctctcttcttcacttctttcttctcgtgtaagtctctgcttgaccagagagcgcccgagcgggggggggtgtttttgggaatgttgctttactaggtaacgaattatgagggaacaataaaagcatcttttttcgagattacaagaaaaaaaaaaaaaaaaaaggccccta

SEQ ID NO: 58573 - DNA, 735 bp, Triticum aestivum
  Clone ID: PAT_TA_58573
gccggccgtgccgggaatagccgagctcgaatctacgatcggccatctgagggaggcacccggagctgctgaaaggcaagacgcactcagtgcggcgcaaaaacagttgcagatcacggaagacaagctgaaggccgccttgacagatgtggagttcatgagaagccgctatcaggatgttggctctgcagcagcacagttgtccaacgaggtcaatgcattgaagacacagaacgtcgctctagagcagaaggcttcagcgaacctgttggctatccatgcacagcaggcttctggggagaggcaagctatgcagcaggcgattgagaacctacaagcgcaactccagcaaagggacgcagaactgactgcagcgcaccagaaacttaatagttttgcgaatgggcggaacacacgaggaggcagcatgcctcgcagcccccgcgttccgagtggagtgagtccacggcccaacctggcgtatactggttctgctagtagaggaacaagtccttccgggcctggtacacaatttatgagccaacaggctcaaaataccaggtggaaccctattcaatgagaggggttatgatgatcaggaaacaagggagatttgttgggaggagaaagaaggaagaaagcgtcatgatatcatattttgagcctaccgtaatgttagatagatatggcgcatcgaatagttaccaagaaaaaaaaaaaaaaaaaaagccccta

SEQ ID NO: 58574 - DNA, 236 bp, Triticum aestivum
  Clone ID: PAT_TA_58574
gccggccggtccgggatcaacttcaggccacagtcttcaagcgcatcacagtcaaaatggtctccttcacctaccttctcgccgctgtctcggccgtcactggcgccgtcgctgctcccaaccctaccaaggttgatgctcagcctccttccggtcttcttgagaagcgcaccagccctacaactggtgtcaacaaaagagtattaactgaaaaaaaaaaaaaaaaaaggccccta

SEQ ID NO: 58575 - DNA, 440 bp, Triticum aestivum
  Clone ID: PAT_TA_58575
gccggccgggtcgggatcgatagtgagacatcttttgcaacacgccagcaattgacagtcaatttgttcgattcacggtttagaaccaagccagtcaagtctgttcaagcaaaagaccttcaaaatggttaaaagcccgcactcaacttactatgatccccgcctgcgacagggcgctgcgctcgtgcgagcacgaagaccctatcttttcaagaacgccatcactggccttggtctcctaggcgtggttggaagtatctattggtataccctcaacgccgttggccaagacaatttcgaagatgtcaaggttcccgatgcgcccaagcccgccgcttccaagtaaggggatttcttatggtcaggccacgtgtacgatcaataccaagcgttggaatttatgatattcaaatgaaaaaaaaaaaaaaaaaaggccccta

SEQ ID NO: 58576 - DNA, 526 bp, Triticum aestivum
  Clone ID: PAT_TA_58576
gccggccgggtcgggaaaactctgaacccgaacttgtactttcaacataataaacaaagactactaatcttcgcaaaaacatcaaacgccgacacatcattccctgattcagacaagatggtgcacaacatccgaactaaggacgagttccaagacgcgcttaagaactactctgtcgtggttgtcgatttctactctactcatgccgctgagtcaaagaacattgctcccacatttgcccatgcaaacgagcttgacaagttcaaggactttcgatttctcaagatcgacatcgatgatctcaagagtctagcggaggagcttggagtctcaaagcctgcctctttccaaatgtacaagaatggagagaagattaatgacttacagagtgatcagacggaggaccttattcaatttctggaaactggtctgtagaagaaagattgactaattaatgagccacgccatcaattaatacagcatcaataacagacctgccaaaaaaaaaaaaaaaaaaaggccccta

SEQ ID NO: 58577 - DNA, 768 bp, Triticum aestivum
  unsure (1)..(768): unsure at all n locations
  Clone ID: PAT_TA_58577
gccggccgggccggggaattcgctcgatgtctcgatttcattgatcgcggtcgacgaaatggcactgcaacactggtgcactgtcgcgtgggagtatctcgaagcgcaaccatctgtattgctgaagtcatgcgatcgaaggggatgtcatttcctcacgcatactgttacgtcagagcccgtcgtctgaatgtcatcatccaacctcatcttcgctttgcctacgagttattgaagtacgaggaggcgctccagcaggatggtgaccctgacgccgaggttaagagaacattggagtgggctgaaattgcacgagaaattgcccttatgaatcggccatactcccgttgaagcgacatagccagcgcattgtgatccttttcagcagacctctggatcgaccagggcctttttttctaaaccatattcatgcgcatatgaacttctttttaggtgatcttggtttcaaatttattttattcggacgaatcggctcaaaggactgcagggctggacttgcagtcggataggcgcatcgttgatacaaggcatctttgaatgtgtctcaaagggcttccgttcttggcgtttttggcaggcacgtttacttgttttattgtcctagctctggaatatgttnttggcttgtatttgngacaatggggaaaagttcgaatttgtttacatatggcgatgactgatgactaccantggctttggatcgatacatacttctctgnataacgcacatatttcattactcattaa

SEQ ID NO: 58578 - DNA, 772 bp, Triticum aestivum
  Clone ID: PAT_TA_58578
gccggccgggttcgggaaaaaattaaaaaggctaaatcgtagcctgcgtatccgatatttttacttcgagatcagggtagatacgtcaaattcctcaagatggtgctctatttcacctcctccgtcgttgacccgtcgggcttcatttacgtcggcaaggacaagttcgagaatgaggatcttatcaagtttggctgggaagaggatatctggttccacgcggataaactctccagcgcacatatttacctacgaatgaaagagggccagacatgggacgccctccccgaagagctggtcatggacctggcccaattgacaaaggccaactccatcgaaggcaacaagaaggacaacgtcacaatcatctacaccccatggtccaacctcaagaaggacggcagcatggaagttggccaagtcggattcaaggacccccgcaaagtcaagcgcatcctcgtgccccagcgtgagaaccccatcgtcaaccgcctcaacaagacaaaggtggaaaagaaacccgacctgaagcaggaacgcgatgaccgcctcaaggagctgagacgccgcgaccaggctgtcttcctagcaaggaagaaagaggaggccaagcaagcccaggagtggaaggaaaagaagtatcagaaggatcacgcttacgatgacatttttacggaggagctcatggctggctcgagtaacaggaccgcgacgagaactgggaggacgatttcatgtaaactcgccagtggaaagagaacactttattacc

SEQ ID NO: 58579 - DNA, 377 bp, Triticum aestivum
  Clone ID: PAT_TA_58579
gccggccggtccgggaatctctcccacaatcgactcccagtcaccgcctccattgtaaaaacaagaaagaaaccacttgttagataaatcacggtgtctaacaacactctctagttgcgttcgatattgcccttgaagatgggctatccgtgtcaagttttccacgcttcagagcttcctgaacgtgtccagaccaacctcagcggccgcaagcgcaagttgggccaaggagccaagaatgtcgacctaaacggctgtgagctccttgagatgctccagtacaagtgcgagattaaagaacctgtcaagtgggatagtcctgtgcagtgctttgccgttggacggttattcaaaaaaaaaaaaaaaaaaggccccta

SEQ ID NO: 58580 - DNA, 455 bp, Triticum aestivum
  Clone ID: PAT_TA_58580
gccggcccgggtcgggatcctcacctcaaacatcaactactatacaccctttttaaacaacttccttccaccaccaaacatcttcacaatggctggcgactgtggctgctctggtgcctcttcttgcaactgcggctctagctgctcttgctctggctgcggcaaataaacaacttgatctttgatcattcggataccacttgttctaggcccaagcttgggtcaagatacatcctttgacgacgaatcacggacggagttatgaagggcggagttgagatcatgatgtgattgggatatgcgcttggatagttagctacagattaagcttaaatactacccttgtgctgagtaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaagggccccta

SEQ ID NO: 58581 - DNA, 453 bp, Triticum aestivum
  Clone ID: PAT_TA_58581
gccggccgggttcggtgagagcgacgatagcgatgcagagtatgttggaagggaagattcgatcgagacaacttccagtgatggcagtggtgctcagatcgttgtcgaagagtcatctcctgagcctgccaagcccgagactagcaggagaaaccctacccgatcttctacttcgtcctctacatccaagcgaaagccgacaacagcaacatcatccagtgcacgccggaagaaataaagagttatgatactaggacaaagaataccccgggttagaaaagcagtctctattcagtgttgataaattatctacttatttgctcaaaaaaaaaaaaaaaaaaaaaaaaactatgatttaccacacacataatctaactagatactacacacacttacatatgaatgaacatagagcttagttgcttataaaaaaaaaaaaaaaaaaggccccta

SEQ ID NO: 58582 - DNA, 289 bp, Triticum aestivum
  Clone ID: PAT_TA_58582
gccggccgtttcggaaccaatcttcaattgccgacaaaggcgcacgggcaataggatggtcttctatgccacgaaaaatacgatgtatgaaattacacgaagaccgaatccgagaggattacagaagagtttactttgccagtttttgcgtctctgaaacaaggaaacttgtttttaggtacaagattaagacggagaaactaaaaaagaatcatgagttactgttagttatgaaacaaacaaatcaaaacattaaaaacaccaaaaaaaaaaaaaaaaaaggccccta

SEQ ID NO: 58583 - DNA, 712 bp, Triticum aestivum
  unsure (1)..(712): unsure at all n locations
  Clone ID: PAT_TA_58583
gccggccggtccgggattcatattcccactttccagcacggaccctactactccgtatcgcatctccgaattcataactaccaaagataccccgcgattttcttcaacttcaaactttcaacttcacaaacactcttcacaatggccgacacccacacctacgagtttgacattgccatgagctgcggcggctgctctggcgccatcgaccgcgtcttcaagaagcttgacggtgttgagagctacgaggtctccctcgagaaccagtccgccaaggtcatcactgccctcccttacgagaccgtcctccaaaagatcgtcaagaccggaaagaccgtcaagtcaggcaaggcggatggtatcgagcagtcgatcgaggttgctgcttaagcaacagactaaaccgaatagaagcattatacgatanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnaaaannnnnaaaaaaaaanaaaannnnnnnnnnnnnnnaaanaannnaaaaaaaaaaaaaaaaaaagcccccaagggccgggccccctaaaaaaaaaggggacccccggggcccggaaatttcaaataaactttttttcccccccccccccccgggggg

SEQ ID NO: 58584 - DNA, 535 bp, Triticum aestivum
  Clone ID: PAT_TA_58584
gccggccggtccgggatacctaaagcccggtggctggatcgagcacgttgaactctggggtaacgcaatgtctgacgacggaaccatgactgaagactctccactcaaaacatgggttcggatctttgaccaaatcggagaaaagattggcaacccgttcttctgggacccggtcgaggcattccaggaggctggtttgcaaaacataagcgagcgaaaggtcaaggtgcccattggtacttggcctaagaacaaggatctcaagcagtggggcgcctggaaccgacaattcctgatgcaaggactggaagggttttctattcgcggtttgacagagcttctggggtgggaatacgaaaaggcgcaagtctttcttgtcgatatgcgtaaggagttgttgaacccaagcctccattcatacgtcttagtaactgctgtttgcggtcaaaagcctttagaatagaatataaacgcagctcatatcattcaatatccacattttttactataaaaaaaaaaaaaaaaaaggccccta

SEQ ID NO: 58585 - DNA, 483 bp, Triticum aestivum
  unsure (1)..(483): unsure at all n locations
  Clone ID: PAT_TA_58585
gccggccagttcgggatttccagcaactgtttgggtctacccctctgagatcctaccccttcgccttcgacacgtggctcttctatttcgacagcttccaattggattttcaactatatgattgtacaaattactcccgtctcaatcaacaacatnntggctggagaacatacatcatctttgcagtactgaacgctttctttgtccctgttatcttcctgttcttccctgagaccgagggcttggagttggaggatgttgaccaactttttggtggagaggatattgctaaggtcttggataacaagggtgatgggactgtggtcacggtggagtctgtgaaccgagatggagctacctagatgtgcgtctaatcgctaagccccttattgttaagggcttcataaatatctttagtataaataattacatttatgcattcgacatattggaacataaaaaaaaaaaaaaaaaaggccccta

SEQ ID NO: 58586 - DNA, 677 bp, Triticum aestivum
  unsure (1)..(677): unsure at all n locations
  Clone ID: PAT_TA_58586
gccggccggttcggcgacgaagttcatcgccgccacaaaccccacctacacgccctactgatctaggatctagggttagcgcggtgctcacgggaagtaccaccgcctcgccatctctctgtccacatcgccacctacacgccctactgatctaggatctagggttagcgcggtgctcacgggaagtaccaccgcctcgccatctctctgtccacatcgccaccgtcaccacatcaccatggccggcgttggatcgagctcgtctggacagccagaaggaggctttcacttgatgagttgcctaaaagaagttccaacactcagaggtgacaatcacaccgagtggaggaagaaagtagaactggcatttgtttgtgctgatctggactgggttgtggatgaacaatagccggtcagacctatagagccagtaagagaggccactgatgatgatgttgcgtgggctaaaaagaggggggattatgctcctttggagatgtcatacatcatagaaaatcaaaagtgggtcaatgcaaacaaaaagtgcatgacatttataaagaatacaattgagagcaccattgtgggctccattgcagagtgcaaaannnnnnnnnnnnnnnnnnnnnnnnnnnnnnnnnnnnnnnnngaanaaaanaaaaaaaaaaggcccccta

SEQ ID NO: 58587 - DNA, 293 bp, Triticum aestivum
  Clone ID: PAT_TA_58587
gccggccgggtcgggatgatctacctcttgtcgtcctgatagtgcaagtatatatgtcatgttaattattcggattttcatgactctttactgagaaagggcgaactgtcacaagacttgatggactgtagtctgatgagagaacgtttcacatgacttgttcgccattactgtattagctctactgaacagtggacagtgaatactcgtgaatcgtcaattccatatgaatccgccacaacatacactttatcatgctgtttttgcaaaaaaaaaaaaaaaaaaggccccta

SEQ ID NO: 58588 - DNA, 851 bp, Triticum aestivum
  unsure (1)..(851): unsure at all n locations
  Clone ID: PAT_TA_58588
gccggccggtccgggagctttacgtcacaaggaccgagctatcacgaagaagattgtgcagcatgctgagaagcgtggctgtaagggtctctttatcacagttgatgcccctcaacttggtcgacgtgagaaggatatgcgatccaagttcactgaccctggctctcatgtccaggagggtaccgacacagataacagccagggcgcggcgcgagccatttcgacttttatcgaccctgctctgagctggaaggatatcgcttggttccagagcatcacctccatgccaattatcctcaagggtgttcagcgcgttgaggatgttctcaaggctattgactacggttgccagggtgtcgtgctatccaaccacggtggccgacagctcgagtttgcgcgatctgctattgaagttcttgccgagactatgcccattctccgtgagcgcggtcttgaaaacaagatcgagatcttcatcgacggtggtatccgacgtggaactgatatcctcaaggcgctctgcctcggcgcccgtggtgttggtatcggacgacctttcctctacgccatgagcacatatggcgaagctggtgtcatccgagctatgcagcttctcaaggatgagctcgagatgaacatgcgacttatcggcgcgagcaagattgaagacctacaccctggtatgctcgatctccgaagtctgttccagcacggtgctgtgccttcggacaacctgtcgtctactgtgtacgaccctctggctgtgcctgcgcagagacccaagggctggnctgaacagggtgccccaaggctaagctgtagaaagtcgcacttgatctagaatctgctgt

SEQ ID NO: 58589 - DNA, 486 bp, Triticum aestivum
  Clone ID: PAT_TA_58589
gccggccgggtcgggactccattctaaccgattgaaacttgcttcaaatcacatatcgtcaatacaacatccaactacaatggaacgtccctcctcaagctcagacacagcctctatcctctcagggtcaaccgtcttctccaaagaagcccaaatttcagtctcagtctcagactcaccgacaaaagccgagatagacaccttgacgagcgacgcttcaaagcagcaacgcaagagcatgcggcagcgagtccgcaacgtcgtcgctgatctcggacgtccaccaactacaagagatgatttgaagagcggcaatgcgacacaaaagtatgtcgatgttgggcctgcttctggtacggttctgatgggctcgacgactgtttgagataggggaaaacagatggacgggagtttggattcttaaatcaatgatgataatgcaatatgatacctttactataaaaaaaaaaaaaaaaaaggccccta

SEQ ID NO: 58590 - DNA, 527 bp, Triticum aestivum
  Clone ID: PAT_TA_58590
gccggccgcttcgccaatctagaaattacgtttcaccctcactgcaagaatacgatgtcctcttgatccactacggctaccactgatatctccctcgaagacgactctgcctataacgacgcctcccacatcattgcacggcgaggcgaaaagatacgcaaagcagaggatcaaccttggaaagctgcttataaagctgcaccgcgactagatgcccccatctcaccatgctgtctacactacaaaccactgcaccagagagagcacctccacgcggtgacaaggacgcattgcgaaggttaagtggagaggggcatatttcgtgactgcatgcgacttgcaaatgatgcttatgcgcagcctgtatacctgatatcctgaatatattttgtccctactcaaggaagacatgagaacggaattcgttactatcgtggttacatgccgccatgaaaagccgctattggaattgataaacctcgacgaaacttgtacgaaaaaccaactatcgcgcctatggcccacta

SEQ ID NO: 58591 - DNA, 667 bp, Triticum aestivum
  Clone ID: PAT_TA_58591
gccggccgcgtcgccgaactctcactttataatgacttgtttactcacatcttacaaaatgacttctcggaacgcgaacattgacgatgaagacctcactgcacacgcatgctgcgcgcccatccagaacctagcttcgagccgcgtgatttcaagagaactacatgaggacaagcgacctttctttcactgtcccatctttggcccgctgtcacctgataatgaaagcagtgatgcgcgtgaacattgcgccaacgagagaacgtttctctcatatcttcccctgtcggtttatatggccatcgtatcggagaccatcaccctgtctttccatctcaagagtgaggcctcaccgttataactacccatggcaaagccactgggcacgatattctgggcgctttccgacatgacactctttgcagggatggcaaattacataagaacggacaacaagaacagcaagcgagcactcattgtacagattggttggaacaccatgcagtattcagtctcactacaggatccatcatacgaacatgtatcatcctgatggatgtcgccaaggtccgtgactcatcgcccaattcttaacatacacgtattttttagctgggaaacttcccactctgtaccaagacataattcatacccggaatagcgcctt

SEQ ID NO: 58592 - DNA, 436 bp, Triticum aestivum
  Clone ID: PAT_TA_58592
gccggccgcttcgccattctacagctattcactcccccacaatctcaacacttttttataaccttatcgataccgtcttcaccaacatcttcacctgtctccctgctcttgatgtagccacgccttagcttcttgcaccggccactgctcttgatgcaagcactagatgcattattatccaaacctgactacacttgcttgacatcactcccccttgacactgctgcatcaatagtacattatgaccacgcctctggatcttcctctcatcaagcaagtcagacagacatgtgaatggacataatgaaagaatatgtgataacatgcgcataaatatctgcgacgaccacttcttctatgtaaccgcaaggtagataccaaattgaaccttgcttacattgaagaataaaccgagataggcccctatggtcgccca

SEQ ID NO: 58593 - DNA, 422 bp, Triticum aestivum
  Clone ID: PAT_TA_58593
gccggccgggtcgggtcgggtttctcaagaccatcgaaaacgagcaaacagcgctggcgtgtgaagcagagcgagctctcatgagagcgctcgaaggcggttgcagtgttcccattggtgtcgagacaaagtggatcgacgacaagttacgaatgaaggctacagttgtttccctccgaggtgacgagggcgtcgattgtgagatagcagaagccatcaagacgcacgacgaggcggacaagtttggaaaaaaggtggcagagacgttggtggaacaaggagcgcaaaagattttggatgccatcaatgagacccgacaggtgccggagacagtcaaatgagtgatgatagatcagtagatggtcatgaattaacccaaatataccccggtatgacaaaaaaaaaaaaaaaaaaggccccta

SEQ ID NO: 58594 - DNA, 697 bp, Triticum aestivum
  Clone ID: PAT_TA_58594
gccggccggttcggggatgctattattgagcagcacatggccgacatggtcttcgtttgacccgtattcttcgagagaagggcaagctcgacgagaaaatgcttccagccgccgcactcatgaagaaaggcgacgtgcagggcaaaatgctcgcgatgcagatggctggtatagtggatgtgcaagaagtccccaaggatagtagtcggcttgccaaccgcaccttgctcttctggtactttgataaggaacgagcccaaacacaggcgctggacgatatctacaaggccatgctccggtgcttgcagacactcgaagttgaacgtcacaaggagcgaaacattctttcttttgtggagagaaaggatgtgcagggcaaggaggaggaagtgatgacagcggagcactacaacaagtacaacacgcatctggaggttcagaataagctcctcgggcaattaatgcggttagatgagttggtatccgtgcttcgtgactactgaaaaggctggaaagtcttctcatatccttgcttatgtctagcccgagactggtggtttggcatgaatatcggcgttagggtgggaggttttggcctgtatctctataaccatctttttgagcaaaccatacattaaaaaaaagaaaaaaaagccgacatattactttatgaaaaaaaaaaaaaaaaaggccccta

SEQ ID NO: 58595 - DNA, 345 bp, Triticum aestivum
  Clone ID: PAT_TA_58595
gccggccggtttccaaataccacgagctcccaggcaccttccacttcctgtccgccgttcccgggctcggagacaccgttctccggacacttttcggttgatcgaccaataccagacaagttagtttttagtccaagaaaacgtggagaagtgtttggcctttagctagcttggcgtacgaggcaaactggcgaagtgcaggacagtatgtctatttcttgattaatttatactactgtacatgggaacatgaggcagcatgtagattttgtatttcatactccttttttcattcgtttgtaatcaaaactatgctgacaaaaaaaaaaaaaaaaaaggccccta

SEQ ID NO: 58596 - DNA, 552 bp, Triticum aestivum
  unsure (1)..(552): unsure at all n locations
  Clone ID: PAT_TA_58596
gaaaaaaanaaaaaaaaaaaaaaaaaaaaaaaaaaaccaaaaaaaaacccccatcgaaatcctcagcacttctgccaccctcgaacgctccgcttcttcacccgaacagcttcgcacaaataaatcagtcacaatggccgtccaacccatcatcggtatgcttcgacgaaacctcgtcctaaatcttagcatcgctctcggttctggtttcgtcatggccaacttcttctggtaagggacatcaccgaaagagcgatacgacggcaagataaaaagactcaccattccgacacaggtacggtttccacatgccccgaaccaacgcccgcgacaactactacatcaagctcgaggaggaacgagctgctcaaaagaacgagtaaagcaaagacatgccgagtcgaaatcgcatcacccaaagcaagggcatgggggagacaggaagtgcacatagaggccactagccaatgtttcgtttgtcgggtagctgggtacaaagcaaaataccaccgaggcttcatccgctaaaaaaaaaaaaaaaaaaggccccta

SEQ ID NO: 58597 - DNA, 481 bp, Triticum aestivum
  Clone ID: PAT_TA_58597
gccggccggttcgggcgatgctctgaagcagggcaacgccaccgagctcttcaagcgcgccaagtccgctgtcgactccggtgaccttggcgatctggagaagtacgtcaaggacgccacagaaaaggtcaagtccaagggaaatgagctcgccggcggctgggtcgacattagagaagtacatcaaggagatacccaacggcggagagattatggaaaagctccagcagctgagcgaggttgccgacaagcacaaggaggagggcgagaagctcttcaaggagaccgtcgaggagctacgacaggtgttggagaagaagtccgaaaaggctcaggagattgctggcgaggccaagaaggacgccaagaaggaggccaaataaaggcacagaactgtactctactatgaattccataatgatatcctaataattgatcaaaagttgaacaactacaaaaaaaaaaaaaaaaaaggccccta

SEQ ID NO: 58598 - DNA, 628 bp, Triticum aestivum
  Clone ID: PAT_TA_58598
gccggccgggttccgaatattcctcaccaccaacaatcaactccatcttccaacaacatcctccaacactttcaacacttttccactctcccaaaaccaacttcatcatacaaaatgcagttctctactctcaccactgtcttcgccctcgtcgccgctgccgtcgctgctccccacagcagcggaggcaacaaccccgtctgctctgctcagaacaaccaggtctgctgtgacggtatcctcaactgtcctatccaggttctcggcagcaactgcaatggcaattcttactgctgcaagactgacgcccctgttgtaagtttcactcacacactctacaaacgattagtttctaactttctcagggctctttcatcaacgttgctctcctcaactgtgtcaagttcctctagaggaccagttgcattagcagctcgcagctctctctctgagtgctaggatgtgcaggatgggttgattggttggataatgggaacatggtgtggaggatactgacggggaaggcctctgctagctactccgtgtcaatagggtcttcacttctactataacttggctcgacttatatactattatttccgaaaaaaaaaaaaaaaaaaggccccta

SEQ ID NO: 58599 - DNA, 260 bp, Triticum aestivum
  Clone ID: PAT_TA_58599
gccggccggttcggcttcaagaagcttgacggtgttgagagctacgaggtctccctcgagaaccagtccgccaaggtcatcactgccctcccttacgagaccgtcctccaaaagatcgtcaagaccggaaagaccgtcaagtcaggcaaggcggatggtatcgagcagtcgatcgaggtcgctgcttaagcaacagactaaaccgaatagaagcattatacgatcaattattccaaaaaaaaaaaaaaaaaaggccccta

SEQ ID NO: 58600 - DNA, 854 bp, Triticum aestivum
  unsure (1)..(854): unsure at all n locations
  Clone ID: PAT_TA_58600
gccggccgggtcgggagcctggttaggtcttcagtctccgtacaaactttgcctgttacagagatgcgtttcagtattcttcccaccgtggccttggccctttacatggcctggttgcagccaaccctgtgccgtaagttcgtcagttgtaaatatctgaaagattattgttgacaatttgacgatagggagctcgagtctcgacagacttctggcctggacgccgccatgaaagccgccggcaagaagtactttggcacagcgctgacagtccgcaatgacgctggagagactaacgttctcaacaccaagggtgaatttgggtccatcactcccgagaacgctatgaagtgggaggctatccagcctaaccgtggccagttcaactggggtccggccgatcagcatgccaacgcggctacgcagcgaggcatggagcttcgatgccacactttagtctggcacagccagcttccctcttgggtggctaatggtaactggaacaaccaaactctacagcaggttatgaaggaccacatcaatgctgttatgggtcgatacaaggggaagtgccccactgngatgttgtcaatgaggctctcaatgaggacggaacttaccgtgacagtgtcttctaccgtgtcatcggcgaggcattcatccccattgctttccgcatggctctggctgcagaccctaccaccaagctctactacaacgactacnacctcgnagtatggtgggtgccaagactgcaggcgctatccgcatcaccaagctttatcagtcctacggccttcgnncatctgacgtggttggtctgcaggctcacatgaccagcgagagcactctac

SEQ ID NO: 58601 - DNA, 423 bp, Triticum aestivum
  Clone ID: PAT_TA_58601
gccggccgggtcgggaaaaccacactaaagcaggtagggtcccttggttggttactctgcttctacagcacctgttatggagaaagaagcgcacagacttattacagaggagctatgaaacatatttgagtgggtctatttccttcattgtgctgcatcgatctgggggcttcatacagtttgaggacttcacagtggatgtcaaattgcaggagccactctaattgtagggatgtatgactcttattttagtgtccgcctgcatgttcatctttgctggaagaaactctgttctcagctgtgctcttctcctatgctaaggggtggtcgcaggttgtagtgcattttcttatgttcactttagcctagtgcatttttgtgcggaatttacgttcataaaaaaaaaaaaaaaaaaggccccta

SEQ ID NO: 58602 - DNA, 595 bp, Triticum aestivum
  Clone ID: PAT_TA_58602
gctcaggccggccggttctgggactggtgtcatctacacgtcaccaagtccgctgtcggtgtcatcatctacaagcaggtcaagcaccgatacatcgagaagcgaatcaacgtccgaatcgaccacatctcgcagtcccgatctcgtgaggacttcctcaagcgagtcaaggctaacgccgaggccaagcgtgaggccaaggccaccggaaccgttgtccaggtcaagcgtcagccccttggacctcgtggcgcccacacactgtcgctctccgagaacccccccatgaccgttacccctcttgcctacgagaccacgatctaaaagaaaagatattgcgggggttggtggtgcttgcttctatttatttggggtattgcgtccggatgggaaagaattctgcatggcaagggcttgccttttgatgtctgtacggcataggaccagaaaaaagacatcgtttgaagcatccccttctctgtattagaagatacctctggtgaattgtgaccggcccatatagaaggcccggtgatgacttggcgtaaaatgaactgacgcttctcccgaaaaaaaaaaaaaaaaaaggccccta

SEQ ID NO: 58603 - DNA, 391 bp, Triticum aestivum
  Clone ID: PAT_TA_58603
gtggcggccgcttcgaaggccggcccggttctggaacttcacatcatcatactggaatgatcaaccactccaacctcactcgtctccgacccgtcaaccagcgcaaggcggccaagatgatccgccgagttcaaggaatgggtatctaccccagcgtgcacgcccaccccgaaatgctccgtgaggatttcttctcgcgcaacaagtatgatcagccgtaaataaaggaaaaagaaaaagcgaaaaacgacttgttcatgcgctggtgttctggtgaatgggatgtatgtcatgatcattatttttgtggacttatgtataacagcctcaaacctctatgtaacatattgatacagttgtcaacaaaaaaaaaaaaaaaaaaggcccctat

SEQ ID NO: 58604 - DNA, 737 bp, Triticum aestivum
  Clone ID: PAT_TA_58604
ggccgcttccgaggccggcccggtctcgggaaaaaaaaaaaaaagtaacccagcacactctcccagcagctctcgatcgcctcgaccttttattttcgcatcgacagtcgactaacaacttgaagcaaaaatggctggaggcaaaccccgtggtcttaacgccgcccgtaagctgcgaacaaaccgaaaggaccagaaatgggccgatctcgcctacaagaagcgtgccctcggtaccgcttataagtcctctcctttcggtggttcttcgcacacgaagggcatcgtcctcgagaaggtcggtgtcgaggccaagcagcccaactccgctatccgaaagtgtgtccgtgttcaactcatcaagaacggaaagaaggtcactgccttcgtccccaatgacggttgcttgaacttcgtggatgagaacgatgaggtcctcctggctggtttcggtcgcaagggcaaggccaagggtgatattcccggtgtgcgattcaaggtcgtcaaggtctccggtgtcggtctgcttgctctgtggaaggagaagaaggagaagccccgttcttaagcgaagagcgcgtggatggaaacaaagtcatatttcgacacgtggagtctattcggattgcttgcatcgacattacggttagggatctgatcatggggagacgggtctgcaaaaggaaaatagatcacaaagtcttcgacgaacgaaaaaaaaaaaaaaaaagccccta

SEQ ID NO: 58605 - DNA, 488 bp, Triticum aestivum
  Clone ID: PAT_TA_58605
gccggccggttttcgggaaaaaaaaaaaaaaaaaaaaaacaacgacaccttgtctcacgaaagcgtctagaactcccgcccccgaaactacggcaagggctctcgcagctgccgtgtctgcaagcacaaggccggtctcatccgaaagtacgacctcaacctgtgccgtcagtgcttccgtgagaaggccaaggacatcggtttcaacaagtaccgataaacgatccaccatcatgacacccggttttctcgtttaagggatggggggaactgctagagagcagagtattatgtggaagggggtgaactctcagcagaaagtcaaaggcctcgcgttaaaaaagcactcggagggcggccgcttggaacaggagttttatggcttgcttgggtccctcaggaagatcgtgcgtctgacgaacatcctccgaggatagacgaataccattgcattggacctcgaaaaaaaaaaaaaaaaaaggccccta

SEQ ID NO: 58606 - DNA, 467 bp, Triticum aestivum
  Clone ID: PAT_TA_58606
gccggccgggtcgggtctgggaacaggttggtgcttccggcgaggaggtcacagaaaccctccaattgagtggcatggagagcatcgcagatgctacggagcaacttacaaaggctttgtctctgcagccgctggagggtaccgacgtgcccgtcaaccagaccactcacacactcaagcttctgggcaagacagttggcggaggccgcgtggttgccaacgtcaggatggctttctcatcaaaaacaggtgtcacgacaaagatcacggtgcgaagcgaggaggagaatgtggctgccctagttatcgcgtcagtcgcttaaagatgagaagcaaagccggcgttgaaaggataatgatgtatcgaaagctttgtctcgggttttagaacaccttacgagtgtggcgagtaatgtgattatttacgattcatttcccttgaaaaaaaaaaaaaaaaaaggccccta

SEQ ID NO: 58607 - DNA, 670 bp, Triticum aestivum
  Clone ID: PAT_TA_58607
gccggccgggtcgcgaatcaaatcacacaactcatactcgcctgatcgaccgccttatagactgctcacggcagcccctgttctcgacaattcgtccctactccgacgacaacctcatacccgccatgtccgaagcctacgagcgagagcgccagaacaatgcgcgcctcgacgaactatccgccaaagtctctgctcttcgtggagtgacagtcgacatttacgataatgcccgagcccaagatgtcattgacaacacctctgatactttctcctccatgaccacacagatgaagggctctgccggtcgcttgactcgcatgggcgcatctggcaaccgtgttgcgatccttaaattgtcgggaatcgtaattggcgttttcttggtgttgttctacggtgcaaaactgattttctaagacttgggagcgcaggcgtctactatgaatttgagaagtgctataatgattagagcggaaatggggtgcctgtcatttttgctgtgtacggccaggaaaatacgactggagggtatcccagacatccaagtgtccacaaccaggaagctagagagttatcccttaggaagtttactgtttcggcagcgttgggtcggcgttacttgaatacattcacatcgctacaaaaaaaaaaaaaaaaaaggccccta

SEQ ID NO: 58608 - DNA, 164 bp, Triticum aestivum
  Clone ID: PAT_TA_58608
gtgcggtcgctcgaggtcggccgtgtcgcggaaatggaatgatttcaccggataacgacaacaaaactttcccggagtctctcctaactgtgtatatgaatcccatgaaacctgaatccaattacgacatctacccagaaaaaaaaaaaaaaaaaagggcccta

SEQ ID NO: 58609 - DNA, 574 bp, Triticum aestivum
  Clone ID: PAT_TA_58609
gccggccgggtcgggtactgcctagataccaccagcgagattcctatcattaaattttttcgtccgtgaaaaaaaaaaaaaaaaaaaaaaaaaaaaaaaaaaaaaaaaaaaaaaaaaaaaaaaaaaaaaaaaatccacgccggccccatggcgagccccaaatctttcccaaccaaacaaaaacttgccaaggggcaaaaacaaaacccccctgggccccaggggattcccccctgaaatgggaaaaccatccgctacaacgccaagggaagggactggggcaaaacccccatcgggatctaagctactccttcccaaccggtggccccccccaaaacccgaatttttctcccttgggcatgggatccccatgttaaaggaaaggatggattgatttgttatggggggaactatgggacccggttgttaacgtacccccgggcaccccgggggggaagggcccgatgcctggtttatccattatcccggttactggatggcccggacggtcatagggaaaaaggaatggaaaaatatgatgccccccaaaaaaaaaaaaaaaaaaggcccccaa

SEQ ID NO: 58610 - DNA, 888 bp, Triticum aestivum
  unsure (1)..(888): unsure at all n locations
  Clone ID: PAT_TA_58610
cctgtgcgggcgctcgaggcggcgttcgggacgaccgcaaaatggcttccgtgtcacggatacctcatattttagagccatatctcgctcttccctcagaaggctcactcaatcttgtcacaagcgtactcggcgcaagttcaaattggttgctcttacggcatgtgtactcatacctgagaggaagcacagatggcgatgagagcaccaaagacacaggcgtggtgctggttagttttatgagagatggcgctttctggagagagggatctacgaaactgggattggatctagatgcccacagcagaacaggacgcttcactttcgtagatggactcacaggaacttacggtgacagcaaaccccaaactccaggcgcacgcaaagagagagtactacgaggtacaaaccttgcggatatcaagaaggaaatcgaaggcgccattggggacttgaaagcctcgcgcaaagttctcatcatcgatcagctcgatgccctgcttgctatcactgatgagtcaactacaagcctcacactacaaaacctcgttctcggtctccgcagtcttgttcacagtactcttctcacactctctgccgacacacccctggttgctgcccaagctactactctcgaacgagagcatgccagccttgtgctctcaacagctcatgtggctgacgcagttttggcactgcgtatgttggacacaggaacagcgagggacgtcagcggtgtcgttcgtattacaggacctggtatcgagnggaatgggaggtgccgncgagtatnctgtacatgttgttgcggatggcggagttaagtcttcgagagggggacatgaaatttaatacgagaaatacgaatacacgnnatacatagatctg

SEQ ID NO: 58611 - DNA, 482 bp, Triticum aestivum
  Clone ID: PAT_TA_58611
gccggccgggttcggacgaagcacaattggccacgaccatcacccacaacccggatccagatcttgttccagtagcatcttcttctccgccggctcaccagggaaggggagaaccctgccgtcgatcgagccgattctgtcatcacgtgatggctcgcgcggcgaacgtcgacgtgcccgctgccggcgcggcgcagggcggagcgagcatggcggaggggttggcggccgtggccggcgacggcaggagggtcgaccaggccgtggcctacctgctcatggccgccgcgctcgccgtcacctacctcgtgcactgatcgaccggtcggtcgacggacggcggctaggagagttcatattcgtgtcgcttcatctttgtataaatctttagcgaggggaaaactaaagagatgcttgctacagtaaaaaaaaaaaaaaaaaaaaaaaaaaaaaaataaaaaaaaaaaaaaaaaaggccccta

SEQ ID NO: 58612 - DNA, 629 bp, Triticum aestivum
  Clone ID: PAT_TA_58612
gccggccgggctccggacattggtggtcacttctggcgagactattgttcccctcttcagcaaggcctctccttcagttcagatccccgacgacaagtacgatgctctcgtaaaccgcattcagttcggcggtgacgaagttgtcaaggccaaggacggtgctggttccgccaccctgtccatggcctatgccggtttccgattcgccgagaaggttctccgtgccgtcaagggcgagaagggccttgttgagcccagctacgtctaccttcccggtgttcccggaggcgaggccattgctaaggaaactggctgcgacttcttctctgtccccatcgagcttggccccaacggtgctgagaaggccaccaaccccttcgagggcattaccgagaaggagaaggctctgctagccaaggccaccgagggcctcaagggcaacatcaccaagggtgtcagctttgtccacaaccctccccaaaagtgaatatcccctatttgtcatcttttaatacccagtaagaggcttccaaaaggaggcaaggacactccaggatgcccatagctatggcaatagacatagtaatatgagacatgaacacgaaaaaaaaaaaaaaaaaaggccccta

SEQ ID NO: 58613 - DNA, 214 bp, Triticum aestivum
  Clone ID: PAT_TA_58613
ggccgcttcgaggcccggcccggttccgggaaaaaaaaaaaaaaaaaaaaaaaaaaagtcaggatagcaagttgatattggtttgagattgcttaccacaattaatgattgtgtggtatatatgtacatgtatttgtatcttgaacaaagtttataataaaattacacattgtgtgaaagttcagcacaaaaaaaaaaaaaaaaaaggccccta

SEQ ID NO: 58614 - DNA, 152 bp, Triticum aestivum
  Clone ID: PAT_TA_58614
gccggccggttcgggtgcgaaaggagggtgttgagattggcaagcaggacttccttggtcctttcattggccagtacctccagtaaattagggactatgggataaataaaagaaatgatttatggtaaaaaaaaaaaaaaaaaaggccccta

SEQ ID NO: 58615 - DNA, 366 bp, Triticum aestivum
  Clone ID: PAT_TA_58615
gccggccgggtcgggactagagttgaggtaaatggtccggcttgggactcagcttccacgacatggttatatccgtccgaaagccgacactcatgcaatgggaccatatcgcacactagctttttcttatctggttttttttcacgctttacgactcatgttctcacgatttacacggcggcgttcacggtataagcccactttggatttttggtttgcgacttagatggagtatggaggagcccggcggtggaacaggtatacaacactggctcgcttttttgtaattttctttactatacccaagatggtcgttgttgaacgagttcccgataaaagaaaaaaaaaaaaaaaaaaaggccccta

SEQ ID NO: 58616 - DNA, 804 bp, Triticum aestivum
  Clone ID: PAT_TA_58616
gccggccgggttcgggattcaattccatcaacctcatcagcaaaacaacaattctttaacgactgagtagagaacaaccccacgatcaataccaaaccgcccatcatgtcgaccatgcccgcgtcccacggccacagtgaggcctgctgtaacatcccacccgttatcacaaagggatatgaggccaagggaacctacaaggatattggaggctacaagacttatgtcactggccccgtcgatgcgaaaaaggccattgtcgtaatctacgacatctttggctactttgaacaaactcttcagggagctgatattctcgctttcagcgacgctcatcagaagtacaaggtctttatccctgactggttcaagggcggcccatgccccattgagatttacccaccagacaatgatgataagaagaagcaacttggcgagttctttgagacctaccctcctcccaaggttgctggccaagttcccgactatgtcaaggctgtcaaggagcaggacttttccattgagaagtttggcattcttggttactgctggggtggcaaagtcgtcgctctcagtgtcaaggctgactccaaccccttctccattgccgcccaaatccaccccgccatggtcgatgcctctgatgctgagggtctctctgtccctactatgctgctcgcctccatggaagagcccgaggaagagggtcagaagttcgaggacaacctcaaggtggccaagcacgttgagacattcaaggatcagatccatggctggatggctgcccgtgccgatcttaatgac

SEQ ID NO: 58617 - DNA, 481 bp, Triticum aestivum
  Clone ID: PAT_TA_58617
gccggccgggtcgggattccttgcatcttcctctccagttggatgcttaaccctactggcgccaaccttggtggcaagtgtggttacgtctgggccggtaccggtgccttctgtctgctctgcgcttacatctggcttcccgagatgaaggaccgatcctaccgagagatcgacattctcttcaaccgaaaggttcaagcccgcaagtggaagaagactgttgtcgatatccacgacaacgagtaaaggatgtgtttatgtttactacggaggggacaaagggaatcagctcaaggttgggctggagagttttcttgtttcctctgtattctcatgcggctggattacgtggcgtgattttgtaaattgacctgcgtagtcatatagcgataggatggggtttacctgtcatatggccacaaggcttcctaggactatttaattatgtttacctcaaaaaaaaaaaaaaaaaaggccccta

SEQ ID NO: 58618 - DNA, 376 bp, Triticum aestivum
  Clone ID: PAT_TA_58618
gccggccgggttccagacccaaggtaccaacgccgccaggctagaaaatcatctttccttccgtcccatcttcctcttcacctgcatttgccccctcgccttgtgtactctagtcctctctatacagactcaacatccacatatattacatcctcaacgtacctatccatcttcagtcgctcttcatcgttgttcttgtctttgaccaggaggcggggatcagaacaccagaaccccactcgcctggttactcctctctctatttgtccccttcatttctttcagaaaaaaaaaaaaaaaaaaagaaaaagaaaaaaaaaaaaagaaaaaaaaaaaaaaaaaaaaaaaagaaaaaaaaaaaaaaaaaaggccccta

SEQ ID NO: 58619 - DNA, 666 bp, Triticum aestivum
  Clone ID: PAT_TA_58619
gccggccgggtcgggtcaggagaagctatgctacgtgtcgtacgacctcgagctcgacaagcgcctgagcgaggacacgaccgttctcgtcgaggattacactctgccggacggacgtgtgatccgcgtgggcagcgagcgtttcgaggcgcccgagtgcctcttccagccccacctcgtcgacagcgagtcgccgggtctgggcgagtttctgttcaacacgatccaatcggccgacgtggacattcgctcgtcgctgttcaaggcgatcgtgctgtcgggcggaagcagcatgtacccgggtctcccgtcgcgactggagaaggagctcaagcagctgtggctcacgcgggcgctgcagggcaacccggagcggctgagcaagttcaaggtgcggatagaggatcccccgcgacgccgacacatggtgttcctcggtggtgcggtgctggccaacatcatggcggacaaggagagcatgtgggttaccaaggcggagtgggaagaggagggtactagagttcttgagaagctgggaccccgataaggtgagagcaagcgttgcatatgggggagactagtattttgcgttgaaagtttagtgcaaggtagacagcaagaaaagacgttatgaagtacaaaaaaaaaaaaaaaaaaggcccccta

SEQ ID NO: 58620 - DNA, 372 bp, Triticum aestivum
  Clone ID: PAT_TA_58620
tgtgcggcgctcaggcggcggttccagtcgcgagataagcaaaagatgtagaaggatagcacccgctgtcggtgtatcagcaaccagcaacgcgccccaatcccaacctcctatagctgttcaggagggcgattttgtgccaacctcactggacgacatagtaactgaagaacctccccatgttgcagatcccaagtcagacgacgtgcctatactgaataaggcggccgttttggaggctcggaaagacaagccagcagaagagaagccggttgaagagcaagagacacctcctgggcaggaataattcgtggataagaaatcaaacataaggcattataaacgcaaaaaaaaaaaaaaaaaaggccccta

SEQ ID NO: 58621 - DNA, 616 bp, Triticum aestivum
  Clone ID: PAT_TA_58621
gccggccgggtccggacagctttgatataattacaaagaaactttcacttgttgaaagagctagcaaacaaagactaaaaaatggcatccgaatcacgactgtataccttctctggggagtcaaaggaccacctccgcaagtttcgccttactacttcccgagccaagggacctcaagctgttatttacctgatcgataagcacacctacgagatccgacaagacgaagacaagaccgtttatacatctctcgaagaggttggcgatgacctcccagaccatgccccccgcttcatcctcctgagctaccccctcaccatgggtgacggacggctatctgtaccatatgtgctcctcttctacctccccgttacatgcaatgccgagattagaatgctttatgccggcgccaaggagttgatgcgaaacaccgctgaggttggacgaattatcgatattgagacggcagaagagctcgaggagattcctgacaagctcaagtcggagtaggcaaacgaaacaaatgggcagggacatacggtggagcacaaaattcatatatcatgacatacataaaagcgtaaggttgataaaaaaaaaaaaaaaaaggccccta

SEQ ID NO: 58622 - DNA, 607 bp, Triticum aestivum
  Clone ID: PAT_TA_58622
gccggccgggctcgggatcagcaacaacctcactatccactctcatctgtttatccatcacctgaaaacatgctattccaaaacatgctcttcgctgctaccatcggcctcgctgccgcagcctctcaacccacaggccaagaatgtggccgcaaggttgcaccctgctccaaagacgctgtctgcaaacctaccctcgccaactgcaaggacatcaacaagtgccccggaacgtgctactttaagaacgaataccaatcatgcggtggcttccgtgccaagcctccaccaccttgcaagaagaacacacattgtgttgacgaccctcgaacacctggtgactgcggtatggcttgtgacaagccaggtatctgtgcgcccaagaagccacagagttgcggtggattcgcgggcctaagctgtcccaagggcctgtactgttatgacgatcccaaggatgagtgtgatcctaagaagggcggagctgattgtcctggaatttgtctgtgagttttggtgtagtttagcaagcttgtcggggcgtatgtaggacttgattgaatgaagaggttctctatgtgaaaaaaaaaaaaaaaaaaggccccta

SEQ ID NO: 58623 - DNA, 439 bp, Triticum aestivum
  Clone ID: PAT_TA_58623
gccggccggttcggaacttcaccagagcagcaatctattcacatagtcagccatctcataggacaagtatccacgttacttcattacagcatctctcttcgatcacaaacattcaaccccaccatcgcaattatgagactcgcagctattatcgctgccactggtgtcatcttcacggctagtgtcagtggcctcgcctgcaaagacggcatcaaatactgtagctataacctaaacagcggaggtcatttctggactgaagacgagatttggtctcagcttcaatccgagggccttccagatggttataccaagggtcacatacagcatacgcttttcaaatgtcaggaccgctggtattggtccaaggcccacctctattatgtcgagtggtgtgccaacagctgccagaatggtgggggtgggaaggatgatcgtt

SEQ ID NO: 58624 - DNA, 389 bp, Triticum aestivum
  Clone ID: PAT_TA_58624
gccggccgggttcgggattaccggacgcatcaatcaccctctgacgaccatctggctacccgtcaagaaaagactctgcatgaccgccgccacctttaacgccgaaatgaaccagtagcaaattgccgcaaacatcatgttggccatcgactaccttgtctcccttctcaccaccggatgaacaaacgatggaacccttaccatcactgcttccatgtctccccccaatactctgaactaaacgagaatctctgctctttgcctgacatgaacctccaactgatctcgcctatctgtccaccgtacagcttagactactacggcaagaaagtaaacacaaacgacaccaaccgactcaacctcctccctctcggccatacgaacgccct

SEQ ID NO: 58625 - DNA, 417 bp, Triticum aestivum
  Clone ID: PAT_TA_58625
gccggccgggtcgggatcagtatcagtttttgaaaccactcgtcgagactgcacctcttagtttatcaccaaatcaacaccacaaaaatggactctgctggaaaccgatctgtcctgtccaatgacatgcaggagcttcgcaccggaagggaggagatctcccacaagattcagggccacaaggcgaacatgtccaaccctaacaccagcgaggctagcaaggagaatagcaagaaggagattgagtctctgggcggagacgtcaaccactatgggcaggagagcgaccctcgaagcaagagtgctgctgagaacctcgagggcagccgagctgcttaagtaattctattagttgttatgatatccacggaataataatacttgttaatctaaaaaaaaaaaaaaaaaaggccccta

SEQ ID NO: 58626 - DNA, 541 bp, Triticum aestivum
  Clone ID: PAT_TA_58626
gccggccgggtcggggtctaccttcccggtgttcccggaggcgaggccattgctaaggaaactggctgcgacttcttctctgtccccatcgagcttggccccaacggtgctgagaaggccaccaaccccttcgagggcattaccgagaaggagaaggctctgctagccaaggccaccgagggcctcaagggcaacatcaccaagggtgtcagctttgtccataaccctccccaaaagctgtgaaatttcccgggcgattatttacgatagacgtttttgcggttctggcattgaatctgaggaactgttgcaggtatggttggagttctggtcaagggctgatctaagccacggcgatattcaaatcttatatgttcatgacggtcgatagtcggaagatggcgtgtttgtgccccgaattgaaaacaaaaaagggtatcatgatattatagctaagcagatagctctcctagggcttatttggtatggttttaatttgaaacactgctcccgacaaaaaaaaaaaaaaaaaaggccccta

SEQ ID NO: 58627 - DNA, 500 bp, Triticum aestivum
  Clone ID: PAT_TA_58627
gccggccgggtcgggcctttcctctcttacacaccatcctgtctcattcttaagaaatcaactattaattctccttgaccatactacaatggctgcacaacttcgccttcaagattccaaggagaaattccaagctgcgtataacgcagctgtcacccagaaggaaagttcggagaaagactggaaagacgaaaaggaagcgggtatgcacgatcaggaattcgatcaatggtttcctataaatgcacccgcctacgctgttgcttttcaacaataccgaggcgctagagctgcatacgaggccgcacttcacgcagttgatgagcaagctgctaggtcttggcaggaaaaggtcagacaagcggtgattgacaacaagctcaactacaacatattgatcggacctgatgaatgaggtttagacctagataatctacagcaatcatgccataacatgcaaaaaaaaaaaaaaagaaaaaaaaaaaaaaaaaaggccccta

SEQ ID NO: 58628 - DNA, 715 bp, Triticum aestivum
  unsure (1)..(715): unsure at all n locations
  Clone ID: PAT_TA_58628
gccggccgggtccgnactcctcactcgtgagaaactccctctcctctgacctcatctctcgtcaagtaccttgtttctatgcggataccttccaaacctctcaataataactcggtgtctctcctcaaacttcaaactcgtctgtcctacagtctttgccttgtcaggatcggattgcacaacctctctcgcctttctctcatactcatccccaccgcctgtgcctgtagtcagacttaggatatcctcgttcatccgcttaaacgccaacactgcctcatcatgcgccgataaatcttcagagtgcatcagtggcatatagaaccaattgcggtgcgaaaacacccagcggatctctggcgctttgtctggaattccctgcgctatcgccttgagagagacttgcaccgcgagagggtcaaaataagtgaaacacacagaagctttgtcgccgcgatatgagttgcgggggatttgatcgagcaggatgatcagactcaaccagtctagagaatcacggggtttgacgatggatagaagctcttggcctgatgtcacacccgcggtgcgaatggactctagtatagggctgaattgagtgctagaggagttagacgactcgattggaggacggcgagtgattacacacagacgtcgtcgaattgcttgtctgaaacaaccatctcttttggaaaaaaaaaaaaaaaggccccta

SEQ ID NO: 58629 - DNA, 235 bp, Triticum aestivum
  Clone ID: PAT_TA_58629
gccggccgggttccgatacagaaacatccttgcacgctaagtattgctagagtacctggcttaagagggctctatgattccgtcatgcagtgcatgcaagtagtagcatttctagttacatatccattcattaaggggcagtttcagagtctgggcaaggtcttgatagatgccgttaaattgatggattcttcgcaatcacatttggcaaaaaaaaaaaaaaaaaaggccccta

SEQ ID NO: 58630 - DNA, 859 bp, Triticum aestivum
  unsure (1)..(859): unsure at all n locations
  Clone ID: PAT_TA_58630
gccggccgggccgggacagaagcccccaagatggacgagcaggtcgacctcaccaccatccccgtcgaccccgctggcaaggaagactcttccgacgtcaaggatgacaagcccgttactgtcttccatgacaaggacaacttcaacgtcaagcaccctctccagaacaagtggactctttggttcaccaagcccccgagcggaaagggcgacaactggaacgatctcctcaaggaggttatcacgttcgactctgttgaagagttttggggcgtctataacaacgtcacacccgtttccgaactctccctcaagtccgactaccacctttttaaggaaggtgtccgccctgagtgggaggatccccagaacaagcacggtggcaagtggtcttaccagtataaggacaagcgcaacatcgatatcgatcgtctgtggctccaggttatgatgggcgctatcggcgagactcttgagaacgaagatgatggcgaagttatgggagttgttgtcaacgtccgtaaggcattcttccgtatcggcgtctggactcgcaccataggaaagagcattccgggccgaggtgaaggtgatgttgccggcggtaagggccgtagcggagagaagggtaaggagattctcctgtctatcggacgccgcttcaaggaggtcctcgagctgcccgcttccgagcaagttgagttctccggtcacaccgacagtgctcactctggcagcacgagagccaaggccaagcacgtcgtttaagagcgtgcagccgatttacgcgnagggcacgacgttgatttagcacgatatccgataatgaccatttcacgtttctgaaactgacgccgct

SEQ ID NO: 58631 - DNA, 423 bp, Triticum aestivum
  Clone ID: PAT_TA_58631
gccggccgggccgtatgtagaacttgaagtggccagcaaggaccgaatcgaccccgtatctttcaccatcgtcgagagcaatcaccgcgtcattgctggccttgcttacaacgtgctcctccatgaggctgacacgctgtgtctcgacgggtctttcgacacccaaaatgtcgaccaatatacccacaagctcgtcgccggcttcactcttctaagtctaaactgcttctataaaatgcctctattcagattctaccataaatgtgcgctaaaatattccgactctagagacgtcccactccatagacatgctctatgcaccttacacgattgcatatgcttggtgccttaaggatggacattatctcagataaatatatcccgtagataataaaaatcacaatctaggcccctatgtgccat

SEQ ID NO: 58632 - DNA, 814 bp, Triticum aestivum
  unsure (1)..(814): unsure at all n locations
  Clone ID: PAT_TA_58632
gccggccgggttcgggaccatcaacaccaagcacagcatccattcggcctagtatataaatggatggcctcgttgtaatacctccattttctcgttcaagctgccttataggcacttcatgatggcctcctttcattttgcccgccatccagtgcgaacgactgtgtcttttgtcaaagctgcatgtctcgtccatcttggcatcacctacggctataccgtcagtcccgctcagggtccatctatgctaccaacatttactgttgacggtgattggatattgtgcgaccacacacgccgttatggtcgtggtgtttctgtgggtgatttggttgtctaccgcatccccatcttcaacaatcaatggggagtgaagcgcgtgactggcatgccaggggactatgtctctgttggaactccaggcgaacaaggggaagacttgatgattcagatccctgagggtcattgttggatttcaggagataacctcccagcctcaagagattcacgtcactttggccccttgcctttggctctcatctctggcaccacaatcgccaaaatcctcccctggaatgagcgccagtggatgaagactgggttagaaaaggttgatgagctggactgacatccacaatcacattcaccaagtcaagccctgatatgtatgtcatctcttatctgggtatagaaacttacgactgctcgtctaattacatctgctctcgncaaatttaattccccagtaagtgatcaagcggatatccgccgcataaacttcatcaaacaaaatgaaacaaatgtcgtcctcttg

SEQ ID NO: 58633 - DNA, 667 bp, Triticum aestivum
  Clone ID: PAT_TA_58633
gccggccggttttcaaaaatggccctggacaatttatgcttcctatgatgacagggatgcaaggccagaaccaatttatgccgatgcaagctcaacccactggtttccaacaacaatttcctgccacgcagccgatgtacggtgcccccaccggcatcaacagtttcctgccacctgctcttgagccacagcgaactggcatgcctggcatgcttcctcaagcaaccggaatgtcgaacatgggcaacatgggcggcatgaacaacgcgccaaccccccagccccttcaaccacagcaaactggaccacctcctcccgtccgatttggcgtgacgaatgacgctaacaaactggcccctcaagcgacagggcgaagggccaacctgtcgcaagcgaccccccaaaatccttggattctgattcaagaatcgcccgtgacaattggacgttgttggcgcgccattttgtaatctggcgaatactctggacacatctcttcatatcttgtatgcgtgcgtcgacttcattaggcaggatcgccttcgagccgagcgcggaataatagtactatactcatgattgctcctggctaaccaggatcagttcgttctcatatcttaatctataagtctatgcaaaacaaaaaaaaaaaaaaaaaaggccccta

SEQ ID NO: 58634 - DNA, 457 bp, Triticum aestivum
  Clone ID: PAT_TA_58634
gccggcacggttcatccacagccgataagcttaagatgggtgctctgatgggtggaactgttggtgtcatcatgggctttgtctttggaaccgtcaacattttccgatacggtgctggccctaacggcatcatgagaaccctcggccagtacatggccggctccggtgcaacctttggcttcttcatgtccattggcagtgtcattcgatctgatacggatcctaaactgcacgacatgtatatgcgagcccaacgtcgacctataatgctgatggcaaaccccgcatggaggaaatcatgagaccagcaacagatcatacgatacgagagcaatacccagtcgacttcaacgtccaccttgtacagtctggcatctgatggccgcattctgtaaaatatatcaaatctatttcgaaaatggaccaatgccgaaaaaaaaaaaaaaaaaggccccta

SEQ ID NO: 58635 - DNA, 556 bp, Triticum aestivum
  Clone ID: PAT_TA_58635
gtataatatggatcccttcccttatcttcaagaactctcaggactaccacgaaaaggactccctgttatattacacacaagaagcatctccccatcatgaagtacttgtggtatcttcgctgaggacattcgcacctacgaccactcgaccaccactggctactaccacactaacataggatatgagcctcgccccgtgagcgacactctttggtctgatgttgctaacggcttcattatagattacgagagtgaaagctcagggaacagccccaccatatacaacgaatcgagacgacatcatcgatgtgtgtgaatcccccaactgcgaagattgatgaagcctccaatagaatggtcgtgaaaatatcgatcctgctatctacctactctgctctggcttcaacattagaactcaatgccatgaaggccctcactggtggacaacttacggatctcgcgcgtggcaagaaccagatataccactttgacacatctgctagcgcgatggagaagccgacagctaattctctactaattttatgagatgaattac

SEQ ID NO: 58636 - DNA, 255 bp, Triticum aestivum
  Clone ID: PAT_TA_58636
gccggccggccgcattgagctgggatttgactttgggaattacgtcagggtggttgaaccccgcacttgagcggctgatgtggcacacaatgaatattatggtggatgggattatgacaatcagatggtcaggtacaaggcggtgttggatcgaccactatcaaatgctcaccaacacaaagcatcacaacaacattcaaagataaagaaatacagagattcctctgccaaaaaaaaaaaaaaaaaaggccccta

SEQ ID NO: 58637 - DNA, 513 bp, Triticum aestivum
  Clone ID: PAT_TA_58637
caggcggcggtcgggataaggggatggatagtggatgtatgtacatactatgccgtcatttggcatatccttcatcatcagcgacatgacggaagagcagtcgatcaggattatgcctctcgctacttggcactgggcgtggttgagcaaccactaagggcgctgagaagctgtatttgagtttaacatcctcaaggatctggccttggaagagacccgagtcgtcgtcgtcgtcgccgccgcccgcttggacgtgtttcaatcgacgtggtttcttgaggaatttcccgttgttactggatcatattcctttctggaagcatataaaaccgtcaaatgttgattggtttggtatagaacaatggcgtcagtggaaagtggaactatgaggtttaatccacgcgccgaaatcggcaaaaggaatgaagcaacctagaaagaaggaaagaatcttagaactcatgcaatcttgatggattcttattgtaaaaaaaaaaaaaaaaaaggccccta

SEQ ID NO: 58638 - DNA, 680 bp, Triticum aestivum
  Clone ID: PAT_TA_58638
gccggccaggtccggcttccttttgttatcatggctcgtgtcacttacgtgcaccactactaccctgctctttactttgccatcctcaactttggcttccttatcgattggttcacacgcaaccgcaacaacaccatcaagtccatcgtttacggcgtcctgtacaccgttatcattggcctttacatctacttcatccctatttgctggggtatgactggtccccacaaggagtacaagtacatgaagtggttcgacaactggcgagtcaccgactaagcgattaatcaactctgtagatttgaacaatcactttttctcgatcgcatatcgtgtgtgatttagacagaatgccttatggaccaccatataggcctgtttgtattattcggtttcgggaatgttatgcaaggatatagaaatggagggttcatggaaaggataattcgcatgggccggttggcaaagcgaagcatggagaaaagaaaagacgaaacaaagtcggaagagataacacagctacggaatggactttgcgtcggtaatgcaatgtgagtttcatttctggggttcttaatcaaggtggcctatttaagataaggccgacgatgtattatgcattattgtgtacaatccatattgagcttttcgtacaaaaaaaaaaaaaaaaaaggccccta

SEQ ID NO: 58639 - DNA, 559 bp, Triticum aestivum
  unsure (1)..(559): unsure at all n locations
  Clone ID: PAT_TA_58639
gccggccgggtcgganatctaagacaatgaggtcgagagaaacacaaaactcttcccgcttattctctttcaacgcttctttcacaccacaccacagccaccaccaaaaaaaggacggattggggacatggatggaaaaagttattgcttctgctttttggggaggaacgatggagacgcttttccagtcgacggccgctgacgaggttcagaatgtcacctgcttggattgagatatttccagagcagatgaaagacatgtggcaacctgaacagcgagctttgctggaccaaataattttggtgggcgaaaggcagtcgaggctatcatgatactagcctcaattgctgatggagcccgagctgaggtcatcatttctcgttttgtaacaatttgggactatatgggaattacggatgggtggcattttacgtggtgtgagaggtccacaaagggcatacaaagctttgaggcataactatgctagtgataatcaaaatatctggggtttctaagctcctaaaaaaaaaagaaaaaaaaaaaaaaaaaaggccccta

SEQ ID NO: 58640 - DNA, 855 bp, Triticum aestivum
  unsure (1)..(855): unsure at all n locations
  Clone ID: PAT_TA_58640
gccggccggttccggacggtgcgaaacaccgacatgatcaaggatctcgagggccctggcatgagctgcttccctctcgaagtcacagacccaaagagcattgaagcttgcaaaaaccaggtcgccgaactgactggaggtcgtcttgatatcctcgtcaacaatgctggtcgaactcataccatccccgctctggacatggaccttgacgatgtgcgcgccacatacgaagtcaatgtcttcggccccatgtccatggtccaaatctttgcgcccctgctcatagaagcacgtggtctgatcatcaacatctccagcacatcaacccttgtaccctacatcttcggcgccatctactcctcctccaagggcgccatcaacgtctggtcccgcgcgcttcgactcgagctgaagcccttcaacgtgcgcgtcatgaacgctgtcaccggcactgtgcgctccaacattgccagccgcacccacagatctctcccgcagaactccatgtacaagcccatcgaggatttcttccagcagcgcttgacgtttagtcagcgcacggcgactatgccgaccgagatttatgccaagaagcttgttacggcggctttgaagggtgagggctacttgggtggtttgattggagggactccggattggttctatgctggcggtatggctaccaaggtgtggctgttgagttgcttgcctcgatgngtgagtgagactgtcattggaatcttcttcaacattgngagcttgtccaagaggatccaggatgcgcgccggaagttgagttaggctcttggtgtttgatganggattgactgggtcgttccttactacgtgtatgct

SEQ ID NO: 58641 - DNA, 366 bp, Triticum aestivum
  Clone ID: PAT_TA_58641
gccggccggttccggtttatatgacgcatgaatcaaggtatgcctggcatggagtgccaaaagtgctcaaggacacgtgccctgcgtatcttgaagactggccagctcgtgacgatggaaagttctcggaatggcggggatggatgaaaaccaagagaatcaatctgaacgttcgccagatgcgggattgagacatgatcacaagctggaacccgtcaaccaaatgtgttttgcagcgcatcataccgctgtaacgcgggttatcataccgactatattagcctcctacaccttttgctacgctattataccaaatacacaagggcttatactacatttgaaaaaaaaaaaaaaaaaaggccccta

SEQ ID NO: 58642 - DNA, 765 bp, Triticum aestivum
  unsure (1)..(765): unsure at all n locations
  Clone ID: PAT_TA_58642
gccggccgggttccgatcgaaaccttcatggctcgctcctggccgccgtccgtccatccccggccgccgccctggtcatccgggtagccgccccacccgtccgtccccggtcaccgccctgctcatccgggaagacgccccacccgtcggggccgccgccgccctgcacatccccgcctctgctcgccaaatcaaagccttatcgtcgtctccctcgacctccaccgcctgagctcgccatggccacgatggcgtcagcgcacgcgcaccggcagcatggtgggaagcagcaacagtacccaccgctgggcgcatggaggggctaagcctggggtccgcgctccgcatcgacccgcgcgtcgccacgctggccgcggccgcgctcctgctggccacgcttactggcttcgcgctcgcggcgcctctcgtccttctcttcagtcctgtgctcgtgcccgcagcgttggccgtcgcggggctcgccgccgccggcgcgctcngccgtctcgggggcctcagcgctcgtccgggtcgtggggtacgtctagaggggcctatcgcagggcgactacggcggggtgggcgggattgtggtgcagccgttggacagcgggaagcggcacggcggatgggggcgccgggcttcgtcggacatagagttgtggacgacgcacgggacgctctgggcacaccanagcgcgggacgtcgccagcacctagtgctgcacggatgaacgtatgtcgttgcatgcgtttaatttggcg

SEQ ID NO: 58643 - DNA, 795 bp, Triticum aestivum
  unsure (1)..(795): unsure at all n locations
  Clone ID: PAT_TA_58643
gccggccggttccgggcaatatgcaagagttctatgttaggtttaagggaccggctgaaactccattcgaaggcggaacatggaaggtccatgttgagctgcccgacacgtacccttacaagtctccaagcattggatttgtcaatcgcatcttccatcctaacatcgacgagttgtctggctcagtgtgcttggatgtcattaaccaaacttggtcgcccatgtttgatatgatcaacattttcgaggtcttcctcccccaacttctgcgataccccaacccgaccgaccctctcaacggcgaagcagcagccttgctgataagagaacccaagagctacgatgctaaagtcaaagaatacgtccagaaatacgcctctaaggaagccgcagacgaagccggagccgagagcgaagatgacgacgagctatcctcagttgccagctttggcgacgacgacgacgagccagcaggccagatggatgatgtataagtcatcctactcgaagtttgacttgggcgagcgtttcgattcacataatggcgtcatgggatcaatgggcgggctaggagctatcatgggacggagttgcagcagacaccgcgaaggcttggactcggatcgcatttttgtttcgtggtattgggaatgctgcacatttcctcacttgtatcccgcggaggaaagctggacgggatcgtgtactggatgatatgatttggtcatagtgtagcagccggggccgtttataacacttggacaacccgaaaaaaaaaaaaaaaaaggcccctan

SEQ ID NO: 58644 - DNA, 731 bp, Triticum aestivum
  Clone ID: PAT_TA_58644
gccggccgggtcgggaacctgcgcctttgacaagtctcctttattgtaaaactccacatttggtagcatctcactggcaacccatcttgctgtctgggtgtgtagtgagccataaccaaagggttcttgagtcttttcctttctcattctatcgtctccaatgtcaaggtttcccatatcgtcaattaccactctagaagatgatccgcccggaccatcatcccgggggaacgaggagtatccttcgcaaagtgcctggaatacgaccacttggtcttgtagatggacgtctacttgacctccaacttctacctctttacacagacctcggcacagctgttttgacacctgatccgtgaatcgatccctgttctttgtcttcttcggcaaagatcccagccaatcgtgcccccatcgaagtccggatgtggaatgggcgacaaggagtatgtaccagcgtgaatccagccttgatctcataggattcggggtactttcgttgctttggggccttgtatcgtaggctctggccaatcttcaatgggtggaattttaaactgatttgtcctcttgactggggacctatgctccaaccgcgatgttccagtgctctctctacctggatgccgaaccgttcttctagtgttggcaagagtatctgatccagatattcgaaactaagggaaaatgaaacgttagttccgccagaaaaaaaaaaaaaaaagccccta

SEQ ID NO: 58645 - DNA, 421 bp, Triticum aestivum
  Clone ID: PAT_TA_58645
gccggccgggtccggatggtttcgcttatcccgccttctacgagcttcgcgatgatcctcttcatattctcggttttggacttgctcacatttccttggttattattggacttggagtcttcctacctcgttggtacaacattattattccccatgaccgtcgcgaggatggcaagatcccctacgcaccgaatgtactcttggatggtgaggaacctaggaggactgagtccattgagaccggcgaaggtcctggaatatctgaaggtagtgaaagccaagagaagaaacaataagatcggttgtagggtattggagggaaactaagagactaacacgaagaatggggagttagttccctacgagctattgtttatttgaagcatttgtgccggaaaaaaaaaaaaaaaaaaggccccta

SEQ ID NO: 58646 - DNA, 479 bp, Triticum aestivum
  Clone ID: PAT_TA_58646
ccggccggttcggaaacttctctctaccacacaaacctacatcctcaacattcaaaatgggtaacttccacgagagctccaacaacatctggctcgaggacggccacatcctccacgccgagtgcggcaacggcgagggcgactatgtcgagtcaactcttgaccttgactactatatcggtaacgacgatggctctttctcatggggaggcgagaacttctctggctctgcttccaacatcaccctcgacatcgaaggcgatgataacattcccgttctccgcgccgagttgaaccccatggatggtgatcccgtcgaggccaatgtcaacctttccgagcatcggcaacgactgtggcactcttatcttcctcgcttaaactggatagagaacagcacatgtgatgagaagagaggtagcatcaaacaataaacaaagttaaacatttcataaaaaaaaaaaaaaaaaaggccccta

SEQ ID NO: 58647 - DNA, 450 bp, Triticum aestivum
  Clone ID: PAT_TA_58647
gccggccgggtcgggaaaaaatacagccctgggaggcaacagcaagactctcatgtttgtcatggtttcaccactcgaaacacatctgaaggaaacattgacaagtctccgatttgcgacaaaggtgcacaacactcatattggtacggccaaggcgaccaaaaaggtgcgcgattcaacataggccggcctatagacagactctcgattggaactgtcaagaagaagtggataatggagttgtgtgtttttgttgcttttgagttgagtcatcaggatagcgttgaacagggcgtccagaggctgaaatgtctggattgcaggagttgaggagcatatatggttaagagctgtcgcctacggccagtttatgatgtgtttgtgccaggcgagcaagtaaacatgattgattgattgatttctgaaaaaaaaaaaaaaaaaaggccccta

SEQ ID NO: 58648 - DNA, 361 bp, Triticum aestivum
  Clone ID: PAT_TA_58648
gccggccgggccgggacgtctgtatctcttatttccctggtcgtacgaggtcgagaccctctgactgtattgcgctaccaataaattgcatcattgcggctggattcagtgctctgcgtatcgaacagcggctggtttgccgagggctgggcatgtaaaaacaggattgttgctttgtgtgttctgaaacagcttttcagtcttttttggcttgttgggctaggcatttctatgtacccatcttctgtgaaacaacagagctcaaacccgtgtaacaaagcacaatgtaatgtgggttgccctaaagtactccatactatcgtgtatttgagaagaaaaaaaaaaaaaaaaaaggccccta

SEQ ID NO: 58649 - DNA, 533 bp, Triticum aestivum
  Clone ID: PAT_TA_58649
gccggccgggtcgggtgaagaagctcaacaagaacaagaagctcatcaagaagctcgctcgcaagtacgatgctttcgtcgcttccgaggctctgatcaagcagatcccccgtctcttgggtcctggtctgtccaaggccggaaagttccctacccccgtttctcacgccgatgatcttaccggacgtatcaacgaggtcaagagcaccatcaagttccagctcaagaaggttctctgcatgggtgtcgccgtcggcaacgtcgagatgagccaggagcagcttgttggtaacatcatgttggccatcaactaccttgtctcccttctcaagaagggctggcagaacgttggaagccttaccatcaaggcttccatgtctccccccaagcgcctgtactaagcgtgtttctttggcctttgcctgagatggttcggcaactgagttcgccgaaatgcggaccgtacagcttagactaggatggcaggaaaataaacacaaccgagacaaaaaaaaaaaaaaaaaaggccccta

SEQ ID NO: 58650 - DNA, 262 bp, Triticum aestivum
  Clone ID: PAT_TA_58650
gccggccgggtctggaaaatccttggatgtttaaacttaccatcagggttgtgacttgtgagttttgactgacatcaattcttcttgattcctctctggtttgtatctatgtgtgcatttgtcgtttaaagagatgcactttttttgtacagaaataattggcatggtcctatagggaggatattgtttgttgaatattacgttaaataagaaataagtgctgatttggtggcaagaaaaaaaaaaaaaaaaaaggccccta

SEQ ID NO: 58651 - DNA, 279 bp, Triticum aestivum
  Clone ID: PAT_TA_58651
gccggccggtccgggatgaatgggagagcatcaagcttcccggtgaggagagaggttggagtgagtggtcagtcagctctgcgggagaactgtagaggtggcatgacctgacttttcttgggaacactcgttacgttttattgtttgactttgtggtgggtttcgggccggagcattcttttgcatacggttggaaggtagtctataactttatcatggctttgattatatacatgggaaagattgcttttacaaaaaaaaaaaaaaaaaaggccccta

SEQ ID NO: 58652 - DNA, 600 bp, Triticum aestivum
  Clone ID: PAT_TA_58652
gccggccgggtccggcgaggactccatgcctccatcgccccctcaagccatcctcacattcaacgagaaggacgccaagaagcaatcgcaacaacaacaagaagaagattccaactcactctacgcagaggagtactacctgccacctcgcagtcccgcgaggcttgtgtcggccatctcggtctactaaagcaaggggttttactctgactctacgtcttatgaatgaattgtaattttctttagcgacttgtttcacacacaaagcgatatgggcgggcattacactggcgttttttgttatacaaagggataccacgagaaagggattttgggatacagcaaaaaaagcatttttcatatttaaaggatacgacttttacggattttcaccactctactacaactgaaggaataaagaaagacagagaattgtaccaggcaatgaggaattggatataatatcatggttaggtgccgctcccaacagaaggttgagtggtagccgatcagatagatagttcaaaaagagacttacaaagtctaaaaacaaatgataaaaacattcaaaaacaaaaaaaaaaaaaaaaaaggccccta

SEQ ID NO: 58653 - DNA, 531 bp, Triticum aestivum
  Clone ID: PAT_TA_58653
gccggccggtccggatacacatcaccctcttgatgcgattgcggcagtcaagttcaacatgaagcagtgcaaagctatacatggttcttctgctctcaaacaactctttttacattgtgccatcagccgtcctcgcgcctgtatccttccaactgccgcggcatcgtgtgatgcatgttctggccctttgtcacaaactgccaggccagattaatgaagtactgcacgatgacttctcttataagtcctcaaagcaaccaaacgccaaaagtctatccctttaccaacccacatactggagccctcttttttctccgctcacttctttctacccttcttgctcttggcagaaccacccgcagatgcggtagacgcaacactggatgctctggacggagttgcagagctgttcttgctagatttgacagatatgacattgtcaagcgccttgttctacaagttcgttagcaacaaacattagaatagaacaatcaatcagtgacccaaaaaaaaaaaaaaaaaaggccccta

SEQ ID NO: 58654 - DNA, 601 bp, Triticum aestivum
  Clone ID: PAT_TA_58654
gccggccgggtcgggccccgcgagggtgcaggtcttgaggcctttgtcgactctagcgacactggctacaccgtcaacggtgcccctgttgagaacggcaaggccaacgctcaccaagttgccatgaacagcatcgagaacagtaagctccatgcttctggacccgagggcgttgacggcctgcagcaggagtccagcggcagcagcagcagcgacgaggactacgtccttggtaactccaagaccaacggtcaacaggaaaagggtatcctaagcgacgtcaaggagaaggttgtcggtctccagaaccaggtggccaaggcggttactgtccagagccaataactgcattgtagcatgaaggcaaagttttgatatcatgggagcatacaaatacttggggatcatggacattatccactcactatttgggcatatttgttggactggggttcattaacacccttctctgtttttgcgcaaaacatgataccgggtctgagaacgagatgataaatcactcagcatccacggttttactttcgattcaattatacaaacaaggatatttatccgaaaaaaaaaaaaaaaaaggccccta

SEQ ID NO: 58655 - DNA, 281 bp, Triticum aestivum
  Clone ID: PAT_TA_58655
gccggccggtctcgggaacgctcgttctaaaatattgctcttaagccacattaaccttttggatacctttttccattgcttctttcaacctccaatagcataccatccgagctgagaatttagcatatatctatgaactccaccgcgagatcaaggggaagcattacacaggagttacggagttaacacgggaattcatgttagacagaaatctttatcattgatatacaaaatgcaattcgtgtctaccttctgaaaaaaaaaaaaaaaaaaggccccta

SEQ ID NO: 58656 - DNA, 451 bp, Triticum aestivum
  Clone ID: PAT_TA_58656
gccggccgggtccgggagatacttacatatcaacaacttcacaaactcgataccatttaccatatacccctttacctacctcgaaccctacatcctgattaagccgatcagatcccaaatcaagaacaatggaacaacagccaatcaacacccaagaggccactacgcagcctttgaacgaaactcccgtcgttggctctcctcctcaagaccgcagggcaagtgatgcagcgtacgaccgaagaatgagtgatgagtgggacgcatcaaaggtccctcccagccgcttccagaagcgcaagggatccatctatgctacgcccggttcccgtgacggccacgttgacaggaattacgcagacaagtactggaacaagatgaccgagaagaattggggtagtagtagtaaataaactccgaacgagaaaaaaaaaaaaaaaaaaggccccta

SEQ ID NO: 58657 - DNA, 500 bp, Triticum aestivum
  Clone ID: PAT_TA_58657
gccggccgggtcgggtcgacttcgtcaactcccgccagaacactgagcgtcgtctcacccagaacttcgttttcagcactcctcagaccaacgggatccccagccactccaaggcccagtaaataacctctgtattggagttggagttgagggtatgacgtgagcaatctagcattgagttgggcacgttgtttgatatttcaagagatatgtgtacaagaaaacattgtgagaagcgagttagcgcctcgagaaatgacgagtccagattttaggattgatgacgggaaataagacaagatgctgctggtgaaggttctcagctagctggacggatggatggatatagggtttcgctggagaagcggagcatgataaaggatatagatctggaatttttgctctagggttagacaaatgaacggactgtcctatacagatacataatagtatacaacatacattagaacatgcaaaaaaaaaaaaaaaaaaggccccta

SEQ ID NO: 58658 - DNA, 673 bp, Triticum aestivum
  unsure (1)..(673): unsure at all n locations
  Clone ID: PAT_TA_58658
gtgcggcgctcgggccggccnttattaggtgacactatagaaggccggccgggcggaaaaaaaaaattatcttctctcattcacgcaacgtacttttaatatctctctccgtttcttccaccatccaaaatgtccgaccaggttcaagagattctcgaggttccctccgagttcgtcagagacggtgttcaattcatgcgacggtgcactaagcccgaccagaaggagtttctgcgactctgccaagctgttggcgttggtttcctcatcatgggcgccgtcggctacgttgttaagctggtgcacattccccttaaccacgccctcgtcggaagcgcataaacggtcacgcgatacgttgatgagattctggatggcgacttgataatccaaaaacccgcaacacgggaacgaggacaatcacacctttcttgcttgcgggtatgcttaacggggcggagttacatgacattatggcgggcacgcgacacacttctacgctgaaattcgaccgagcgccatgggagatgagaaggaggatgtgctttcacgtccaaggcgctatttgtgtggattgagaaatatccactacgaaaaagacggctacagtgattaattgtacaaatatatccattgttatttctgcaaaaaaaaaaaaaaaaaaaggccccta

SEQ ID NO: 58659 - DNA, 170 bp, Triticum aestivum
  Clone ID: PAT_TA_58659
gccggccggttcgggcatttattctgattggagcagggaactgcgccacagtctggggaagtaccgcggcgccatcatagaccatttgtgtgcaactctaggtgtgttatgagattcttgacaatacacgagcatattaaccgcaaaaaaaaaaaaaaaaaaggccccta

SEQ ID NO: 58660 - DNA, 242 bp, Triticum aestivum
  Clone ID: PAT_TA_58660
gccggccgggttccagatcaaccaaagcagcttcttgcttggatttcgcgcaatattcactaatcacatgatctctacagcattacacgtacttccagatagatagaagttgcaaatttatatcatgcattcaataacaccctctattgacgaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 58661 - DNA, 782 bp, Triticum aestivum
  unsure (1)..(782): unsure at all n locations
  Clone ID: PAT_TA_58661
gccggcctgttctgggttaccagcatctcatctcatctcacacatctcacatcaaccatgttctccaaagccctcactgcccttgcccttgtggcacctcttgtctcagcacagacctttaccagctgcaatcctctcacaaccacatgtcctcctgatcctgctttcggcaaagatactgtccactgtgacttcaccaagggagcttgcccagatttcaaggaagacgccggtacatcaattactcacaacgccaacggtgccgtctttaccattggtggacccaaccaagcccctacaattgccacgggcaagtacatcatgtttggccgtgtcgatatcgaagtccaagcctctaccggtgttggtatcgttaccagcgctgttttgcagtctgactgtctcgacgagattgattgggaatggctaggaggtgacaatgctcaggtccagtccaactactttagcaagggtgatgtgagcacatacaaccgaggagctttccaccctgtcgcaaaccccgtcggtcaattccacgtctactccatcgagtggatacctgcactcattaactggatcatcgacgacgttgtggtccgcacactcacatacgaggatgccaagggtggatctgctttcccccaaacacccatgcagatcaagcttggtacttggtgtgctggatctcccgatgctgctgaaggcactattcaatgngctggtggcctgactgacttcagccaagctcctttcaaggcttactacaagagcatttccatcgt

SEQ ID NO: 58662 - DNA, 497 bp, Triticum aestivum
  Clone ID: PAT_TA_58662
gccggccggtccgggaagatccaactaccagccagaatctcgcctccagcccacgatgcttgcccgagagtactacgagccgccgcgggcggacccaagcctaacatcaccggcttcaacatgcgagcgttccaagcatccaccggccagcctcgatacgatccttgggagcgaaatgaggcctggcgataccagggcccctacactcgttggaaccgtctcaagagcgggttccctggtctcggcatcgcgacagtcgccttcactgcctactgcggctacgagtatttcttcctcgaggacgagcaccaccatggcgaggagcaccactagagtggacatttacggcacatgataaaacgggaagaccttgaacacgttttggttgtggggaagttttgtacatatacctcgtcaagcgagaagggtgttcggccagactacggaacctatcaattaaaagaaatatggaaaaaaaaaaaaaaaaaaggccccta

SEQ ID NO: 58663 - DNA, 847 bp, Triticum aestivum
  Clone ID: PAT_TA_58663
gccggcctggttcgggaaggggcttaccaaactgaatatggatctggctacccacctgagacaacttcgtctccccagcaccagcctcctgcgacaggttctggcaatcaataccgtcaacaaggacttcaagcaccaatgtctgagagtggttacagcgaaggtgagtacgtgattgatgcaaatggcaacttcctgttagatgcccaaggaaataagattcccttcgctgcaccaccttccacttactctggttctgatggtgaagcagaagagtatgcaacacctgccaccaccgtgccaccaagtggtaagcatgattccccttcgacttctactggagaggggagtggtggcaatggtggccagtggacgactggcacgcaattggagcctcaggattataccggtcaagggtatggcactcctggttgggaaacagtccctcgccatcatcaccctacccggctgagcgatgtcatggaagaggaggatgaacgcagccgagctagcacgagccgtgtttaggactcaacgagctcgttttgatataaaaagccgacgtatataccgttctgttcccggtcactaatctaattccaccctaatagcgcacacattcgaagcacgagcgagcacctagcaattgccctttgcgataccaagaagccgacggaacacacaagagttgccagttacagttttctgtcatgtaatatcgtatcactagcagcatatctccaccacgccaacgggtgcactggtacctgggtctgggacctggacattcgactgaaggagtttgatagactaagcctgcatttagaggggtttatcatgttctaaa

SEQ ID NO: 58664 - DNA, 383 bp, Triticum aestivum
  Clone ID: PAT_TA_58664
gccggccggtccgggaaaaaaaaaatatccccagaccagagaccagcttcccccaccgaatacctgccatacgaagcgaccattcattatccgttcgtgtttgatgcctgtggcagcaacaaatacgattttaccttttcgatgtctctgtgagggactaactagtagcaggcctggactttggcgaggagtttcgaggcgaatttggagtttggggtcactgcagcgaacaattttgatgtttgtacaggctgagactggggtttgatattattgttaaagaattagaagaacttagagcacacacctttcagattgcaccgacgtctccagcctaacctacgatttacaaatcacaaaaaaaaaaaaaaaaaaggccccta

SEQ ID NO: 58665 - DNA, 176 bp, Triticum aestivum
  Clone ID: PAT_TA_58665
gccggccgggtcgggtatatgcgtcttcacggctcttgagcgaagcgggaagcggatgctgtttctgagaagagttaatcttcacctataatatatagtatagcccggttgtcatttagtctttaccttctaatacttaatatattggccaaaaaaaaaaaaaaaaaaggccccta

SEQ ID NO: 58666 - DNA, 512 bp, Triticum aestivum
  unsure (1)..(512): unsure at all n locations
  Clone ID: PAT_TA_58666
gcggccgcttcgaggnccggcccgggtctgggaatccaacacacaaacatccatatcattccatcccatcagtaaacatgcagttcaccacctccttcatcgtcgccgctttcctcggcactgcctttgccatgccacaggccgcaccagttgactgccccgagacgtcagccattcccacctgcggtgtaagtgacacaatcgatactcaaacacatcatgtactaatgaccttctgaaggccccttgtatcacctctgcagctgcagctgctggatgcaccgacattgcttgccagtgtgctagctctgaagtgattcaggcttcagctcttggctgtgttgtcggtaactgtggaattcccgtggctctatcagtgcaagctgccgccgctgccgtctgcactgcctgtgcttagatgtggtatatttattgggacatataagtgacattatatacctgaatacaagctatattagttgcgcgaaaaaaaaaaaaaaaaaaggccccta

SEQ ID NO: 58667 - DNA, 849 bp, Triticum aestivum
  unsure (1)..(849): unsure at all n locations
  Clone ID: PAT_TA_58667
gccggccggtccggggcgacctactggaatctcattcctgcaaaggcgatctacccagttaccacttcctccactgagatcatgtcgttcaaggataagaacggttctgatgagagtctgctgcataatgaagagggcagcgagggaaccgactggaccccattgaagcagcgagggagccggaaaggccacgcctggctcgcatttaacgtcttcttcttcttgatatctctttgtctcttcgtggctacctacacgagaatcaatgtgatatcagagatggagcatgttcggaagacttcattttattctcctgtcctggactcaatcaacttcaaactgaggcccatagagactgaaggtggcctattcgaagccaaaaatcctaccaagtggcgcaactccgtcaagcccgactcagcagtcgatgaagcatgggaagacctcgagaacatccgcgttttccccatcaccgagaatgaggttcgaagactaggcaaagatccagagcttcttgtcaagtttccaccggagtatgggctcggtgataatgcctacatggcacagatcgatatgttccatcagattcactgcctgaacctccttcgacatctggcatgggccgagtatcaccggaacggcacagccaagaaaccattcagcgaactgcattggattcatgtcagccactgcaccgacatacttatgcagaatcttatgtgtaatggcaatttggacattatcacattcaactgggttgaaacacagacaaaccctttcccnggactttggtgtcaatcatcagtgcagggatttcgatgcgatatacgagtggcaggataacactct

SEQ ID NO: 58668 - DNA, 771 bp, Triticum aestivum
  Clone ID: PAT_TA_58668
gccggccgggtcgggaacgatattcattgtaccctctttcttcttgacacacaggctgactaccgtttcaactatacgtcgatgaacttatgactgaaacatcgtcctcccgctgcctttcctgaactcgtagatagtgttcattaacgagtccattatggcgtgctctccgatcttcatctcgccgtgatcatcccttctcaagaaatgctgctattcgaacccggctctgctcttcactcaactctattgcctaggacattgaaactgccgacgatgccaagtacaattacatctacttccatatctaccgatgcaaccccaatacccccactgagaagccccgcctccccaacaacactctgaacctcaacaagactgcacctatgattctcgatgttcttatccgaatcatgaacgacttcgaccctactctgaccctccgaccaatgtgccgagatgacatctgcggtagctgtgccatgaacatcaacggacataacacccttgcctgcttgtgccgtatccctaccgaggctgcttccgacgtcaagatctaccctcttcctcacacctacgtcgtcaaggaccttgtccctgatctgacacacttctactaacagtacaagagcatcaagccttacctccagcgcgacaccccggtcgaagacggacgtgaataccgacagaccaaggaggaccgacgcaagctcgacggactttatgagtgcattctctgcgcctgctgctctacttcatggccatcttact

SEQ ID NO: 58669 - DNA, 378 bp, Triticum aestivum
  Clone ID: PAT_TA_58669
gccggccggttttccaaatcttgctgttgccgctgcctttaccccaaatggcccgagattgagcagctccaggaccgcatcgacaaccccgatgcttacgcctctgctgctcccgctgctgccgctttcggagatgatgctcccgctgctgaggaggcctataaggaccagtctgaggacgacgacgatgatgagggctgccgaggtctcttctactacatgtagccacatcttatacgatgtaccactgtcttcaaggacttctgttgggtttacgacttatggatcctgaaaaaaggtctacatagatcgcctgctggacaattgaatctgtcgcgacggtgacaaatcaaaataaaaaagaagataggcccctat

SEQ ID NO: 58670 - DNA, 450 bp, Triticum aestivum
  Clone ID: PAT_TA_58670
ctgtgcggcgctcgaggcggccggtcgaaatctggggtggtctctgcaccttcgccttcgtctacacttacttcctcgttcccgagaccaagggtctgtctctggagcaggtcgacaagatgatggaggagaccactccccgaacctctgccaagtggcgacctcacgagacctttgcccagaccatgggtgctggcgacatgaagatcgtccccaagaccgagcacgacgaccacgtctaaatcactgcgccctcattctacagaactgttttttcgtttgagagggggtgttttctattttaattatacctgaatgtctagggatcatggtgttatgacctgagatgagatgagatcgcggtagtacatgagaataatgtgtatatatctctacagaatgaaacgattacgttataaaaaagaaaaaaaaaaaaaaaaaaggccccta

SEQ ID NO: 58671 - DNA, 491 bp, Triticum aestivum
  Clone ID: PAT_TA_58671
tgtgcggcgctcaagccggccggttccagacttcgactcaagacgccagcactctgagtcaaatcagaaagcttaaggccaatgcgtcggcctcagtcagctcctcattctttcaggcttctgcgagctacagcaatgagaaacagagcaatgagagtaaaagttctgattccaaaagcctcaacaagtccatggcgtgggaagccactggaggggacactctactttgcaatagtcccgctcaatggtgttccacagtcagtcactacgagaattggcgcattgtcaaccaagatgaggttgtgcgtttatccgaattcctcgccgaatttccagaagttaaaaagatcaacgaaaacttggttgaatactttaaaaagtgtgccgatacatactagctagatgcatgatattattgtaaaggtcatgcaacagactggtcatttaggctgattcttgcccaccaaaaaaaaaaaaaaaaaaggccccta

SEQ ID NO: 58672 - DNA, 228 bp, Triticum aestivum
  Clone ID: PAT_TA_58672
gtttcttctcatccttctctgaatttatcacacgattcatcggaagacaaccaactcaccccggtcttgtatgtcaacgtgtaccttcgtcacatcaactcatggagctgagcgcaaattcaccaagatgcacacgaacatcctatcatggaaactcacactcaacctattctactgataatcaaataagatgcccctatgtacatgttacgatctagatactacgac

SEQ ID NO: 58673 - DNA, 717 bp, Triticum aestivum
  unsure (1)..(717): unsure at all n locations
  Clone ID: PAT_TA_58673
gccggccggtccggaccagtacctcggccgtggtgcaatgtcgcgtggccgtatgaccatcaccagtgccctcaacaccgtcgtctccggtaaccccttcctcaacgaccccgaagacaaaaaggctgttgtgaaagcccttgacaaccttcgtaaagctctttctggcgtgaaggatctcgtgtggctccaacccgctcctagtgtcagctcgcagcaatacgtcgacgatatggtcgtctcatggagtaaccgtcgcgccaaccactggattggaactaacaagatgggcaaggatgacggtcgccagggtggtactgctgtcgttgatcttaacaccaaggtctacggcacggacaacctcttcatcactgatgcatccatcttccctggtatggtcaccactaaccctagtgcctactttgtcaccgcttccgagaaggccagtgatgccatccttgcccttcctgtctccaaggcccaggaaccgtacaagcagtgtggtggcactgagtggaatgggagcatgcagtgtggcaagggatactactgcaaggctctgaaccccttctacggtcagtgctaccctgaaggtaaataggttctgtgttagatgaacaactttatgtatatacttttactatagtttcgtatataggatagtagattttatgtcaagtatatctatataaaaaaaaaaaaaaaaaaggcccctan

SEQ ID NO: 58674 - DNA, 452 bp, Triticum aestivum
  Clone ID: PAT_TA_58674
gccggccggttcgggaaaaagactcacctcatcttacgagcatgcctgcaataccttgagcgatcggtgctcacatgacattggctcttttgctctctcctttggctgggctagagtgcctatgagtctgctttcagaaggtcacaaataagcgggcgaacgagtaacgagcagcttttgtttccccatacacggcgtctccggaagaaaccgaagagcacgccccgcgctgggtagaactggatattatcgggagacaacaacacctcgagcctcttaatatcaccaccacacgtgcaagttcaccgtcaatggccttgacttgcctaagcagggactatgtagtaattattacaataaaaagtacagaacgtggtccctgttgggcccttcgatgcaggcctggacttccaacatgatttccatcaaaaaaaaaaaaaaaaaggccccta

SEQ ID NO: 58675 - DNA, 587 bp, Triticum aestivum
  unsure (1)..(587): unsure at all n locations
  Clone ID: PAT_TA_58675
ctgtgacgncgctcgaggcggccgggtcgcaataggcaatcattcttagcaatgtctctactccaataacagctcccagtcccaccggtcccgcaaagagcaccggaacaaaatcaagaactcctctacttcccggtacacttctctgaaggggaccgaccccaagtcccgactaccccatccacatgatcttcacgggaacatgatggacctgacggaggctaagagagggcaagtgctagggcctctaaccacccggccgacgaatattgcggcgctcctgtggagaattcccattgctccgatacggactacccacaacacaacgtgcgcgcttgagccgtggaggataccatacgattagcccgacccccctaggtgctggatggctcaaaaactaaaagaatccccggccctacgggcgctcccgatctagataataggtatcccccacctctgcaggaattccctatcccccttatcccctccagcgacctcgatgacgggccctccatgcacttcgccctatactgagtcgaatgacacgcccctgctgttcgccaactttatacgcttggactgatacc

SEQ ID NO: 58676 - DNA, 616 bp, Triticum aestivum
  Clone ID: PAT_TA_58676
gccggccgggtccgggggagatcacctcaacactgtcgagttccactggtactctgctgaggagaaggtcttcttggatcccaggatattttcaacagctactcacgcttgggcattcaagtcgaagctatgctcaatcaggacatggtcggctacaagggtcgtgacgggatcgagcgctttggccttgtgaccgatttcacaagccctagccaaaacgagtttctcaagctgctaatcgacgagtacgctgatattccttatgaggagtccacttgcgggtatgcctgctctgaccatgcttcggcacatcgaaatggcttcccctcatcgttcctcttcgagactccgttcggcaaccacaatccctacatccacacacccaacgataccatggcccatgtcgattttgaccacgtcatgcagcatgccaaggtcactgctggctttgtctacgagttggctcaccgcgactttactgcatgagaatattgagagtgatagaatagttcaaattttgatctttaagaaagactgagtaaagagaaataatttacaaaaaaaaaaaaaaaaaaaaaaaaaaaaaaaaagaaaaaaaaaaaaaaaaaggccccta

SEQ ID NO: 58677 - DNA, 229 bp, Triticum aestivum
  Clone ID: PAT_TA_58677
gccggccggtcccgaaccacatttacggtttggggcggtgtacagtacgtttcggtttaagtagaacgagtgtcacggcaaaggcaaaaagggtgcgtgcgaggtaccagagaagtttgtttactggctagagcaaagtattggtggattaatgctaggtattgaatcatcggtgaataagtcaagagacgggagtcaaagggaaaaaaaaaaaaaaaaaaggccccta

SEQ ID NO: 58678 - DNA, 518 bp, Triticum aestivum
  Clone ID: PAT_TA_58678
tgtgcggcgctcgaggcggccgttcgggatctccctcaactcactactataacaccctttttaacacttccttccaccccaacatcttcacaacgtctggcgactgtggctgctctggtgcctcttcttgcaactgcggctctagctgctcttgctctggctgcggcaaataaacaacttgatctttgatcattcggataccacttgttctaggcccaagcttgggtcaagatacatcctttgacgacgaatcacggacggagttatgaagggcggagttgagatcatgatgtgattgggatatgcgcttggatagttagctacagattaagcttaaatactacccttgtgctgagtaaaaaaaaaaaaaaaaaaaaaaaaaaaaaaaaaaaaaaaaaaaaaaaaaaatgaatggggagggataagctattcatggcatccacttctactttatgtcttaactacacatgaatcgaactcaaccctttattcaaaaaaaaaaaaaaaaaaggccccta

SEQ ID NO: 58679 - DNA, 354 bp, Triticum aestivum
  Clone ID: PAT_TA_58679
gccggccggttccggaccagcagcacctgtgcctgcgatgactcttccggcaacaaacactccgaaggaagtcgagacggtacagaccaaaccgcctgttgctatgagagccgcaatggggaggataagagttctcggcgggaagatggtggccagacgacctgttacaggcgccagagaggacattgggatgagataggcgccggtgaaccacatagcggatgaaccatatgagtcaaattgagcagcgatagcgccttgaattaaggtcatgaaaaaaaaaaaaaaaaaaaaaaaaaaaaaaaaaaaaaaaaaaaaaaaaaaaaagaaaaaaaaaaaaaaaaaaggccccta

SEQ ID NO: 58680 - DNA, 599 bp, Triticum aestivum
  Clone ID: PAT_TA_58680
gccggccggttcgcgggaaacggccagccctgaaattgtcgaagaactattgatccgcggtgctgagaccaaggtacgcatgctgggaggccaaaccatgctaacatactccatcgacgtcaaccaccgcaatcacgtcaaaagtctgttgtcttacggtgttgatgtgaacgaagtagacggcttgaacagaacgccgttgatgctggcaatgttgaggcttgacttcaacatggccaagttgttcatggactatggcgctgatgcaatggcggatgtgaatgagagcgcagtcaagtttatcaaggctttgaagagaagggactttctcgaaatacttggccttactggagagcctcgattgcatcaggtcaggggcttaccgcaggttagggactcgccaacaacaagcccttctacgactgaagaacatgcacctgatgttccaccaccatcgtacgaggtcgctgctgggaaggcttgaaagtctgtaaatgacataactattagtatcgctaaaaccagtcccctgataataaggtttccatctttaaatacacttttcaagcacgctaaaaaaaaaaaaaaaaaggccccta

SEQ ID NO: 58681 - DNA, 401 bp, Triticum aestivum
  Clone ID: PAT_TA_58681
gccggccgggtccgggccaacaagaagatgctcactggtatttcgcatcttgataccacaacctttggtggtgccaaggcatatgttaaccccgagacggccaccgttgatcccagtggaaaggttgtggttcaactccgagaggcagaacccgaggcgcagctcattgctaaggaagccaagggacgcgcccgagtttacgacccgtcaaagcgaagcaagacggagatcaaggaggctgatatttggcgaacaggccgcgttgctgatgaacttcttggcggggatgcggctgcccctgaagacgacgctgtgagcagctccaggaactacggccttgatgataggcaataaaacatcacgtttggccaagagaaaaaaaaaaaaaaaaaaggccccta

SEQ ID NO: 58682 - DNA, 261 bp, Triticum aestivum
  Clone ID: PAT_TA_58682
gccggccgtttccaaaaaaaaaagaccagttcctcggtttcttctactaccctctcgacccgaccctgtcactagtgtagatcgatcgatcgttctatgtgtcacgcgcgtgcgcgcgtcctcgtgaccgatcgatcaaacgtgttcgttatcaaaagcacccgatcaaacgtgaaaatgcgcttcttgaatcttgatcacctcgatttgcatgcttccatgtccacgtttctccaaaaaaaaaaaaaaaaaaggacccta

SEQ ID NO: 58683 - DNA, 568 bp, Triticum aestivum
  unsure (1)..(568): unsure at all n locations
  Clone ID: PAT_TA_58683
gnncggccggttttcaaaaaacttcatccaacaagctattcactccccccaaactcaacacttttttataaccttttcgaagttttcttcaccaacatcttcaacatgtctccctgctcttgctgtaaccacgccggcgcttcttgcaccagcgactgctcttgctgcaagcactaaatccattattatccaaacctgacaacacttggcttacatcacggtttcgtgacaatgtctcatcggagtacattatgaggacgtctctggatcggtctctcatcaagcaagtcagacagacatgggaatggacataatgaaagaaatggtataacatgcggataaatagctgcgacggccacttttcgatggtagcgcatggtagataccaaattggagcttgcatacattgaaaaaaaccaaaactaaacaaaaaaaaataaaacttcccaccaacaacacaaactaacaaaccccaacaccccacaaacccataacatcttcccaaaaaaaaaaaaaaaaacaaggcccctcggcaccccccccgcccctaaaataaaggcaccccccc

SEQ ID NO: 58684 - DNA, 433 bp, Triticum aestivum
  Clone ID: PAT_TA_58684
gccggccggttcggaggatttatctttatttactccagtaacctaacatcaacccctacattacaaagttacaagcggaatcatgggcgtgaagagtgacagccacctcaaccacggtgaactacgcacctcttgtgttttcagttctcaagatgcactcaaagccgaacaagatcactctgccaagaactaccaatctcttcccatcgtattctcccgtgctcagggagcatcggtctgggatcccgaaggtcgtcattatctcgactttcacgctgcttccacggctctgaaccacggacactgtcacccgaaacttgtcgcgaccctggttgatcaggcttcgcgtctgacactcacgtctcgcgctttccataacgacatttatccacaatttgctcattcagaaaaaaaaaaaaaaaaaaggccccta

SEQ ID NO: 58685 - DNA, 859 bp, Triticum aestivum
  Clone ID: PAT_TA_58685
ctgtgcggcgctcgaggcggccggttcaagaaagggatttttcgtctctttattactcgtatttcttcccttgtctcgtctttcgcgacgctcgatatatcttcaaaatctccaaattcgtcaataccgtcaaaatggtcgagaagctctacgtcacctacaacgatgtgcacaagatgtgccagaagtctgctgagaagcttctcctcgacttccagcctcaacttctgatcgccatcggcggtggtggttacgtccctgctcgaatcctccgatctttcctcaagaagggcggcgctcccaacattcccatccaggccatcggtctctccctctacgagtctctcggcaacgatgaagtcgaggcccccggtaccaaggtcacccgaacacagtggctggacctcactgctctcggcgagatgcagaacctcgtcggaaagcgaatcctgattgttgacgaggtcgacgacacccgaacaactcttgagtacgccgtcagggagctcgagaaggacgttgagactgcccgccagaagatgggtggtaccgcccccaagactgagttcagcatttttgtcctccacaacaaggacaagcccaagaagggaaagctccccgacgagatgctcgccacccgttactccgctgccgagaccgtcggagatgtctggatcaactacccctgggaggccatcgatatcgacgagcatgaccgaaacgctagcctgcagaccaagagcaactaaatgttttataagaattcgggagttgggaaaatggcgcatagatttaacgcgagatatccatataacacatgacgaatgagaaatcccgggcctgtgagctcgaatgaccc

SEQ ID NO: 58686 - DNA, 496 bp, Triticum aestivum
  Clone ID: PAT_TA_58686
gccggccgggttccggacccttacacgtcgcatcttcctccaggccgccgccaacagcaacccagacgttccatcatggtcatacctcgcaagctacgattacggcacacccattctgggaacattccacgggtctgaccttttacaagtcttttatggtctgttgcccaataacgctatgcggagtgtccgaacgtactacttcaactttgtatacaaccttgatcccaacaagggcgttaccaagtacgccaagtggcccgagtggaaggagagcaagaagctcatgtggtttgagacggcgaataagaacagcattataaacgatgactttagacaggattcgtatgagtttattgcggcgaatgccggtgctttggtggtatgagctgtgggtagttaggatgtgtgtgtttatgcattttaattataggacaccaatggttaagccttgaactccgttcttgcctaaaaaaaaaaaaaaaaaaggccccta

SEQ ID NO: 58687 - DNA, 411 bp, Triticum aestivum
  Clone ID: PAT_TA_58687
gccggccgtttcgaaagagcccaaggaggagcaggctgttcccagcccgtcagccaagactacggcgctaaggccgcccaggctgctcaggctgctcaggatgcccgcgttgctgaggaggagggtggtgaggaggtccaggctgttgagcaatagagtgcttaaatcattaggctcggaaaagccaccaaaaccttacgaaggaagatgggagacccgtgggatgagggacggaggtctactcaggcgtcaattgttcatttgcatctgctaagggcacggaaggtttcattcttgcttgtaatggtaggcaaagcataaaagagaaaaaatgagacccaaagattacgacgacacgtcatatggccgtgtcttctgtctacctaaaaaaaaaaaaaaaaaaggccccta

SEQ ID NO: 58688 - DNA, 687 bp, Triticum aestivum
  Clone ID: PAT_TA_58688
gccggccggtttcgagtgtcttggtctcggctttcgaggtaacacgagttgccagatctcccggatccgccccttccccgacccgaatcgcgcggagatggacgccggcggcagcggcagcggcgccgacctgaggagcagcatcaagaagtggaagatcatctacccggtgtacctcaactccaagaagacggtcgccgagggccgccgcatcgccgccgccaaggcctgctccgaccccacctgcatcgagatcgccgacagctgcgcctacctcaagatccctcgcgccatcgagttggataaggcgtatccgcgggatttcttccaggtggggagggtgagggtgcagctcaccaatgacgacggctccccggtcaaccctgcaatcagaacaaagaagcagctaatgatccaaatagcagagctggtccccaagcatcatgggaggactaagaagcaggaaccagtggcaggtccatcagttacaactactaacaagaaaaataagaagaagaagtagcattctgtgttgttttttctgttcatagaaagttttctagaaaattcatcagagggagttcttggttgtctgtctgctatgaggcctgaaaaactgtgaattttctgaatttcttattttatatggtgacttctgcagaaaaaaaaaaaaaaaaaaggccccta

SEQ ID NO: 58689 - DNA, 424 bp, Triticum aestivum
  Clone ID: PAT_TA_58689
gccggcccggtccgggaatgttttctctcaggaggcaggtgtttgggtcaagactaaagtctaggggttctctgggcttttcacgtttatgactgctccgctactcccatgctacggaacctacaagttgtctatttagcatggaactcggtaatactttcgcagtagataatccgagaacagctggtttgtttaaacagaactttcaacatataatgtccagttagtctgtttccaatttggctactacagctgtattgaagtgcatggaagttctactgtaaatctggtaatttaattaacacatgcatgcatagtcttacattccacttaagaggtattaaaacataagcctataactttatatactctattttcatatattaaaaaaaaaaaagaaaaaaaaaaaaaaaaaaggccccta

SEQ ID NO: 58690 - DNA, 188 bp, Triticum aestivum
  Clone ID: PAT_TA_58690
gccggccgggtccggttctataggatttagtatagtatagtaggatttataattatacatactataataatgctattgtattccacatagcatctacacttcttttcagtaacagataagctagagaaggtatatatatactgagtatataaagcaagcgagaaaaaaaaaaaaaaaaaaggccccta

SEQ ID NO: 58691 - DNA, 791 bp, Triticum aestivum
  unsure (1)..(791): unsure at all n locations
  Clone ID: PAT_TA_58691
gccggccgggttccggattcatcatcacgagcattcaacactccaagatttatatgcaggcttgtcgcataaacaatctttcgacaaaggaactttgagatttgacgaaatcaaacatcgatcgcttcatcaatacaaggcacaatgcgacctggcgtcagaagtactgtagagcgcctggacaggcccagcgcctactatcagaaccgcaacaagcgaagacgtgatcgcgatgacgagagcaaccaaccacaagaaccccaagtcgatcctttggccaatgctacaactctctatgttggcaacctgtctttctacacaaccgaagaacaggtttacgagcttttcgcaaagtgtggcgaaatcaagcgcctcgtcatgggcctcgatcgtttcaacaagacaccctgcggtttctgcttcgtcgagtattttacacaccaggacgctcttgattgtttgaagtacatcggcggcacaaaactcgacgagcgcatcattcgtaccgatttggaccccggttttgaggaaggccgtcagtacggccgtggtaaatctggcggtcaagtacgtgacgagtaccgcgaggactttgacgagggcagaggaggagttggtagggcgatacaggccgaggaacgagacgagtacgctgaaggcaagtaacctggtgtattagaagcagaggctgtcccctggagcgagatttgggactcgatacccttaattttaacaagaagctttcatcattcgagaaggcttatacaaaaaaaaanaaaaaaagggcccta

SEQ ID NO: 58692 - DNA, 434 bp, Triticum aestivum
  Clone ID: PAT_TA_58692
gccggccggttccggatctggtcacggatacctgggtctccatgggccaagaagctgatacccagaagcgtctcaaggactttgctggattccaaatcactaatgacttagctaagcgaggaggtgccaaggctgactggaagtttatgcactgcttgccccgccaccctgaggaggttgccgacgaggtcttctacagccctcgatctctggttttccccgaagccgagaaccgcctttgggctgctctttccgctcttgaaggcttcgttgtgaacaagggtaagttttaagagcgagtcgactatgacacggggatgcctggttttatctgattactgcacgggatgaaggcggagctttggcgcatgaatataaaaaaatagtcattggaattatatcaattagaaaaaaaaaaaaaaaaaaggccccta

SEQ ID NO: 58693 - DNA, 481 bp, Triticum aestivum
  Clone ID: PAT_TA_58693
tcgcaaggaccacccctaccttttttctttcggctgtccgagcatcacgaaatagttgccgagcagaacagaggggtattacacctaaggatttggtgcctgatggagaattgtggtgatgaggttatctaagaattgaagttttgaggtgaggatttatgatttctttaacaggagcagtatttgtagccacggggagtactgctggttggtttactcactgtcatatattataccaaggggggtgttcgctcatttattgttgcgggaggaaagacagcaagtggtgtctctgatactatcttattaccacgagcatgagttggtttctataccaatagagatttggacttgggtcaatattaattgcagggtactttcgaattgtttagatattgtgtatctacatataggccttagttctgattaatgtgaatttaccaactaagtaagacaaaaaaaaaaaaaaaaaaggccccta

SEQ ID NO: 58694 - DNA, 554 bp, Triticum aestivum
  Clone ID: PAT_TA_58694
gccggccgggtcggagaaaagcacatcttaaatcagatcagatcttgacagatcaaacctgcactactaaatcagcctctgccgatcccacgcagatcaattccaaccaacacatcacgcaaaatggtttaccacattacttcaaacgacgagctacagaagctcctctcgtcaacaacatacgtcgccgttgacttcttcgcagactggtgtcctccctgcaaggccatcgcccccgtctacgagcaactctccactaagcacagcgtccctgacgttttggcctttgccaaagtcaacgtggaccatgtccaggacgccgcacaacagtatggtatcactgccatgcccacctttatgttcttcaaggaaggaaagcaggtcgccgtcaatggccaggctgtgatcaagggtgctgatcccagaacgctgggagcagctgctgagaagctgggcggcctagcacaaaagcgagttgctggcgcttaaggaaatgagaggtttaaaaatgcgaccgagaatagaaagaaaaaaaaaaaaaaaaaaggccccta

SEQ ID NO: 58695 - DNA, 606 bp, Triticum aestivum
  unsure (1)..(606): unsure at all n locations
  Clone ID: PAT_TA_58695
gccggccggttccagacaattccatcatcatcaagcaattgattaactcaagaacaacattgacacttatcaacaatccaatcacccttcaagttcaagatgctttcgttcgtaaactacactccccgaactcatcccgagcacaagaacaaagagcattgccgggtacactctgatccagccaacatcccacacgatgtctcccagaaaacacccgtcgctgagcccaagtcctccgtcccacgatctgctgctccttctgctcccacaactcaagcttaaggatgaagcataggcacaggtcccgagaggtaaaagtcttggattagttcaacgaccaaggatacccgcggagtgcaaggcgtttttattagctggtttgctgcaacgatatggataatgggatgcaattggcgtgcgtttgtctgttaaacaggcgcacttggtataataaaggacacaacagggaaaatgaaccgtgggcaaaaatacattagctacctacttgggtagcttgttgggatttgatacactatttaatttctaaactacaaatgcttgtttgcttcataacctaatgaaaaaaaaaaaaaaaaagggccctan

SEQ ID NO: 58696 - DNA, 534 bp, Triticum aestivum
  Clone ID: PAT_TA_58696
aacctactgcctaccagtttcttctaaaacattatattccgctgacttcatgagtgcgataactatttccttttcccctcatccatcatctaccccaccatctactaagtattcttcaaaatggctctacatctcccaagaaccataaatatgaattccctgcccacgacggtgaaaagcaggacgaccacgctgcaaagcatcacagactaccatactgacacccttgaacagccctcgatgatgctcacatcaacaagaatggccgcatcactggtactcatttctatctgcttccatatctctcgaccgcaccgtttgatgcccaagactcaccagaaccttctttttcatccgagaaatgttcactttattcaagatcctccagactgtgactgtctgacactaccctgacaacgctcatatcccccgctctacactcacatctaccacaacaccgacaaggatggccgagccatctacttcgagactcttgccgctatcaacctgagcgctatgtaccacataaccacc

SEQ ID NO: 58697 - DNA, 452 bp, Triticum aestivum
  Clone ID: PAT_TA_58697
gccggccggttccaagaacacacaacatccatatcattctatcccatcagtaaacatgcagttcaccacctccttcatcgtcgccgctttcctcggcactgcctttgccatgccacaggccgcaccagttgactgccccgagacgtcagccattcccacctgcggtgccccttgtatcacctctgcagctgcagctgctggatgcaccgacattgcttgccagtgtgctagctctgaagtgattcaggcttcagctcttggctgtgttgtcggtaactgtggaattcccgtggctctatcagtgcaagctgccgccgctgccgtctgcactgcctgtgcttagatgtggtatatttattgggacatataagtgacattatatacctgaatacaagctatattagttgcgaaaaaaaaaaaaaaaagaaaaaaaaaaaaaaaaaaggccccta

SEQ ID NO: 58698 - DNA, 367 bp, Triticum aestivum
  Clone ID: PAT_TA_58698
ctgtgcgccgctcgaggcggccggtccgggaacaaaatattttgttttcggcctggtcttgactttttaactgccgagaagcaacactttgctgctgttactggtgctctcggcgctcccgatgctggtcctctttgccaggcgaaagatgctgatcctgccaacggtaccagcgattatgatgagagtgtcgctgctatgagcaagcgtgatgtcactgcttggggatggaagaccaagtctcgcttcgttcgctcggcttaaattgagatttacctggagcttggcgatcagtggatgacgtagatacatacccatggaataaatctgagattcattcgaaaaaaaaaaaaaaaaaaggccccta

SEQ ID NO: 58699 - DNA, 652 bp, Triticum aestivum
  Clone ID: PAT_TA_58699
gccggccggttcgggatcgtactgggatcgtgactgctacagttgctggacatttcgctcattggcaatacctcactcgatcccagcgaattaatgtccaagctactgcaaatcgacttcctcttgcacgactcggtttggcctggggtattgtttacctcggcgtgctgagtaccattaccattgctcagcgtaaagtcgcgagaagttcagatcctcttctctcgcctgcgaagccgtagggaatatctttatcatgtcggctgacttttgggctggctatctaagtggcgcagttggtatcatcattggaaaccctctcgatgtcatcaaagtacgacgtcaggcgcagcaagccagtccaccgccagtcctgtcttctccttcgatgatagcaggagaaacttctgccacgagccaaggcacatcattcggcactcgttttctcagatcatatacttctttagtaactggaactgcggcgccaattctcggctatggtgccctcaacgctttactttttgtttcttacaaccgtaccgaatctacattgaacagtgtgttctcaacatcagagaatctgtggaatgcatggattgctggctctgtgggtggtcttgcaacctggatcgtcagcacgcccaccgagctc

SEQ ID NO: 58700 - DNA, 879 bp, Triticum aestivum
  unsure (1)..(879): unsure at all n locations
  Clone ID: PAT_TA_58700
gccggccgggttgggatatctaccattttcctcaatctaagcactgttatttactctttggttattagcagcgacactgaaccacaattaaccaaccggcaattgctcttattatataggcaatatcgcgtcttatatctccatcatggcaactgatcgtgtcaaagcctccgtcctccacggtgagaaggacctaagactggaagagcgtgaactccccaagccttccagcaacgaagttcaagtggctgtccaatccactggtctttgcggctcagatcttcactactacaaccactttcgcaacggcgacatcatcgtgcgagaacctctgactctaggtcatgagtcggcaggcacagtcgtagccgttggttcagaagtcacacacctcaaacctggggaccacgttgcccttgaagttggtcttccttgcgagacctgcgagctctgtgatgagggccgctacaacatctgccgcggtatgaagttccgaagctcagcaaaggccaaccctcatgcccaaggaacgcttcaggagcgaattaaccaccctgccaagtggtgtcacaagatgcccgaacatgtcaccctcgatctcggtgctcttgttgagcctctatctgtcgccatgcacgctcgagaccgcgcctccctccctaaaggctcaacagttctggttctcggcgccggggccgttgggcttctagcagccgctgtcgccaaggccgaccaggcaaagacagtcataatcgccgacattctcaaggaccgcctggattttgccacaagcaatggctttgccgacgcctcagtagttggtcccatggaacgnccgcaactatcgaggacagctggctttcgctcaaaagttgctgc

SEQ ID NO: 58701 - DNA, 836 bp, Triticum aestivum
  unsure (1)..(836): unsure at all n locations
  Clone ID: PAT_TA_58701
gccggccgggccgggatggaaccgcccccatgactttctcagcatttcgttagactctgcagagtcgctagcaattttattctttctgggagtggcttcccatgttttggcttttcgcaagggcgaatgggacatgtggacgatgccattcatatgcacttggataacatatcaagcggttacaccatgcgcactgaaccagctaaggcctatggcgtacttcgatgcgatgattctcgccaacaaatggctcttctcatttctgttcggcatgacaagcagcatcttgatctaccgaggtttcttccaccgtcttaacaagtttcccggcccttttgtagcacggctctcaaacgtgtatgcctcttggttagcaatcaaggaagagcacatgtatcttgaggttcagaaactgcatcagaaatacggagacattgtcagaattggtccccaggaactctccatcgcaacgccaagcgcattccgtatccttcacgccaacaattcgcccattgtcaagggtccattctataatgttgcccgaccctgtgtaaaccttcttgccgacaggaacaagaaaagtcatgctcagcgaagaaagacttgggataaggccttcactgcaaaagctctgagagattacgagccaagagtagtcagatacacgaaacaactaaccgaacagatcgaaaagacaaagggaaatcctatcaacattnggcgcttggatcaacttttacacatttgatatagtaggcgaccttgctttcggcacaagcttcaactatctggtcaatggcgtgaaggataaattcttgagagactacatgacagtc

SEQ ID NO: 58702 - DNA, 808 bp, Triticum aestivum
  unsure (1)..(808): unsure at all n locations
  Clone ID: PAT_TA_58702
gccggccgggtcgggactcaagttagcaccaaagcaatccaagagtagtagtactacaaccagcctcactacgtgagcatctccacaacgagtgtgtgcgtgcatcacttgtgtcctgctagcttcagttagctgcagtatagatcgtctgtgcctctgatcctcggcagttctgccagtagatagtttgggccaacaattggcatcagagccttaggttatgccgaaggaaggcgtcgccggcgacggctccaagaccgccgagcatagctcggctgaggacacccgtgcggcggacgcgctcgcgctgcgaggcaggccgggaggtgagctgggtgcgccacgctccgtgcgtgacgtgagcatgtccagcacctccttccctctccttacgcggaccaactaccccagttggtcggtcatgatgaaagtcatcatggaagcgcggcctatgtggaaagctgtggaaaccggcgatgtcgagtatgaggaggaccggctggcgatggaggcaatcttgcgctccgtctcagaggagatggtgctcacccttggtgccaaggagacggccaaggaagcatgggacaccatcaagactctgcgcatcagcgtggaggncgtacggggagtcgaaggcccagaccttgcgcctccagtacgagggagatccggttttaaggccggtgaacaagtcgacgacttcgccttgcggctgcaaggtctcgtcaacgagctcgcaaacgctcggatgtcaggaccccgactcgatgccacataggtctagcatgtaacacctcatatcactttg

SEQ ID NO: 58703 - DNA, 810 bp, Triticum aestivum
  unsure (1)..(810): unsure at all n locations
  Clone ID: PAT_TA_58703
gccggccgggtcgggatgtgtcggactttggctcgtcactcacctggcacgtggcgaatgtgaaggactcggggttggaatgccctgttatgggcacatttgggtacgtcgaccctgagtactgcctaagaggccgcgtgaagccggcgagcgatgtgtacagcctgggcgtgctgatgctcgaggttttgacagggaaacgggcatttctccaaggggggttgaagataaaggaagatctagcatgtttcgcttctcctatcatcgaggctggtaatattacggagttgctggacaagcgacctgtaccggagccaacaccattgcagttgcaggcgctgaagcgtgtggcgcaaattgcaagatgttgtgtcaagtgggttgggagggctcggccggccatatcggacattgttgccaacctcgagatggtgtacaagttgatctgcagagacgagccatgtttagttgaagagtcagtcgtgtggccttttcttgaaaaagttgatgagtcgccacatgccaagagtgtgccatcagcaggctaccagcccaatctggtacaccagaaactgactgaactctgttcacattaaccaactgaatcatgggaatacacggatgaagcaagaattgattttctgtttaaatactactcctacattacatgtgtttttccataccnttctgcattcggttctagctatttccgcacccccataatagacgagaataacaaatatgtatcgcctcccgccctttatgtgattaattaatagaatgtccttttttagtggttcctcgnngatg

SEQ ID NO: 58704 - DNA, 845 bp, Triticum aestivum
  Clone ID: PAT_TA_58704
gccggccggtttccgggctacctattcaacttatttcctaatcccaagttaccatggcggctgagatacccggtgaagacatctactccgctgacagcgatgtcgacagcgatacaggccagactgaagaaatcccacgatttgatctgggccttttgcataagacagaggtacccataattcaatctcttaatgtgtttgagggtgcaacaatcaaacttgaacacaatcaacataacagtaacaaacccggcccacccctattaggcccagtttccgtcagcatgggtgggaacctccagatcacgatccataatcaatccacgaattataacacctcggcattgatgctggttcctcccactgccggcacccaatctccagcagcgatgatgaggattttgaacagagatcttccagcaagggcaagaacgaacacatcagaagatgaagacatcctctacgaacactatgccccttacgtcactatcgaagatgacagggttaaggacatggctcttcaaatcgccgaaaagttgcagtttgttgataaaatacttgcgagcttcttcgcctccatcgttgctgaggacaataaaacctacatacaaaaacagcttacgagcatccgacaacacattgcaaggaagatgaatagcggaagtcagccctgccaatccaatacccaaaccgtgaaacaagaagatgcaatcctaggtgacctaggccacttttgtgaagatctattcgactacagcacaacaacagaatcaagagatgagaacgcccaggctcccagaatttattcaacacatggaagcagcaccgagaaggtgcactacctt

SEQ ID NO: 58705 - DNA, 611 bp, Triticum aestivum
  Clone ID: PAT_TA_58705
gtgcggcgctcaggcggcggttgggaacaggcacatacaaataaggcctgcatactatcacgaagtacgcatgaagagatgtcttcatgtatgcttcgagctctcaatacactgttacactattttgatataaaagactcacctatcataacgcctgagtgtcaatgccaccttctgctataaccaattcgcctacacaccatgctggacatcctactactgtaacacattgcctctgtccctctaaaatcccaaatacttgttgcggatattcccccccccaacttcaccggatatgaacacataacctgccgcgatgagaatgccaagcaggatgcctgctattacaccaacctctttgacttcaagcccattagctctacaaacagtctcgaggaatggcatcctatactctgtctcatatgaaatagacaaccatggcctcgatatgactatacctcagacatctgcaaaatgtagttcacttccccgacgatgaactcgtctccaaccatacctgaaccttcataacgacatgtacgctcatctcgaacgatatgtccgacatccgatacgatgtcgcctttgaggatgagaacgtccacgaagct

SEQ ID NO: 58706 - DNA, 732 bp, Triticum aestivum
  Clone ID: PAT_TA_58706
gccggccggttcggggtgtcgactgcatgcttattctcctccccgtatgccgaaccgttatgcgatgggttcgacccaagattcgcttcctccctctcgatgagaacctgtggatgcaccgccagctcgcctattccatgcttctcttcacctgccttcacacaggcgctcactacgtcaacttttacaacgtcgaaatcactcagatccgacccgttacggctcttcagattcactatgctcagcctggtggtatcactggtcacatcatgcttctctgcatgctgctcatgtttaccagcgcccacgctcgtatccgtcaacaatcgtttgagacgttttggtacactcaccatctcttcatccctttcttcctcggcctctacacccacacagtgggatgtttcgtgcgtgacactcccgaggctttctcaccattcgccggcgacgagttctgggagcactgcattggttacctcggatggcgatgggagctctggactggtggcgcctacctcctcgagcgtctctggcgtgaggttcgcgctcgtcgatctacaaagattacccgagtcgtccgtcacccctacgatgtggtagagattcagttcaacaagccatctttcaagtacaaggctggtcagtggctcttcctccaggtaccttcgctctccaagtaccagtggcatccctttaccatcacttcatgccccttcgacccctatgtgtcag

SEQ ID NO: 58707 - DNA, 177 bp, Triticum aestivum
  Clone ID: PAT_TA_58707
gccggccggttcgggatctttgggtgtctcttttgctcttgttccttgcacattagcttgtgcccctatggaccccattagaaactccccctaaaaggtccactgaattcttgagtagcattacagtgaatatgaagcacgttagctcatgaaaaaaaaaaaaaaaaaaggccccta

SEQ ID NO: 58708 - DNA, 734 bp, Triticum aestivum
  Clone ID: PAT_TA_58708
gccggccgggtcgggaatcgcgctgctcctagcgaggtctccttcagctatacattaggcaagagatcttgtgcacgggaactagcgacaacgacgggtcgtactagtgtcaatgcaacttctgctctgcatggcaagtgacgcgaagcgtgctcgtaaggcgtgagcaccctccattctacgacaaccgcactggagaatgcgtctgaccgcgaggaaccgatgtcgacgacgcagaagtgtgctcacgtacgagccctgtgcatcagacgctagccaccagcgtcctcacaagtgcgaatgccacaaggtactgagatggaaatacggaaagtgtgcgccctcgtgcgatcaacctcacaactatgacccccacgccggagagtgtgtgtgcaccaaggtcaactgaggtcactacttcaagagtgctactgtctggcctgatctccagtactttaacgaagactctcactatgcgcggatgcgacaagggcacctctgacgtcctactggaagcgtgtgtaaaactgcctccaagggacagcactaccaccgctgcagcaatacttggaagtgccctaaggacttgaactggaacggccaccagtgcgcctatgactgcggacacgacgatgagtacaactacggcgcctgtgtctgcaagaaggagaaccacgtctttcgacagcactccaaagaagtgttcttgccagcagggctggtatacgaccagc

SEQ ID NO: 58709 - DNA, 817 bp, Triticum aestivum
  unsure (1)..(817): unsure at all n locations
  Clone ID: PAT_TA_58709
gccggccgggttcgggatttttncgtggcttacacaacagaacacaaaaggactatcttcccgactagcgcaaaccactccttgtcaatctatccgaaatcatgtctccttcaagcaccaaggttgcctctggcggctcctttcacactttccagggaattattcccaaaaagcagccagctgcttccagcaatgcaaggcccagggttgcgggcacacggcgcataacaactccccatgcttgtaccgagtgtaaacgaagaaagatccgctgtgatggcaagctaccatgtggccaatgcatcaccagtcgagccccaaagaattgctcttacgataaacaccgtcaaagaatgatcccatccagaaaagctctggatagccttgcacaatctctcgaagagtgccgttcggtacttcggcggctttacccaaatcatgacgtttctgcacttcgctccctggacaagcaggagctgatcaacctcttggctcaatcgcaatgttccttgagcgaccctcttccatcgccacccctcgaatcgtcattccccaagagcggcacacctatgatgggatccgactccctactggaactgcagacatccctagaagctgatctcgactcactcattggtgagctcgagtttgaggtcccgggagagcaacgagaggccagtgaggaagcaaattacctcgcgcaacaatccntggtgggactntggctcgagacaatggagctccgtatcatctgtgcctcncatgatggatgggtcatcgtacgggcatgatatgatgactccagggcaacactcga

SEQ ID NO: 58710 - DNA, 531 bp, Triticum aestivum
  unsure (1)..(531): unsure at all n locations
  Clone ID: PAT_TA_58710
gccggccgggtccgggaggcacttcattttacaagattatctntggactcctacagcaaaagcaccttacaccgtacaacctcaaccacttacaccaaccaaacatccacaatggccgacaacaacaaccagcagcccggtcttatcggcagccacgcccaatacgtcaagggtgccgcagaggccaccattggtgccatcaccggctctcagccctggaaggcttcgggtgagcaggacaaggccgctggtcttgccgatatgaagaaagctggcgaacttcgagcgcaaaacgaccccaacaaccagaacggatatggaaaggccgaggagattgccggcaagcttaccggttgccagggaatggagcgcgagggtcacgcaagcgctgctcagaagaaggaataaatggtctctttagcgttgaacgattgatgtctgtacgatatatatacctcggcaatgagatcacttcgatgactctgtcgataataccaaattttgcaaaaaaaaaaaaaaaaaaggccccta

SEQ ID NO: 58711 - DNA, 638 bp, Triticum aestivum
  unsure (1)..(638): unsure at all n locations
  Clone ID: PAT_TA_58711
gccggccggtccgggatgagcaaccaccattgccgaccaagcactttcccgacagcataacttgagctctcgatacccaaacaacgaccacccccaaaattcagaatcaatacgaaaaacatcttgttacggaaagaaaggacagaaatcaatccactcacaatgtcagccgaagaagagcgccaggccgcccttaactcgtaccgtgccaagctcatcgagtcgcgagaatgggaggcaaagctaaagaatttgcgtcttgaaatcaaggacatgcaaagggagttcgacaagacagaggacaacatcaaggcgctacaaagtgtgggacaaattatcggcgaggtgctgaaacagctcgatgatgaacgatttattgtcaaggcctcctccggacctcgatacgtcgtcggatgcagatcaaaggtggacaaggtcaagctgaagcaaggcacccgtgtggcactcgatatgacaacacttaccattatgcgaatgctgcctcgcgaagttgatcctttggtgtacaacatgtccctggaagacccgggccaagtgagctttgctggcattggtggattgaacgatcaatttcgagagttgcgggagggcatcgagcttcnccttaagaaccccga

SEQ ID NO: 58712 - DNA, 200 bp, Triticum aestivum
  unsure (1)..(200): unsure at all n locations
  Clone ID: PAT_TA_58712
gccggccgggtcggcatttccccagtgcattccccagtctccatttctttccatcatcctaatatctaaattaaacctcagcactcctaaactactcacacaatcatcatcatgaagttcctctggtctctcgccctcttncgcgctgctgcttctgcccagtccccgtacgactcagacgctgctgccccctctgcctc

SEQ ID NO: 58713 - DNA, 805 bp, Triticum aestivum
  unsure (1)..(805): unsure at all n locations
  Clone ID: PAT_TA_58713
gccggccgggtctgggccctcaaaacactcaacaacgccaatgtatcaagtacagtcaccatgtcgtgtcgaagacgggcaatatattgcgcaaagcaaggtcgctgcattttgggatgaggcttggtggaggttgtcgtggacaggtcgagccaaggaatacatgattcgaggtattacagaccgaagtccgaagaatcttctcaccgatagagatgtacgaagacaccagaaagcggtccacagtgagacaggagacatcgtagggtatgcccgatggattatgccagagtcgcacaaggattcttggctcaccgcccaaacaccagatgtgagcgccgaacagcaggagatattcgcaaaacgtcatgcagaaacagactgggatccaagccacgataatgacgaattggacgagcatatggatgggtggagggagaagtacaagcacgctgattgcatggaactacattacatcgctgttcgtcccgaacaccagaagaagggacttgccagtatgcttgttcgatctggccttgaagtggcagaccagttaggtattgatgtcttagtggtggctaccggtcgacgtggccagggtctctattcgaaacatggatttgagattctggacgagaagagccagagcatgagtaaatttggagtcgatgagatgtatgaaactttcgtcatgatgcgcccagctcagaaatgatggngagaaatgttctgaatatctttacgcattcactgccccctagtcagttgcctactagcaatttatattgatacatcggcctctact

SEQ ID NO: 58714 - DNA, 890 bp, Triticum aestivum
  Clone ID: PAT_TA_58714
gccggccggttcgggatgctaccaacagcatagtcaaacttggtataattgattctaggttcttgaccataaccaatcacagtctttgtgcaactgtatactataccatggcaggtctttcttctcctcgtccctaacaaaaatgacgatacccgcgcggcttgttgcagcttccagtaccacagacgaaacaaataaacgagtacggtcaacatgcatgcgttgggagatcttttcctttatgtctggcctttacgcaagctttccgccactcttctctttcgacaattcatcctgaatcacacatatacatctcgttagggctgcatgtaacatgcttgctacgatgacaaggcacatcactgcgttgtttctttatttccttccgatatgtcttgctgctagcaagtgctactatcccaacggtgttgaagccaatgatttcccttgcgacccggatgcggatgaaagtgtctgctgttctggagggttgggtacagtatgtctatccaataagctgtgcattggggcggacggaaacaccttgaggggctcgtgtacggataagaactgggcgtcgcctgagtgtgctatgttctgtctgggcgcggacaagggagggacagatttgatatcgtgctcgaacgtcacaggtagcgatacatcgttttgttgtgatcacaactcaggctgttgcaacagtggtgtcgggagattcgctgtcctcccatccaatccaaaagtatgggcgacatggaatcgaaaagcaaatgagtacaccgttgtagggacgatattcactgacgaatccacatccacaactggcgttggttacttcagacacatctttcttcggtcacagtcgcaaacatcacacatgccactacgac

SEQ ID NO: 58715 - DNA, 803 bp, Triticum aestivum
  unsure (1)..(803): unsure at all n locations
  Clone ID: PAT_TA_58715
gccggccgggtcgggaagctttactctcatctactcttgactctctaaagttgatactcatcaatcgaatattcttgctgagaaactacaaaccacaactctactcagcttacattcatctcacttacaccaccaccaccacaatggcaaactacatcctcactgaaccctccccttccacaaacgtctttgtgcgttccggtcgaggtggctacggcaacatctcgcgtgcctcaaagccaacgaactcttcgacatcccgcaccgtcgcaaccactaccaccacaccaaccgctccctcacgccgcttcttcagcggaatcggcggagcaggcaacgtccaccgcgccagcgagcagccatctgtgtctctcgacgacgagtacgaccgcatcgctgcccgtgatcagatggccgccggacacgtcggcatcggtggcgcgggcaacgtcttccaccgcaaggagagcgatgctggatcagacattagctccagcagctctctgagctcaaagaccaagctgtgggctcgcgtgagcagcactttcagcagggactaggaggcgattctttctatcttgttttgttactgtgccagggagaagaaaggatccccctgtacttgaaactagcgatcggcgtttgatgaatgggctttgacattttttctgtttggtacgagaaagtaaaaataagggcggngacctcagagcaaatgggaatggcgaaaagagccttggatatatgtacggttggcattgatgagtggagattggcgatatgaaactgcctctcttcatccc

SEQ ID NO: 58716 - DNA, 838 bp, Triticum aestivum
  unsure (1)..(838): unsure at all n locations
  Clone ID: PAT_TA_58716
gccggccgggccgggatcacaatcaactcatcaatcacaacaaccactcttctctcttcctcaccttctcctcctgccggtcaggtcttttaattacaactactttttactcttttacctcttctctcttaatcgaaccaactccacccttctacctcaccaacacctacaataatcacaatggctcccatcaagaacctcgtctgggcccttttcgttgccgctgacctcgccgctgctcacagtgtcatcaccaacgctgtcggcgatgctggtggctctggcatggctctcggtgttgacacctccactcctcgtgatggcacccgacgccgtcctttccagaccgatgctactcgcttccgtggcgcctccgctgatactgtcggcgagactctcgctggtggtgacaaccaggttgagcagggtaccgccgacatcatggaggagacaggtgatcagcttcctcaagtcaaccctggtggtagccttgagatgactgtccaccaagtcaactctgatggtgctggcccttacacctgtatgatcaacgccgatggtactggcacctcttgggagaacattcccgtcactaccaacctcgagggcaacgaccgtggccgcaaccgtgatggtgagatgggtgatttccctctcgtggcctccatccctgctggacagacttgcactggtacagttgctggtgaagacaacgtctgccttgttcgttgccagaacccggnccgtgctggtcccttcggtggtgtcatcccagttcagatggctcagacaaacaacgccggcaatggcaccgagacagacgctggtaatggcactg

SEQ ID NO: 58717 - DNA, 759 bp, Triticum aestivum
  unsure (1)..(759): unsure at all n locations
  Clone ID: PAT_TA_58717
gccggccgggtctcgagacgtcttcttccttttatttattccgttctgcttttgtcttgttacatcttgataccccacaatctccctcgatatgactgtgacacaacttagatccgctggccggctggcccagcttgccggacatgtgaatggcgcacgacagttctctacgaggccagctctgcgcaaggaacttcaagacgcctatattctgagcgctgcccgaacccctaccgcaaagttcaatggctctttcctatcagtatcagctcccaagcttggcgctgttgcgatcaaggccgccctagaaaagtcaaaggtccccgtcgagaagatcaccgatgtgtatatgggcaacgtccttcagggctctgtcggtcaagcgcctgcccgacaggctgtcatcttcgctggtctacccaaggagatcgaggcaacaacgattaacaaggtctgcgcatctggactaaaggccgttactttggctgcccagaacatccaaatgggtctctccgaggctcagatcgccggtggaatggagaacatgtcccaagtcccatactatgtgtcacgcgccagcggtcttcctgcctttggccacgtcaagatggaggatggcttattaaggatgtnttgaccgacgtctacgaccaattccacatggggcactgcgccgagaacacagntaagaacccacacattacccgagagcagcaagatgagntacgcattcagtcataccngcacgcacaaaaagcc

SEQ ID NO: 58718 - DNA, 790 bp, Triticum aestivum
  unsure (1)..(790): unsure at all n locations
  Clone ID: PAT_TA_58718
gccggccgggttgggtaccccgcacggcgccaacccctgcttcgagcccacggcggggcaccacctcttcgacggcgacggcatggtgcacgccatccgcatccgcaacggcgccgccgagtcttacacctgccgcttcaccgagacggcccgcctctcccaggagcgcgccgttgggaagccggttttccctaagaccattggcgagctccacggccactctggcatcgcgaggctggctctgttctacgcgcgcggcgcctgcggcctcgtcgacccgtcccacggcaccggcgtcgccaacgccggcctcgtctacttcaacggccgcctcctcgccatgtccgaggacgacctcccgtaccaggtccgcgtcaccgccgacggcgacctcgagaccgtcggccgctacgacttcgacggccagctcgactgcgccatgatcgcgcaccccaagctcgaccctgtctccggcgagctcttcgcgctcagctacgatgtcatcaagaagccgtacctcaagtacttctacttccacgccgacggcaccaagtccgccgacgtcgagatcgagctcgaccagcccaccatgatccacgacttcgccatcaccgagaacttcgtcgtcgtgcccgaccaccagatggtgttcaagctcgccgagatgttccgcggcggctcgccggtgatgctcgacaaggagaagacctcccgcttcggcgtcctccccaagtacgccaagcactcgntcgagatgatggtgggtggacgtgccggactgcttctgctt

SEQ ID NO: 58719 - DNA, 762 bp, Triticum aestivum
  unsure (1)..(762): unsure at all n locations
  Clone ID: PAT_TA_58719
gccggccgggcttcgtcacgactcgacacgattcattttaacgacatacgacacgccgaatctattcagtcttttgttttgacaattcgtcttgaccgcttggtcctattcaccgacaagctcggctgggctacagcacccgaagcctagctttattatattcctgtaactgagacctgctcatcacagactccttccatcatggctcccgccctcatccgcatattgcgcagtgcgccttcgctcacacaacacacccctagagctgccgaggcattctcttcactccagggacatctgctcgaggcttccaaagtactcaatgctcgagacgacaaggatgaagacagcaacaacagacacaagccgtctgtcgagcctgaatcaggctccttcgaccctcacgatatcaacaatgctggtttcttctttctcttcgctctgattggtgtcgtcttcgtttgcaccggtatctggtttttcttctgggccaagaacggtggtttccaattcaaggaggatgattgggatgactacaaatctactgtacttcgacgcaccggacctaacggcactattctttccaatgcgactcgaccaacaaacctcggtggtggcagcgtgtacaaggacgttgatgatgataacaaccgttgttacagagggcacgacacttactggtattacagctggagctagcgacatttatgcccngtgagaagcgtcgccgcaagcaggaaaagcgagatcgtgagcgtgcga

SEQ ID NO: 58720 - DNA, 619 bp, Triticum aestivum
  Clone ID: PAT_TA_58720
gccggccgggtccggaactatcaattgaagatgcggatggcaatgcagctgagaagggtgtggcgtatgtcgatgagtttatgcaactcaaggtgcgtgtcaccaaccgaacggctcagaaaatccaccccctcgtcagaatcctacctgcgctttgccatcggcctgcgaatgttggcctggagtttacacggaagctagcatggaacggtacattacaacagctcattccggtattggaaggacatggcagcgcagaggtttcagtgggcatgacagtgctctgtcgcggcgagttcgagatatcagcatctgtagaagaggtgcaggtctgggaaggacctagagttgcgcctacacgggcacgatcggagtcacagacgatgcaagatgctgctctgggtgtcaaggagagacgcatttggcatgcgagacagccttgtatgctgattacgagagatcgcaagtagatggaagaggaggaagggctttgacatggattgactgtaggctagtaatctagtcgatctgtactagatgatgaggatttatactataatgcgatgttgatacatagcgaataacaaggatagaaaaaaaaaaaaaaaaaaggccccta

SEQ ID NO: 58721 - DNA, 829 bp, Triticum aestivum
  unsure (1)..(829): unsure at all n locations
  Clone ID: PAT_TA_58721
gccggccgggttccgagatgttactatcatccctcacctatcacaactctcacaacaaattttatccaatatacagccctgatctctccaccttcagtatggatactgtcaatcaagccacagacaatccagccacggacaatctggaggccacgcattcacatcctggcctgtcttacccagttgacttcatcatgaatatcgagctccaaacttcaaatggcacagatatacctctgtacaataagactttggagattgaaaaattacctccatggatgcctgattacgcgaaaaaacaatatccatctatcacacgtaacgagggtgaaagagaagacgtctttgactccgataacgaggactactggttgttttacgttcacctccacaatgcagagcttgagatagccattggaggggaggaaccaatctatgcgacctcgagaccgaactggaacaagattagtgaaaacgacaagagcgtgcaagatgtgcatggccaggacggtactctttaccagttgcgttggcaatatggtgattcgtatgatcgttttgtggccgttagggcacccaagatggataacccagctatctctctacgtacacatggtcagttcggagccgtccactgggtcggactcttcaccaaaacaggtgtcagcaacacaaaccactttatcgcagtacgaacatccaatcgtctactccctcattatgccgagaggaccaagaagtaccctggttatagaaacgggtacctcgaagatggtcccgncaacattctggattgcgcctttgacgtgttcccaagcagctgtacgga

SEQ ID NO: 58722 - DNA, 771 bp, Triticum aestivum
  Clone ID: PAT_TA_58722
gccggccgggttccgcattccaagtccacgatggactgacacgcaagcaaccccgaacagcgagcctctccgatagatcacgagataaatttcctgaaacgcgttcagtcaaaacaacctgggaaggtctaaacgactggacgagttccttcgacatcgtccgctgcaaatcagcagttagtgatggccttgcttgtccgtagaaaggcagagctggcccattcgtaccacgatccttcctcgacgcttttaaacaagagatacgaaatacactgggtaggcgaaaggtaagagtagggaagatgctaaaagcttcctccatgccgaagctattcgagtaatgaatcaaccggactcgtcgcccacatgcacgaccgataatacatcttgatattatactgcagagcgaccgtgagctttgggaggacttggatcgaggcttgaccaggctgcatgatgtctagcataccatcggtatacttcggattccaaaacaccaagcgaacgatagccaagttgacctcctaggtctaacggtgcagaaataaacaacctaagaagcataatctgattagtatacgctgatctacttcgtcccttatgcttgtcgcggccaatgtttctgacaccccaaggcatgcctacgttgccttcgtcactctgtattcacatctagagatctgttatttgcatgctatcgcatatctatttagtagagtacacaatcttagagacctcatctctccaaaaaaaaaaaaaaaagggccctaa

SEQ ID NO: 58723 - DNA, 491 bp, Triticum aestivum
  Clone ID: PAT_TA_58723
gccggccgggtttgataccaatagtatctcatccactaaagacaccgtcgataagatgacagccaaatggatgaagaaacgggttctgcgcctcagagcagagaaaaaatgagggcgatccaaataaaagatcgcatctcacctgacttgactcattatcatgatgaacgacctcgcacgcctcgcgataccttggtcgaagcagggaacttggcgttctggcgcctctgggatctcccgcaacgcattgagatgggatttgactattagaaagtacgtcagggcggctgaaccccgcacttgagcggctgaagatggcacacaatgaatattatggaggatgacattatgacaatcagatggtcatgcacaagggggagctgcatctaccactatcaaatgctcaccaacaccaagcatcacaacaacattctcagatgaagaaatacagatattcctctgccgaagaatgaaaacaaaaaggcgcctac

SEQ ID NO: 58724 - DNA, 731 bp, Triticum aestivum
  unsure (1)..(731): unsure at all n locations
  Clone ID: PAT_TA_58724
gccggccgggttgggctctcctcgctgaggagcccaaccactgatttcccaaattctcattcctgcagggccttgactccaggctctccagacaagaataacaacgcccaatggactacttgtctgagaaaatgaccttgtcggattcgaacgcaaaggctattcaattgcatttgttaagaacaataacagagggttttgcagagaaattgaaagttggtagtggtggctatggagaggtttacaagggattgctcaatggggatgaaattgctgtcaagaagcttttccccgttcctggacttaatgacgaggcatttgataatgaatttcgcaaccttaagaaggttcaacataaaaatgtcatacggatgattgggtattgctatgagatatcacatagagatgttgagtaccaaggaaaattggtttgggctcgagtaatagatcgagctctctgctttgaatatatgaaggggggaagccttgtcaaccatatttctgatgagtcatgcgtacatgattggccgacaacatacaaaataattcatggggcttgcgagggcctgcactacctgcataaaggacaagaacagaagatttttcatctggacttaaagccagacaatgtattgttggatgaagattttgtgcccaaatagggggggatttggttttgtcaaaaactctttgngtcttcatatacccannccactagcagtaagaaagga

SEQ ID NO: 58725 - DNA, 706 bp, Triticum aestivum
  unsure (1)..(706): unsure at all n locations
  Clone ID: PAT_TA_58725
gccggccgggctcggacagtcaagcatttgatcaaccggaatccggggacccaaatctttccccagatcccaaagcttgtcagatctgccttcacggctttatcttggcttgctttaacaaacctctcttgatcaaccgggatcatgccgatgcccagagaggacaacgaacctcccaacacggaggattacatcaatgacagccatcggaactctaacagcaatggtacctttgtcaacgacaacccaaacaacaacattggcggccaacgccgcgtctccaaagatactctgctgagcaaccctctggggagcatgacccgagcagagctccttgccgacgctgactctttcatcgacgccaggggacttcaagagcatcacgaggacttccgaaagggagctctggatgctcaagtcaacaataccccaggagcatttgagaagattgacattgacaccgaggaggaaaaggctgccctccgaaaggaagagacttctcgatggaaccaaccctttgccttgtacttcctctgcacacttgntgccggatactgctatcgtgcacggtatggatcaaaccgctgtcaatggcgctcagatgttttattctgacgagattgagatcggaaacgaatggatgcaaggcttcaccaacggagatccttactctgctgcgctctcatcggatgctggactagtccta

SEQ ID NO: 58726 - DNA, 812 bp, Triticum aestivum
  unsure (1)..(812): unsure at all n locations
  Clone ID: PAT_TA_58726
ctgtgcggcgctcaggcggcggctcggatctcacagatctcattaattcttccctatggcttccgctcttcttcgatcaactcccgccctccgcgctggcctgcgcgcccgctctactcccctcgcggctatggctaccaccagcttcgtccgcggcaaggccactctccccgatcttccctacgactatggcgctcttgagccctacatctctggccagatcatggagcttcaccactccaagcaccaccagacctacgttaccggcttcaacaacgctaccgacgccatcgccgaggccaaccacaagggcgacgccaaggctgctgccgctcaggctcctctcctcaacttccacggcggtggtcacgtcaaccactccctcttctgggagaaccttgctcccaacggtaagggcggtggtggtgagcccgagggcaagcttctgacttccatcaacgaggactttggctccttcgaggccttcaagaagcagaccaacgctaccctcgccggtatccagggctccggctgggcctggctcgtcaaggacaagaacgctggcactctgtccatcgttacccgacccaaccaggaccccgtcaccggtaaccttgagcccctcctcggcattgacgcctgggagcacgcctactaccttcagtaccagaaccgcaaggccgagtacttcagcgccatctgggacgtcatcaactggngcactgtcgccaagcgatttgagaagaaatcaatccatattagtaaagtgaagagcttgagtggagataatgtcaaatagcgatgacttgcgc

SEQ ID NO: 58727 - DNA, 329 bp, Triticum aestivum
  Clone ID: PAT_TA_58727
gccggccgggtcgggcgacgaggtggtgcgcaagtggactggtggcggggacgcctaggtgccggcacgccctgccatcatcatcaatggaccccgctcctccatatgcttgtacggcttgctggtttcttttcgtgcttgttcatcgccatcattgtaggccgtagctacttaagcgcccaaattattgttaggcagggcatgcaggtcccaggcatgaggaggaaaatattcttattttagatttgtataattgaaggaatgcacattggtatatataaacgaaatcaaaactcttctattaaaaaaaaaaaaaaaaaaggccccta

SEQ ID NO: 58728 - DNA, 787 bp, Triticum aestivum
  Clone ID: PAT_TA_58728
gccggccgggttccggatctattgttgacgtgacgatttactacttgatcacgattaaatcctttcttctacgggcctcttttatttctacgagaatagaagtctaacaacagttttccggccattttcaaagatcgactttccgtgcgcgcgacagcactcgaaatcgaaaacacccccacctcttcttcttgacccccgaccgaatacctcactcagttaagcactcgacaataccgccaatatgtcgttaacaaactgccgtttttacgaggagaagtatccggagattgacagcttcgtcatggtcaatgtcaagcagatcgccgagatgggtgcctatgttaagcttctagagtacgatgacatcgacggcatgattctgctttctgagctctcccgaagacgtattcgatctatccagaagctcatccgagttggtcgcaacgaggttgtcgtggtgctccgtgtggacaaagagaagggttacatcgatctttccaagcgacgagtctctcccgaggatatcgtcaagtgtgaggagcgatacaacaagagcaagatggtccactcagtcatgatccatcttgccaaggccaccgagatccccctcgagaccctataccaggccattgcttggcccctgaacaagaaattcggccatgctctcgatgctttcaagctctccatcaccaaccctgaagtgtggaacgatatcaccttcccccgacgaggtcaccgcccaggagctgaagaatacatcggcaagcgtctcacacccaaccca

SEQ ID NO: 58729 - DNA, 449 bp, Triticum aestivum
  unsure (1)..(449): unsure at all n locations
  Clone ID: PAT_TA_58729
gccggcctggcctcgttgaancttcaggcgggcgttaaagacagtcatgagaatcctagcgctccaattcgctacttcggccggtatcaactcgaccattaaagacgagcatatacgagacgactttttgagaaggtttggcctagattcccgcgatatcaataacgagcagtacatcatggcgagtctgtgcatggacgttaaatgcctggatcaggcctttaggacatttacggaaaatgtagactggattgatgaacatgagggcttaggtctcatgaggggggtggaggcagcgtgagtttactctaggagcctaacaaggccggctcttcaaggccacatcaggaagtcaaccccctgtcaaaatcgagctagtccatttttcgaaattctcaatatgaaatagaacgatttacttctaaaaaaaaaaaaaaaaaaggccccta

SEQ ID NO: 58730 - DNA, 769 bp, Triticum aestivum
  Clone ID: PAT_TA_58730
ccggccgggccgggaacgaacgccgcgcggcctacgctcctctcttccccagacacgagagggagagggaagggagctttgtcacgagaggaccgacttctgccgctccgccgcaaagcctatatagataggctcccttcaccccctccctccctccctgctccgccgcacccttcccgaggcaggcatcaccgtggacgcgcgcgcgctggtcaaatcgaggagggctcgggaaaccttggagaagggcggcggggacggtaggtactcgccatggccggggcggaggtggtggactccggcgagaagcgcctcaatgagctcggctacaagcaggagctccggagggagatgacgctgttcaagacgctggccatctctttctcgacgatgacgctcttcacggggatcacgccgctgtacggcagcagcctccagtacgccgggccggccagcctcgtgtggggctgggtcgtcgtctccttcttcacctggttcgtcggcatcgccatggccgagatctgctcctccttccccgcctatgcaggatcccaggtgctgcagagcataatcctgctctgcagcggcaccaacaaaggcggcggctacctggcccctcgctggctgttcctcgtcatgtacctcgggttaaccttcatctgggccgtgttcaacactttcgccttggaagtcatcgccttcctcgacgtcatctccatgtgggtggcaggtgggtcggcggcacggccatagtgatcatgctgccgct

SEQ ID NO: 58731 - DNA, 695 bp, Triticum aestivum
  Clone ID: PAT_TA_58731
gccggccgggcctcgataccttagaaactcacgccggacacacaacaaactcatccataattccagatccgatctcccagagcctgcaccgtctgaactcccccagaactccagatcgacctcgcgattacgtttcttgccacgtgtgcgcgcacatccatggcgattgccgccggaggatgtgtgccgctgatcctgcgcggcctcgttcgtcttcagcgtggccggcggcgtctcggcgacgtagggtgtcgtcgtcagcgctcgcccgatggtgcgcggcgacgccgcaaaagatgccggcggcgaccccggtggtgcttctgaaggaggaccactaccgaacgctgcggctgacgacgatatccaccacgggctatgccaataagggcttacaccgcctcgagctgcagcaccacccggtacgtctcgagtcaataaaacagcgaccgcgtgtacttccagcgtatcaacgcgaaggaccggacgatgacgagcaacatgcacaaagcggatgctatgctccagtactgtggccgacgctaccgactccccgacgaggacctcgaacggtaccgccgctacctcaacgacgacgaaaaggacgactggttccccgatctctgaaacgaagccctacacgattcttgtcatgccagaggcatcatcactgtaattatctacatgatacctcg

SEQ ID NO: 58732 - DNA, 673 bp, Triticum aestivum
  Clone ID: PAT_TA_58732
gccggccgggtcgggaaaaaaaaagaaaaaaaaaaacaaccaccgccgccgccgccgccgccgccgtctcgcgaccaaacgacccccatggcggccgccgcctcctccctgcttgccgccgctgcatcctccagttcccgagcagccatctccgtccgccgcccccgcgcagcttctgccgcggccgcggccgccgcctccatcccctcgtcctctcgcacatccttcaccccgctccgcgcctcccccgcgagggccctccggagcctcgtcgtcgccagcgccgctcccgcgatggagccgccggcggtgtcaagagtctccactgtggtcgacgtcgacctcggcgaccggagctacccgatctacatcggccccggcctcctcgatgagcccgacctgctgcagaggcatgtgatcgggaagagggttctggtggtgaccaacactaccgtcgcgccgctctacttggagaaggtgacctgggcgctcacgcaccaaaaccctaatgtgtccgtcgagagcgtgatcctgcccgacggcgagaagtacaaggacatggacacactgatgaaggttttcgacaaggcgggtggagtcccggctggaccgtagatgcacattcgttgcgctaggtggcggtgtcattggggacatgtgtgggtttgcagct

SEQ ID NO: 58733 - DNA, 694 bp, Triticum aestivum
  Clone ID: PAT_TA_58733
gccggccgggctgggattcttctgatcctcattctcaccgccgagtgacgaagcaaccagcaatcgtccattcttattatgacgcccaagaagaccgaacacccgtgatccccaggagagacttctccatcggacctttcgttctcgatgtggagatgcgcttcggtgttgccctgtatcttcgcctccttcgacgatatcttcggcgaccgcaccgatgtgatcggcctgcgagactatcgcccgtgtgactggcgagatgaagggataggccgaccgtgaagagccctcgccctacgctgccatgttggctgcccataacagctctgcgcgctgcaaggagtttgcgatctacgctcttcacatcaagatgcgtggcactggagcgaacggaaccaagacccccggtgaccggtgaccaacccgctctgcgtgaccgtggccgcgatggtatgaagattgaacgaattgaggacgtgacccgtactccttccgactctacccgcagaaaaggtggtcgccgttggtcgtcgatatcagagctgcttacctgatgctgacttgtgattgaacgggtatctcgctatctggtgtctctgtggcgttgagaatcacgaagagaacggctttttcggctggtctacaatctacgctgcacaggctgtgcaggttatgggtatcgacgttatagaca

SEQ ID NO: 58734 - DNA, 722 bp, Triticum aestivum
  Clone ID: PAT_TA_58734
gccggccgggctgaaaacaataaccaataaccaggcccaaatccacgtccccaagtcattgcccgcctcttctgctcgtggtaaataacttaacccaacaaggccccaacttttgacttttcaacttcccaattctcttacctttgatccttcagcttcggaatctccttcttcttccagataccccagatttcctttcctttcccatcatatcataacatcaaaactgcccatcatgtccaacgtcgaggtcacagagaacggggctgctcccaccatccacaagcctcaccacaatgctgctctgccttaccagtccgtcggcgactttctctcaaacaccaacaacttcaagatcattgagagcaccttgagagagggcgagcagtttgccatgcctactttgacacagagaccaagatcaagattgccaaggctctctctgactttggtgtcgagtacattgagctcaccagccctctcgcctctccccagtcccgcaaggactgtgaggagatctgcaagctcggcctcaaggccaagatcctcactcacgtgcgatgcacaatggaagatgccaaggtcgctgttgagaccggtgtcgacggtgtcgatgttgttattggtacttctcagtacctgagagagcactctcacggaaaggacatggcttacatcaaggagtctgccattgaggtcatccgatacatcaagagccaagg

SEQ ID NO: 58735 - DNA, 774 bp, Triticum aestivum
  unsure (1)..(774): unsure at all n locations
  Clone ID: PAT_TA_58735
gccggccgggtcgggatttctccttctttcttccatcctaaggtcccagatccctcgatcctgttcttctttccattcaattgacattgtcattcttgacattgattcagaggcaaagccctccaaagagtccgacagcttcttatcgttccctctcgtcgacgctccccgcaactcttatcaacatggctatctacagctccgtcccgccacctgagcagcaaccgactacgactactccaacccctactgcgacaaaccctcctctggccgctatccacgttcagtcgcctccgacaccagtcaagaattcttctattgatattgatgcttggacactctcggcccttcaatctctcaacgtctcccctgtcgcacgtggaactggtatccctctcactatccctatcgatgaagctgtcaaagttcaacccaagtctcccgagcgcaatgtcgacttcgacgagcgtgaggcgcccacatcaattccaaagcgccctctctctaggagggacagccagcgaaagcgcgatctggttctgaagggcaaggagggtagtcgccagcgtcgtcgctgggagaatgaccgtttgatgcacgttcccaacgttcagcctcctctgccttccgattacgaagtccaccccacgcatactatccatcgagtgccctatcagcttgctcaanttctgggatcgtggcgtgcgccagcgcgtcgagggataaactgctcgacttcaagctgagcgcaagaagcacagctncagtcaggta

SEQ ID NO: 58736 - DNA, 828 bp, Triticum aestivum
  unsure (1)..(828): unsure at all n locations
  Clone ID: PAT_TA_58736
gccggccgggctccgactcttgttgttgcaagtgtatagatcaatatggctacgtttactcgaattgccgacgatgagcgtcctaccatttcggttgaccccagtgctgtcatttccaccattgacgataatatctatggtggtttcacagagcacatgggtcgctgcatctacggcggcatctacgaacctggcaaccccctgtcagacgagaatggcttccgaaaggatgtcattgaggccatgaaggagctcaactgccctgttgttcgatatccaggtggtaactttgttgctacataccattggcaagatggtattggacctcgagaaaagagacctgtcagacctgagcttgcttggattggaaccgagagcaacgagtttggaacagatgagttcatgaagtggtgtgaggttgtcggtaccgagccttatctatgtctcaactttggaactggcactctcgatgaagccctcgcatgggtcgagtactgtaactctgaccgaccaagctactacgccaacctccgtcgtcaaaacggacgtgagaagccatacaacgtcaagtactgggctctcggaaacgaaatgtggggagcatggcaagttggccagatgacaaaggaagactacgcaaagaaggcctaccaatgggccaaggccatcaagctcctagaccccagcgtcaccctgattctatgcggcgagacaggtcacagtacctggngactcgtacgttatcaaggagtgcatcaagtttgacgtgcacggcttgggcggtagcacaactgctagtctgatttgacagcacagtattcacatcta

SEQ ID NO: 58737 - DNA, 734 bp, Triticum aestivum
  unsure (1)..(734): unsure at all n locations
  Clone ID: PAT_TA_58737
gccggccgggctcgggcacttctggagcagggcgttattcccatcgtcaacgagaatgacactctcgccgttgccgaaatcaagtttggcgacaacgatactctctccgccatcactgccgccatgattcacgcagacatgttgttcttaatgacagatgttgactgtctgtacgacaagaacccccgcacccacccagatgccaaacccattgaggtggtcgaggacactgccgcccttcaagctgatgtttccagtgctggctcatccctcggaactggaggcatgagtaccaagattattgcagccagattgggcacttctgcgggtgtcacgactgtgattacaaggtcatctaacccagggaacgtgcttcatattgtgcaatacctccaatcaatacaaagagggaacacccctcccagtcctgatgagcgcgccgaaggtctgacacgttcagcgtcagctctgtcactgtcagcctccaatgggaaatggtgccccctggccccccctacatacccgattcgtccctgccaacaaccctatccgggaccgtcacttctggctgcttcacaccccctatccccacggcaccctctacattgactcgggagcttacaaggcacttgttgngaaggctggcctgctccctgtangcgtcgttgacgtcgagggtacttttgccagcagggagtagtgcggcttgtgacagtcaagagacgatcaactcc

SEQ ID NO: 58738 - DNA, 740 bp, Triticum aestivum
  Clone ID: PAT_TA_58738
gccggccgggtgccgggacatcacataccaccatggacgcgtcggccgcctgcgagatcgagcgcctgccggaggacctcctgatgcacgtgatatcgctcacgtcgccggcggacgccttccacgccaccgccgtgtcccgggccttccacgccgccgccgactcagacaccgtctggtcccgcctcctgccgcacgacctcccgcagttcgccaagagggagctcccccgcaagccgccgtcgaccaagaaggggatgttccggcgcctctccgacgaaccagccctcctcccgggcaagtatgtgcgcatgcagctggacaaggccaccggtgccaagtgcttcacgttttcggccagcgcgctacagatcacccaagctaatgatgcacacacgcccttgatacgtgtaggttcagtgccgggctacagcaaaagaggcaaaaggttctcacaagcagctgacatcggccatgttaacatactcgagatatgtgccaagatacaaagaaacatgctctctcaaaacacaacctacgtggcatacatggtgttcaagctaggacccagattttacagcttcgatttcccgtttcaagaagcctcatttggcattgctgggagccagtcgactcgccaggtttgcctgcaaggctatgtcgaggacggtgatggagccgatgttccacctcgggagcacatcgtgccaagttcttatcatatatataaatcatgactc

SEQ ID NO: 58739 - DNA, 821 bp, Triticum aestivum
  Clone ID: PAT_TA_58739
gccggccgggttccgggcacgcccggttcgcccgggagctcgcgtcgtcgggcggccgcaccgtcgccgcgccaacccggaaggacctgccgaacggcggggagtacatcatgacgctgtccatcggcacgccgccgctgtcctaccctgccatcgccgacacgggcagcgacctcatctggacgcagtgcgcgccctgcggcagccagtgcttcaagcaggccgggcagctgtacaacccgtcgagctccaccacgttcggcgtgctcccctgcgacagctcggtgagcatgtgcgccgcgctggccgggccgagcccgccgcctggctgctcctgcatgtacaaccagacgtacggcacggggtggacggcgggcatccagagcgtggagacgttcacgttcggttcgacgcccgcggaccagacccgcgtccccggcatcgccttcggctgcagcaacgccagcagcgacgactggaacggctcagccggcctcgtcgggctgggcaggggaagcatgtcgctgatctcgcagctcggcgccggcatgttctcctactgcctcacgccattccaggacgccaacagcaccagcacgctcctcctcgggccgtcggcggcgctcaacgccaccggggtccgtacgacgccgtttgtggccagcccatcgaaggcgcccatgagcacgtactactacctgaacctgatgggcatatcgatcggcacgacggcgctggccatccatcccaacgcgttcgccctgcgggccaacggcaccggcgggctcatcatcgactccgggacgacgatcacgtcgctt

SEQ ID NO: 58740 - DNA, 703 bp, Triticum aestivum
  Clone ID: PAT_TA_58740
gccggccgggctctcgattgcaaaccagacaaggatatgaaatgtacatttgttcagcacgatctccgtcaagaccatggccctttggtgatgaggagtttgacttgatcatggtcaaagacgcatgcctgatggttccaagtcatgtttaccaactctttatcgaagactatctccgcctgctcaagcctggtggtgtgctggaaatttgggatagcgatccaacatttcgcatgttgcgaccacatgtcccaagcgcattgccagggtcggaagaggcagaagagcatgaggccgcacttgatctaggcgctttcctcatgacatcaaaaaccccactgtctgcgccattgaactcattcctggttgaatacaacacatggctgtcgcgaactcttgaaggccgacaattgtcgcctgtgccgtgctctctaatcagcgcagtgctccttcaagagtcagaagacctgatggatatcaagtcgaaacgtctagcaattcctctgagcgaagtccgatgggagcgcgaaggtgtcggcggtgttgtcacaaaggatggcaagtcgtatgtggagatgaaggccaagtcagcaccaaaccaaaaggttgaaaagaagaccctgacccctggacaatctgcactacgcaaaacggcgcttcttgacggttgcgcaaacagtggtcggcactggagccaattctt

SEQ ID NO: 58741 - DNA, 288 bp, Triticum aestivum
  Clone ID: PAT_TA_58741
gccggcagggcttcggagtgcgcattggctgtctttctatcatccaggcttggtccttgaagacggtgtctcgggcaccatagaaaaaccgcatgaagttatttgaaacgccacgatatgtggtatgattagcatattggatttagcgatttggtatatggagtttttgcatatcattatggtcctgcgatgggcagatagaccaggaatgggcgttatgattcgattgaccaataaaaaagtctacacttgttttacaagcaaaaaaaaaaaaaaaaaaggccccta

SEQ ID NO: 58742 - DNA, 745 bp, Triticum aestivum
  Clone ID: PAT_TA_58742
gccggccgggttccaagctttcatctcttctgcattaaacagcagaatttgaaggatttaataacctccactcctcctctttctctctcccaactcaacagtctcctccttcgacatcaaaccaccttggctcaagcctgcaccgaagcgagacgaatccatccgcctaaacccaggtcgccgttcgcctcccacctgccacctccccaccttacacaacaacggcagactcttcgcccatcatgaaggtcactttcaaagatctcaagcagcaaaagtttacgctcgatgtcgagccctcagagctgatctccgccgtcaaggagaagatttccgccgagaagggatggcaacctcagttgcagaagcttatctactctggcaaaattctcaaggacgatgaaactgtcggatcctacaatatcgaggagaagggcttcgtggtctgcatggtgaacaagcccaagcctaccaagcctgccgaatccagcgccgctcctcctgctacacccgccgctcctcctacccgcactcccgcagccccagctgctcctgcgcagtccgcatcccagcaggctgctgtgcccgccacacccacgcctcagcgatctgctgatgccggatccgaagagccttcgggcctggccatggggtcccagcgtaccgaggcgatcgcgaatatggaggctatgggtttcgagagaatcaaatcgaggcggccatgcgggctgccttcaacaccccg

SEQ ID NO: 58743 - DNA, 793 bp, Triticum aestivum
  Clone ID: PAT_TA_58743
gccggccgggctgggaacagctgcgttattttgcttcaccttcatcatcatttgttttagtaacggctgtaggttaggtctttgttaatcgcggctcgagcttagcgactcagttacgtcattcaactttcctttttaatagagcgagttctagacacagacaaaacaccaaagaaagagctggtatagaaagaagcgatagaaaaaatggctgagaattacatcctgcgcatcacagctggtcctcattatgacctgagccaacaggccgaggttccagtcaacgtcgccaagcccaccaccatcaagagcgaccgcgctgacattgaactcaacgtccgcatcaacgattacaagggtctgccaagaaactcaccatcaacatctccctacttttcaactgagcctcatgcctacaaccaggatcaatacagtatttcattccgtttcacaccaaagaaaccttccagcagcgacactgatgacgtctccgggatcaaggtcaccgacttacaattcggcaatgactttgaccaccctattcgagaccgcctaccaccaggatttaatacggctatgggcatagttcgatggtggattgatcctggtctggatggcgatgcttacgccgataaaccttacttgtatggcccagcattgagctccttcaataccatccacgttggcgagggtgattttgatgaagaaagggcggactatggttcgaggaaggtgggtgacgagatggtcttgagccccgtgagaaagtgcgcccctctcacagcaagctcga

SEQ ID NO: 58744 - DNA, 752 bp, Triticum aestivum
  Clone ID: PAT_TA_58744
gccggccgggtcgggactcgttcgaccttcatcgcgatattgcattgcagttggttgttgacttgtattgattgtctcttttaacgtcgtctttatcgtctttaattctccttcacttgaccgttttacccttgtactcgagtaatcaacagacaagatggcttctgcagctgccgagaacgcttcaccgattggtattgccaatctgcccaaccagcgacacaagattgtcgcgaagcgtggcgccggcttcactattatggttgctggcgagtctggtttgggcaagactaccttcatcaacactctcttctctaccaccatcaagaactacgccgatcacaagcgacgccaccagaagcaggtcgacaagaccgtcgagattgagattaccaaggccgagcttgaggagaagttcttcaaggtccgattgaccgttatcgatacccccggattcggcgactatgtcaacaaccgcgactcttggatgcccatcatcgagttcctcgacgaccagcacgagtcttacatgctccaggagcagcagccccgccgtcaggacaagattgatctccgtgtccatgcctgcttgtactttatccgccctaccggccacaccctcaagcctctcgatattgaggtcatgaagcgcctctgttcgcgcgttaacttgatccctgttatcgccaaggctgatactctcagccctggcgacctggggcaagtcaagtagcgaattgtctctgtcatcg

SEQ ID NO: 58745 - DNA, 355 bp, Triticum aestivum
  Clone ID: PAT_TA_58745
tgtgcggcgctcgaggcggccgggctgggatcttgccgactcgtgtcattttcgatggacgccacagcggcctgagcaggaagcagttcctctgagttgctgcagcgcgtagtctgagagacaagcaagtacagcagccatgggggaggtcgcggcggagctgtacacccaggatggcaccatcgacatcaagggcaacccggccctcaagagcaacaccggcaactggcgagcatgcccctacatcctcgcgaacgagtgctgcgagcgccttgcctactacggcatgagcaccaacctggtcaacttcatgaaggaccggatgggcatggccaacgcggcggccgccaacaac

SEQ ID NO: 58746 - DNA, 785 bp, Triticum aestivum
  unsure (1)..(785): unsure at all n locations
  Clone ID: PAT_TA_58746
gccggccgggnctgcgatcaataattaaatacacaatatcaccaccttggcattgtcagttctttgattttcgtggccactgaacattgtgttctttacggtgcaatgagaaaagacaaagttaagaatgtcccaacgatcgaggctatccgatcgaaactcggtgtaggcgtacctggcgacaaggaaagcaagatatttcggagagttgtcagggagttccatcaagactacaagaccgccaatggtactccaggggctgtatttacacaatggacaaatcctacccatcaagacgctcttcggcgaatggcagaagagttcttggaggtgcgtggttgggcaaagcgattttggccagacactgcaggttcagggactgtcaaaaagctcaaatggtcggagaatcacattcaaatcatgagacacatgcgtcaattgtttttccgtcataaccaacaagttcgaaaggagcccggctccactccaagaaaaagaatggcgtctcggacgactccatgcccaagtcgaacaatcagcccaggttcgaccaggacaaccacgacccacactggagacgttactatgaatgatatgatggggcctcgacaccaagatgaccagtacgacgacattttccgtccctcnaatccgtatcgcgttccctcaagccccatttccacaactagcgaccgttcctgcacaatttttgacattccccaagattcccaccctttattaggccttnccaacgaaagttcaggtccaacttccagaccattagc

SEQ ID NO: 58747 - DNA, 819 bp, Triticum aestivum
  Clone ID: PAT_TA_58747
ctgtgcggcgctcaggcgccggttcggactaggatcccccttacattgccttcctatagtccctttccattttccttcttcgttacctgcactttgtatatctctctttgacatactttcaaacaagaaaccaaacgccctagcactcaaggttcacgatgtctgtaccagaagctataaaaatacccaattgggaggatgacatcctgcctctcatccagaaaccatattgggtcgctaaaaactctgaagctgctggtagaaaatgggtccgcgagatgctgtattggggcaactgggacctttccagctacgaagatgtgaggaagcgagcgccaggtatttacaatcatctccgctccaagtcaatgcctatcacacgcaatcccgatcattattggccagaagaaaccctcgaactttttcgactttgggccaacaatggttatatgcgaaataaacaggacactcagtcagttcaaagtcttgagcctgccatccctgagcctctggaacctccaatctcataccgagtgagaaaagatattatgagcatgtccagagaggagcttgttgagtatcagtctaagctggatgacatccttcatattcaagaggtttatcttgaagggaaaaagaccaaatggcaggaacttggattacttcatgcatattggtgtctgcactaccaagaagcgacgtttctttggcatcgagcatacttgagatacgttgaagaactgatcgattttcccatcccttactgggatggttatgctgaggaggcatcggtatcatcatcaaaatttgctggcattc

SEQ ID NO: 58748 - DNA, 691 bp, Triticum aestivum
  Clone ID: PAT_TA_58748
gtgcggcgctcaggcggcggctccgatcaacaaattcaatcttgcataccaaccaagctacaatcacagcaaaacacaaacaaacaacatcttcacaatgactacaaattcattcggatcagcccttccccgctttgacttccaccaacccccagcccccagattcacagcgagactggcccgctcattacccactgcagcgctcgtcacaacagcagcagctacatactgcctcacatattatgtcctaagacaacaatacacaactgtaaaagctcaacacaatcgggctgtagagacgttgaacgaaatgaaagaacgagggaataaaacagacgagtgggtgaagaatgatgcattatggtggacggcattctagacgggacatggacgggtttggcgttttgggacatcactatgcatttttgagatgggctattggcagggacatcacttcgacatacaattgagattgagaattgtatgacactacaattcgagttaacatgaatcctagcatttatatatgttggaatcagtacagatccgatgatcatctgcgccaaggagggctcaagaagccattcaaactccaagcacatcggcgaagagagagaaaattcatagaaaataagtattcaattcatcttccttcttaccaaagcaaaaaaaaaaaaaaaaaaggccccta

SEQ ID NO: 58749 - DNA, 555 bp, Triticum aestivum
  Clone ID: PAT_TA_58749
gccggccgggcctgcgaaaattacctatcacttcatccaaagtcaccgcattaccagtcccatctctgttcaaaatgcagcctacatctttcatcctcctgactctttctgccgtctctacagtcatggctggctgtaacgcgggggctcctttccagggcacttgtcttacatgcacctcggagtgtcacagcaactatggcggaccggaccgcaagtctgctcttcagcgaactggttgcatgacagcttgcctacttcgctgtgatgactgcaactaaggcggtcacgaaaaatctgcgacaggtctgccagtatagtgcgggtatatgtactgtcacagtacgatgtgtttgtggtgaaggcagccattctttacggtggaactgcctcattttcgggctataacgtccgacgaggagtgcggagagaatggacgctatctgctttcatcatccggagaacagtctagttaaatctgagatgaatagttcggaatgaaaactgatcatagaccaaaaaaaaaaaaaaacaatgacccctaaggccagcgga

SEQ ID NO: 58750 - DNA, 785 bp, Triticum aestivum
  unsure (1)..(785): unsure at all n locations
  Clone ID: PAT_TA_58750
gccggccgggttcgggcacccaagtactcgaatccntcggcagcaacaaaaaccctttctgtcttggtctcggctccaaaagcacggggaaatggcttcttctgcaccgccggcgccggccgagagaccgcacgccgtgtgcctgccggcggccgcgcaggggcacatcatcccgatgctcgacgttgccaagatgctccacgcccgcggcttccacgtcaccttcgtcaacaccgagtacaaccacgcccgcctcgttcgctcccgcggccccgccgcggtggccggcgtcccgggcttccgcttcgccaccatcccggacggcctgccgccgtctgacgacgacgtcacgcaggacgtcgcgtcgctgtgcaagtccaccacggagacctgcctcgggcccttccgccgcctcctcgtggacctcaacgcaggcggcccgcccgtgacctgcgtcgtctccgacgtcgtcatggacttctccatggaggcggccagggagctcggcctcccctacgtccagctgtggacggccagcgccatcagcttcctcggcttccgccactaccgcctcctcttcgcccgcggnctcgcgccgatcaaagacgtcgaacagcttacggacgagtaccttgacacgccggtggaggacgtgccaggcctgaggaacatgaggttcagggacttcccgagcttcatacgcagcccggcaccggacgactacatgctgcatttcgcgctccgtataacggagcgcgcgggcggcgcgtcagccgtgatcgtca

SEQ ID NO: 58751 - DNA, 669 bp, Triticum aestivum
  Clone ID: PAT_TA_58751
gccggccgggttccgatactccttcacgtctgagacgcacatactcaacctgccgctccatcctcatacctgctaccccaacacaatacgtcacacgacgcgagcccaatgccccataaggccgaaccacctgccgactcccttcccgatgaggtcgggagatgcctctcactgcttgactcttcatattgaggctgtgcatcctctgccctggatggaagaagaaggccctgacggggctcctgagcattgaaagcgtctgcgacgtagatggcaaactccccattgcaaaacgtgatggtgacggctaccgtggacgccctgactctcctctcgaggttgcacaactcaaggaagcccgccctgacatggcaacacgcgactgcctagaatcccgaccctgtgccgccctccacagacatacttccccatcgcccgccgaatacggaaccaaggatgtccgctgtaacctatcagaaaccggcggaggaatcctcggacgacagctcagacaagaggtccaagcatgatgacggactctccacaagatgactctgagacattgacgaagcagaatctgacatcaccgatgagtaggattgagatcgcgaacccaggtaccgcgaccaggaaaagaaagacggcggcgagggcgcaggggccgagccc

SEQ ID NO: 58752 - DNA, 813 bp, Triticum aestivum
  unsure (1)..(813): unsure at all n locations
  Clone ID: PAT_TA_58752
gccggccgggttcgggaatctcatatccagcagctgcctagctctacttactacctgcgcagtgttgtgtggtactgttgtaagtagcagggaagaacagttccgagtacacagcgtacttgtgcctgtcgatacctgctagcagcatctacatcgtgccaatcggaaagtaagtcgagagagatgccgatcgagtcgacagacaacgtaccggccgaccttcccggccacggccggacggtgtgcgtcaccggcgccggcggcttcatcgcctcgtggctcgtcaagcgcctcctccagaaggggtacaccgtgcggggcaccgttcgcaaccctgttgatccgaagaatgaccacctgagagccttcgacggcgccgccgaccgcctcgtcctcctccgcgccgaccttatggagcccgaaaccctcgtggaggcgttcacgggctgcgagggcatcttccacgccgcttcccccgtcaccgacgaccctgagaagatgatcgagccggcgatccgggggaccaagtacgtgatcacggcggccgcggacatgggcatncaagcgtgtggtgttcacgtccaccatcggcacggtgtacatgaacccccacagggaccccagcaagcccgtcgacgacacctgctggagcgaccttgaatactgcaaaaagacagcgaactggtactgctacgcgaagacggtggccgagcaggacgcgctggagacggcccggcagcgcggcatcgagctgatcgtggtgaacccgngtgctggtgctgggcccgctgctgcagccgacggtgacgcgag

SEQ ID NO: 58753 - DNA, 636 bp, Triticum aestivum
  Clone ID: PAT_TA_58753
gccggccgggtcgggatgagaaggacgctacagctacgatgatatcctcagcactacccaactaagcaaggaggtttcagaccaggcaattgctgttcttttgaaggcaaaggtactcatcatgtcaggtgctgctggtgaaaagccagggtccggcaaaactttcaaactcaactatgacttcaagagcaagaagattcgtattaatctgaacattggcggtgtcaaagaggccaagcaagaagaggtcgagaccaacaagacaatcgaggaggaccgaaagttggttcttcagtccgcaatcgtacgaatcatgaaggcacgcaagaagatgaagcacacgcaactagttagcgagaccatcaaccagatccggtcgcggtttgtgcccaaggttggcgacatcaagaagtgcatagaaattctgctggacaaggaatacttagagcgtctggagggtgacgagctagggtaccttgcctaagtcctgattgatggtgtcaagccagggtgactcagctatgctcctcgatttctaactcgcctcatactcaacttattatgtatattccagaggatgagtacccggtgatctcagcacccatgagagactctttcttgtttccttgagcggac

SEQ ID NO: 58754 - DNA, 472 bp, Triticum aestivum
  Clone ID: PAT_TA_58754
gccggccgggtccggatatctctccctctacattctcttactattataccctctgctttctgatacccttcctctctatatcatataaaaattcatacatcttctctctcatcagtcgaggtgcccactccacgaactggaacataacagagctacctggtgctcctcctgcactcgaaatgggctgaggaccaagacatcctcaacgacgaggatatgatgcccttcatccgcttcggccacaactgcgactgagaatgcatcggagaaggatataagagctatctggcgtcgctgacaccatagataactttggcgagaggtacaatgctggatctccccaaccgaggtagacttctccccaaggtcgacgagcttgacccgaacaacctggagctcctcttccgcgataaggaccttgagaatggaaatggcacacgcaaacaacacgagaataactgggccgttgaag

SEQ ID NO: 58755 - DNA, 783 bp, Triticum aestivum
  unsure (1)..(783): unsure at all n locations
  Clone ID: PAT_TA_58755
gccggccgggttccgcaaaggatctggatctcgaaatcattctgcccctctggctgtctctttgtgttccagagcccgactacccgcgaggccgctcgcgctggtgtaatccacggacctgtagctgccgtcagtgccagagggacaactgactttactcagcccgaccccgaaatggcacagtcacttgacctcgctcgagaaatcgtagcagctctcatcacggctcagcatcgtgcacgtgaaggaaagacggagaagcgttttggtgagggagagtggtggacaaccgagaagcgatggggaggtggctctggaggccctatcggacgtgagattgagaaggattccgtgcaaggcgataaagacgcgaaacccagcgacgaaaacggtctgcctatgccactcgccaagaaagctcgcaagaacatgagcatctatgacaactaccgcatgattcgacctcctgcggcaacatgggataagaaggctcagtatgaggccatcggaagagttaagggggctgactacgacgatatctttgtggtgagctctttgtttcaccatgtctcaattctccgtgtcagagtaccaaaccgactgcttgaagttctggatggggcacgcgagccagaaancaggccggcgtagttggggcaaggttgaggcatggaggagtccctggtacgatctatttgacacggtagaacgtctagctgcatggagctagtatgggggatgatggcttatcagatgaggaaagatgacacagntgatggagac

SEQ ID NO: 58756 - DNA, 737 bp, Triticum aestivum
  unsure (1)..(737): unsure at all n locations
  Clone ID: PAT_TA_58756
gccggccgggcttgggaagtagaaatgccacttcctacagcttccatttatgagccgccgtcggctggcttcaatggcttcccttctcgaagaagtgttgttcacagcactgagggaatcgtggctgcacctcaacctcatgcagccaaatgtggtctcgaggttctcagagcgggtggaaatgctgctgatgcagctgtcgcagttgccgccggtctcaacgtaaccgaacctgtatcaactggcatcggaggcgacatgtttctcctatactttgacgctgcgacaaagcaagtcaagagtctcaatggatcaggtcgttcaggcgccaagcagacccttgagaccatccgaaaagctctcaacatccccggcggcaaaattggcgagatcccaacacatggcgtccatgctgcaacggttcctggagctgcagccggttgggtcgacacggttgagaggttcggaagtggaaagcttagtttgagccagattcttgaacctgctatcaagttggcggagaatggacatcctgtttctgagattgcctcgcattcatggcaagctcaagagaagctccttcgtgatgcctctcccaatttcgcagagatgctcaagcaagatccctccgcacaagacggcgtcagagctcccttccccggcgaagtcttcaaaaacccaactctcgcnaaaaccttccgcgcattggcgacagaaggaaagaagggcttttatac

SEQ ID NO: 58757 - DNA, 711 bp, Triticum aestivum
  Clone ID: PAT_TA_58757
gccggccgggctccggaacactttctacctcaaaggcctttgactaatactactctctacatctttcttcaaacttgattatatttcaaaacatggttcccttctctgttctcctcaacagcaacgttacagacgacaaatgcctccaagtcttctacgttaccagccaggataacctgagtgtagccctcagaaactctgatgacaaaggtgtgtgacgtcgcacgacttttactaggtagatgtcgatgcttatgtaggtctcatcccagtttagttcgaaaatgacagtgacgacatgaacggtctcaatctcgtaacggacatcacctagcacaagctgtatgatgaatgcgacaagttcactcttaacgaatgtctacatcgagtgtcctgactaccatggtctcgataccactggtatcaccaacaccagcgctgacatcgtgtcctacgaagacaacagtaacgtatgttgctactacttgaacggctctcgatgctattgagatccaaatctgctgaatatgagctgagcaccgggaacatcggacccatttcaaaccataatattgatcctgactgctcgctcgacgcgtttctatgataccaacggcaacggtagattcatcatctacatggataaggatctgggccacgtcgaggcatagcacatagagtacggttataccatcgacattggtgactctg

SEQ ID NO: 58758 - DNA, 741 bp, Triticum aestivum
  Clone ID: PAT_TA_58758
gccggccgggctggggatctgtaacttgcaattctctatttcctgagctgttgtaacgatatttattcgccaaatttatcaagaaaaatgacgcaggactttgcacctctaaagaacgacctgttgcttcgcacagcatggggccagaccgttgagcgccctcctatgtgggttatgcgacaagctggccgttacctccccgagtaccacgaagccaagggcaaccgagactttttcgaatgctgccgtgaccccgaagttgcaacagaaattacccttcaacccgtccgccgattcgcaggcctcatagatgctgccataatcttttccgatattctggtcatcccacaggccatgggcatgactgtcgagatggttgacaagaagggcccacacttccccgaaccgctcaagagtcccgatgacggacagtacggccaggttctcgccaaggatgtcgatgttgctgttgagctcggctacgtttatgatgccatcacactgacacgccagaagctcgatggtcaggtgcccttgattggattctgtggtgctccctggacgctgttctgttatatggtcgaggggaggcaccaagctgtttgcacaggtcaagacatggatctacaagtaccccgaggaggcaaagaagcttctgtccaagatcgcttgatatttgtgtcgaacatctggctctgcaagtaaaggctggtgctcagttgggtaatggtctttgactca

SEQ ID NO: 58759 - DNA, 767 bp, Triticum aestivum
  unsure (1)..(767): unsure at all n locations
  Clone ID: PAT_TA_58759
ccggccgggctgggccacgcaccgatcagactctcgccccgtttcctttgttcttcgctacaccatattgcactaggtagctcgctcaatacatactacagtactactgtagtatccctctctctactttatccaatttatggtcgtacgttagttctctcgggttcagttatggagtaggataggagtagaaggtaggggttaatttagttaaatccttgactataagctgatgaaagaacccggctttaacattcctcctctctttaatattgcatccaggaagacgactatggcaggcagcagcagcatcccagccaccaccgtccgtgagatccgtgttgtgcagcgcgcggacggggccgcggcggtactggccatcggcacggcgaacccgcaccactgcgtgccccagggcgactaccccgactactacttccgcgtcaccaacagcgaccacctcaccgacctcaagcccaccttcgccaagctatgcgggatgacgggcatcggcaggcgtttcttccaccacaccgacgaaatgctcgccacgcacccgaacttgtccctcgacgcccggcttggacgtcgtggctaccgctgcgccggaactcgccgcgtcggctgccgcgaggccatagncgaatggggnccgtcggtgngcgacatcacccatctcgtcgtcagcaccaacgcgggatcgcacgccccgggcaccgatgtccgcttggtctccctcctcgcnntcgcatgatgtcctgcgcacc

SEQ ID NO: 58760 - DNA, 652 bp, Triticum aestivum
  Clone ID: PAT_TA_58760
gccggccgggctgggcatggacacagccaagcttatgaacctatacacagcataccctgacgctgacttcctagactttgtcaacgctcctctaggcaagggccgtcccgttgacaagaagctaacacccctcatcgccgtccctacaacagccggaaccggcagtgagacaacaggaaccgcaatctttgaccttgtatctaagcgggccaagactggagtcgctcatcggaacctcaagcctacgcttggtatctgcgaccccctcaacaccaggaccatgcccgccgccgtcaaggccgcttcaggcctcgacgttctttgccactcgcttgagtcctggaccgccattccgtacaacgagcgaacccccagaccaacaaaccccatccttcgtccggcctaccagggagccaaccccatttccgatgtcttttcatttcatgcgcttcgtgataccatcaagtacctccctcgttcagtgaagaaccctgacgaccttgaggcccaatccaagatgcttctggcttcacgctggctggtgttgggttcggcaatgcccggagtcatctctgtcacggcatgtcgtaccccatttctagacagaacccgggctacagtcacgatggctacgaggtagcttcgccgctca

SEQ ID NO: 58761 - DNA, 751 bp, Triticum aestivum
  unsure (1)..(751): unsure at all n locations
  Clone ID: PAT_TA_58761
gccggccgggcctggattcaaacacgctcatcgcaatttgatcttttacaacaaaactttcaacaatggatgcagcaattgaatggttcggtctcaccacctttcgcatcaagaccaacggtctcgtcatcttcttagacacatggctagaccgcccagatgtcatgcccaaagcgttggctatcgacgatgtgaccgaggctgattacattttcatttcccacgcacattttgaccacctccccggcgctgacaagatagcaatcaaaactggggcgcacgttatcgccaacggtgaagccatcaacatccttcggtcagctggagtgcccgaggaccagttgattccggtagctggtggcgagcgtattcctcttttcactacagagtgtcgtcaagccgcggctcgtggagaagtcgacgtcgctcatgggccaccaggagcacctgctcgtccagacaataagttggcggcggcttccgttcaagtgtggccttcactgcactgcctgttgccaggtagctcacctgctgacttgccagagatcatggatacaggcaaggagtacattgggggagcaagccagtatgcctgctcacttgatatcacattcatgatgaaacatggccttctncagattggcgaccacatgccgcgtgaagatatggacgagggaatgcgctctttcgcagaatggatcagtggcccagcaaagtaatgcatgtctccctttgacnngaggcagctgat

SEQ ID NO: 58762 - DNA, 275 bp, Triticum aestivum
  Clone ID: PAT_TA_58762
gccggccgggtcgggaagctggtccgtcccgttcctcctcttccttatgagtaatcaatcccctgctcctccggatctgacggaccttgccgctaatctgctgcgcttgccccggcagatggtcatcgacttctccgcctcctggtgcgggccctgccgcttcatcgagcccgccttcaaggagatggcctcccgcttcgccgacgcgctcttcgtcaagatagacgccgacgagctcgcggaggctgtacaaagattcggcggagaggcgatgc

SEQ ID NO: 58763 - DNA, 802 bp, Triticum aestivum
  Clone ID: PAT_TA_58763
gccggccgggctgggcctctcattttcctgcccttttcgtcgcagcccgcccctttttgtaccgcaatggagacggcgacatgtcacagactcaatggatcacattcgccatgatcatgctgcacttcgtcaagcgcgagtacgagactctcttcgtccacaaattttccgccaacacgatgccctggatgaacatcttcaagaacagcttcttctactgggccgtctctggagctgcctgcgcctactccatctaccaccccaactcgctcgctgccaaggccgacatgcccgccatcgacgctgtcggagttgccctgtactgcttcggcgagtttatgaatgcccttgttcaccgatatctctcgactctacgatccactggtggtaccgagcgcaagatccctgtcggctacggctttaacatcgtcacttgccccaactacttgtacgaggtgcttgcatggattggaatcatcattgttagccgtgactggactgtcgctgtttttatctccattggtgcggcacagatgattagctgggccaagggcaaggagcgtgcctaccgcaaggagttcggtgaccgatacaagaagaagcgctttgttatcttccccggtcttctgaaacaactaaaaagttatttgcaaataaaggcgtgggctttgaaagataggaaagccaggtcaatcgatatctgggcgaaaatggtgtcatgagtgggtgtagatacagtgcatagatttgagactaatgctatatggtatgttgagtaaaaaaaaaaaaaaaagggccccta

SEQ ID NO: 58764 - DNA, 771 bp, Triticum aestivum
  unsure (1)..(771): unsure at all n locations
  Clone ID: PAT_TA_58764
gccggcgtggtcccgctgctactcgccgcgggcgtgtccccggcgtcggcctcgagctccgccgtggacctcggcgtgaactggggatcgcagtgcacgcaccagctggacccctccgaggtggtgaggatgctcaaggccaacgggatcatgaaggtgaagctgttcgacgcggacccctggcccgtcggcgcgctgctcgactccggcatcgaggtcatgctgggcatccccaacgacatgctggaggcgatgagcagctacggcaacgccgaggactgggtggcggagaacgccaccagctacggggacaggctcaagctccgctacgtggccgtggggaacgagcccttcctcaagagctacaacggcagcttcatggagaccaccgtgccggcgctcaagaacatccagaaggcgctggacgaggccgggatcggcgacacggtcaaggccaccgtcccgctcaacgccgacgtctacgtcggcgacaagccgtccgagggcaagttccggcccgacatcgacggcgtcatgaccaacatggtcaagttcatgcacgaccacggcgcgcccttcgtcgtcaacatctaccccttcctcagcctctaccagagcgacaacttccccttcgagttcgccttcttcggcggcggccgcagcatccaggacaacggcggcgtcagctactccaacgtgttcgacgccaactacgacaccctcgtcagcgcgctcaagaaggccggncgtgccggcctcaaggtcatcatc

SEQ ID NO: 58765 - DNA, 701 bp, Triticum aestivum
  unsure (1)..(701): unsure at all n locations
  Clone ID: PAT_TA_58765
gccggccgggttgggagctgcgagacactaccacgaaggatatatctgattcctatgagcaaggtctgttgacagaaaaggtgatggatcgggctcttaaacgtcttttcgagggtcttgttcacactggtttcttcgacggcgataaatcagaatggtcttcgcttgatttcgatgatgtcaacactagacacgctcaagaccttgctctacagtctgccgtacgtggcgcagttctcctgaagaatgacaatacgctacccctcaacataaagaagaaggagagtgtagccttgatcgggttctgggccgatgacaaaacaaagctgcaaggaggctattcgggtcccgcacctcacgtccgaacaccagcctatgccgccaagatgttgggtctaaatactaacgtggcttggggtccaactttgcagaatagttcagttcctgataactggactaccaatgctctagaagctgctaagaaatctgattacattgtgtacttgggcggccttgatgccacggctgccggcgaggagcgggaccgcacagaccttgactggcctagcacccagttgacactactcaagaaactgtccaatcttgggcagccgttagttgtggttcaacttggtgaccaagttgacgatacccccttgntnngagacangngcgtgaacagtattctctgggtcaactac

SEQ ID NO: 58766 - DNA, 434 bp, Triticum aestivum
  Clone ID: PAT_TA_58766
gccggccgggttccggtctttatataacacaggaatctggccaaataaatatctaatcactacaattactatctcattcactatttcaaccgactcaatcatcaaaatggcgtctaaatccctctacgctatcattgctggcgtcggtccaggcacaggtcgatctgtcgctttacgctttgcccagaaatatcccgttgttcttttcgcccgtcgcccagagagctatgagagtactgtcgcagacgtcgagaaagcaggtggcaaagccatcggcatcactgctgatgtcgctgacccagcgtctctgaagaaggcctttgacgacatcaacaagcaatttcccaacagtcatctcgcagcagcaggctacaacgtcggcagcggtggattcgccaaaaagcccttcttggaacagacagagaaggaccttg

SEQ ID NO: 58767 - DNA, 763 bp, Triticum aestivum
  unsure (1)..(763): unsure at all n locations
  Clone ID: PAT_TA_58767
gccggccggttccggaaaaggaagaaagagtcgtcgcctccacgcgcttacccaaccgcgtcccccaatctcccctacttatatactacctgtctcgccacaatccaccatccaatccgacctcgccgctgcagtcccgctcctcctcgccgtcgccgccggaatcccctcccttggagccaccagcaccagcagcaccagcaaagcaagccgcctgactcttgcgatgggttcggggagccgcgcggcgtcgtgcctgtgctgcccgttcaagtgcctggcgtgcgggctcttcagctgcctctgcagcatcctcgtctccctcctcgtcaccgcgggggtcctcgccctcatcctctacttcgtcttccgcccgcagatgatcgccgccactgtcgactcggcctccctcgcccagttcgcgctcggcaccccggccagccccgcgctgctccagtacaacctcacgctcgccatgacggtgcgcaaccccaacaagcgggtgggcctctactacgacaacgtcgaggccctcgcgctctacgacggccagcgcttcgggttcgcgcccctcgaccccttcttccagggccaccaggcatccacggaggtgaagccggcgttcggcggccagcaggtgctggagggggacgtgacccagtccaacctcaggacgcagctggcggngggcgcggtggaggtggaggtgaagctcaacgccaagctccgcgtcaagggtgggcgtccaaaggtgcccgggccc

SEQ ID NO: 58768 - DNA, 529 bp, Triticum aestivum
  Clone ID: PAT_TA_58768
gccggccggttcgggtccctgcgcccagttcattcgttcgtttgtgcagcagccaacaagaatcgagtcagcgattgatagagtgatcgaagaagagggaaacacacgctagcttgaatcgtgatggcgggaaaatttaatgccgtgcaggtaatgttactgatgatcgtggtgttcttcgccgtgcccggtgcggctcgccagctcggcggcgacgtgtgggcgccggccggggaggtcgtctccggcgacggcgtggcggtgcaacttctccggcaaatgtacctgcagcggctgggggcagggccctcgtgcggcacccacagtgcaaacggtggctgcccacactgatcgagacccagacgaaatctactcagagaatctggcggcgagatgcgtagggaaagaatagtttgtttctgaccttttcagccgtcgcgatcatgattcctggccgccaggccatctcttctgtatttacaatctagggtggtctttctgtcggtaagttctagttcattctttgctc

SEQ ID NO: 58769 - DNA, 821 bp, Triticum aestivum
  unsure (1)..(821): unsure at all n locations
  Clone ID: PAT_TA_58769
gccggccgggttccgacttggcctcaacttatcgaaatccaatcgacctgcgacaacgtcgatatcatgcgcttctcaatcgcatcgtcacttctcttcctgacgagtgcagctagcgctgcctcgtcttggggcttcaaagatggctccgttaccgtcgcctccaagcaaggacacgccgctactgccaaattcagcaaccaggagccagtcaaggatactcttattctaggaaaggcagataccatcaaagtctcattgactacgaccgaaggcagcgaagcgaagcgacctcaccaggcctttatcgtcattacagaatcgaccggcatcgaggtcgccctccctctcgacgtaaagtcctctggaaaggccgtggcttctatttcgcacaaggacatctctgtcccgttgctcctctccgaggaacccctcaaggtcaacctcgtgttgggctccttcggctcgtccagccccctcatctctcccgttttcaacattcagatctatcatgtacccaacactccccttcccgcgtttgagcgtcccatgcgatacggacgtcgagaggagatccaccacgtctttaaggttggcgagacgagccctcctaagatcatatctattgtattcgtgaccgccatcgtgtgcacgtttcctctgcttcttgtcgggtggagtaagctcggtgctaacctcgaccacctgcctaaggcttttcaaactgcccctatctcacacgctctctttgtcggctcatcatcgncatttgagggatcatttttcctctactacgtcaagtggaaccttttccagttgct

SEQ ID NO: 58770 - DNA, 832 bp, Triticum aestivum
  unsure (1)..(832): unsure at all n locations
  Clone ID: PAT_TA_58770
gccggccgggtttcgttgaggttaccgagaagctgctagcagcgggagccgatgccaatgctgctgctgctagtgagtatggacggactgcgctcgaggcagcagctaagggaggctatcttgaggttgtcgagaagctgctagtagtgggagctgatgctaatgctagtgaggatagacagactgcgctccaggcagcagctgagggaggtcatcttgaggttattgaaaagctgctaacagcgggagccgatgctaatgctgctgcgcttcaggcagcagcttggggaggtcatcttgaggttgctgagaagctgctagcagcgggagctgatgttaatgctgctgcttcccgttattatagacggactgcgctccaggcagcagctaggggaggccatcttgaggttattgagaagctgctagcagcgggagctgatgttaatgctgctgctgctaacaaggatggacggactgcactccaggcangcagctgggggaggtcatcttaaggttgctgagaagctgctagcagcgggagctgatgttaatgctgctgcttctcgttattatggacggactgcgctccaggcagcagctgagggaggtcatcttaaggtttttgagaagctgctagcagcaggagccgatgctaatgctgctgcgctcgaagtagcagcttggggaggccatcttgaggttattgagaagctgctagcagcgggagccgatgctgataatgctgctgcgctcgaagtagcagcttggggaggccatcttgagggtattgagagctgctnagcagcggagctgatggtatgctgctgctgct

SEQ ID NO: 58771 - DNA, 738 bp, Triticum aestivum
  unsure (1)..(738): unsure at all n locations
  Clone ID: PAT_TA_58771
gccggccgggttcgggaaaccttctatctctaaaaagggacgcataaagagtgacaatagttctttttcggaactgtctctcttacatcgtcacttgaatcgttgccatcttcttgacggcaatcgcttcttgcttcttccctttttctgcggctcagatcgcggggtgaaaacttcaaccccgctctgttcccactacaacaacttcgactttacacacatagtcaagttcttcagacaataccgccaagatggttaacttcacaatcgacgagattcggcagcttatggacaagcctaccaatgtccgtaacatgtccgttattgcccacgtcgatcacggcaagtctaccctgaccgactctcttctcgccaaggccggtatcatttccaccgccaaggctggtgatgcccgagccaccgatactcgtgccgacgaacaggagcgtggtatcactatcaagtccactgccatctccctgtacggtcagcttggtggggacgacgacgttgccgacattgttggccagaagaccgacggaaaggacttccttatcaaccttattgactctcccggtcacgttgatttctcttctgaagtactgctgctctccgtgtcactgatggtgctctcgttgtcgtcacaccggtcnaagggtgtctgtggtcagaccgagaccgtcctccgacagggtcttggtgagcgcatcaagcccgtcatcatcatcaacaaggtcg

SEQ ID NO: 58772 - DNA, 594 bp, Triticum aestivum
  Clone ID: PAT_TA_58772
gccggccgggttccgaaatggagggagtagctcgctgtatggtggttctctgtctagtaactgtgtaattattacacattattacttctgtatatgtatatgtattctgcacttctctcgtacttacatttttatttgttcataacctgatattttctaaatcttaactgaagacccgataggctgcccaccggtatactgcccacctcgctgctgataggaagggtactggttctgtacaatggagcatgcgaatttgtggatgatggctggtccgaggcatctgtcgctcgtttcttctccacgagctattgcgcatcaagttcttctgactattaatgaagcgttaatcattctacaggagtcaattactttctacaagtgtaatccgttcgatcaattcgcattttaagagcattagtcttttttagcgaatgaatatacaggagtggacgagcccgtcattccaattttataggcagaaattgagtgacatgtaccagcaaataaaggccaactctgttccaaaagacacagcatgcctattttaaaatttgtctattttaagaaaaaaaaaaaaaaaaaaggccccta

SEQ ID NO: 58773 - DNA, 498 bp, Triticum aestivum
  Clone ID: PAT_TA_58773
gccggccgggcctgaaaataataaaacaaacgctagcgcacacgaccaatactactaataggacgaggaactgccttctacagacgatcagatggcctacaccgaagccccaatggaaagaatccgccgacattgaggcgagaatgaaaactctcaagctctcttccccataaatcatcccgatgaccctcaagaacgtcatcgagctgggcctactctacaatctggtgaccggcgagggcaagatggtgaccaccaccgagatgactgacatgctcgcggccacagagaataatgccacgggcgacatagtgtaccgacatgctcgcgctggtagtactcgaacaacccgacgtcctagcaacatggacgactccaaggatgaacggctgtgccggaacaacaacgacgatgacgtgtgaaaggtcctgatccccaacgaggacggtgtcttcatggctagagctcgcgctcatgaactccgacaaggacctcatg

SEQ ID NO: 58774 - DNA, 800 bp, Triticum aestivum
  unsure (1)..(800): unsure at all n locations
  Clone ID: PAT_TA_58774
gccggccgggccgggaatccgatccaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccggaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctggcaagcagcttgaggatggccgcactttggcggacacaacatccagaaggagtccacacttcacttggtgctcccgtctgcgcggtggncagtagctcctgggcatggatctgcttctgtctct

SEQ ID NO: 58775 - DNA, 808 bp, Triticum aestivum
  unsure (1)..(808): unsure at all n locations
  Clone ID: PAT_TA_58775
gccggccgggttcggattgcatcttgtctatccattcgtctcgatttcttgcctgcgagagggaccagaaatagttgaacgagctagagctcgctagcggcggtccgtcagccaggcccagagaaaaagcactcgtcagccgggaaggttatctgatggggaactgcgcgccatcgcggcacgccggggagtcgtgggccgacgacggcgagtgggaggaggcgtcgtccacgtccgaggacggcgaccaccaccacgcatcggaggtgacgatcaggatcaccaagaggcagctgcacgagctcatggagaggaagacgcccggcggccggggtagcagcacccggcagctgctggcggacatcatggactccggggaggtgcaccaccatgacgtgcaccgggaggagcactggaggcccgcgctgcagagcattccggaggccgtcgagtcgtgacgagacttggtggtggctacgtatgtacgtacttacgtacgctgcccctgccgagctctctgcgaaacaaattaaagttgccatttccctcctagcctcttttctcttttctcgttcccacggtacgtttccatgtccttgaatggatggccatgcgtccatgcatatacaaagattggatttggatagttcgttcaatttgtctctgatgtatacataagatgtacgtctagggaaatacgtataaaaaattatcactgatgtacataggatgtagttgtagggaaataactgtgaataccctatttcgcatgccattttttgtgaatcgncattttctggtatttttg

SEQ ID NO: 58776 - DNA, 313 bp, Triticum aestivum
  unsure (1)..(313): unsure at all n locations
  Clone ID: PAT_TA_58776
gtgcggcgctcgaggcggccggngtgggactttatttatccgtatgcaacgctattgacagcggtcaataaatgacatatacttggaacaattgtccaagttcccaattgaaaagatgcggggtccttttgcggacgaccttcctccggaaatctcacgggattaatatcggtacttgaaactcgcctcacttaaagctatagcgataggagccatggagtatataactagcatcagtggcgggcaaagaagagaaggacaagcacagactccacttccccacaggcggaaacagagtatccaccatgcttga

SEQ ID NO: 58777 - DNA, 774 bp, Triticum aestivum
  Clone ID: PAT_TA_58777
gccggccgggttgggcgtccacggaaacggattcccccgccagtggaacctccgcgaccacatgaagcgtgtccacaatgaccacggtagctccagtggctcacctacaaccggatctgctcagcccgccaagggacgtaagcgcaagaccgagaactctgagactcagacttcccacagccgcaaggcggctgtcaagtcgatgcctcctcccccggagcccaaggagaacttgacccagcctctcattgaccaatggatggagcaccacaaggctgtccaaagcctcatgcgaaatgttatcaagcctgaggatgcccagaaccttaagcacatcggaactatccagaaccgtctcaactctatgatcaagcttactacggacctcaacgccatcaacaaccccggaaacactctgactggtactggctgaatgaattatatgcgagtcttgtctgctaccaacaccaacaaattgatttgtgcaagtgcacaaggagaaatacgaatgtccgtctgatatagagacaaattcttaatctccaagacgtcccaaggtccgggcaaaaacaaaacacgcccacaatctacggcagaggcacctgtcctgcccagtagaggttgcccccaggaacggatgcattgcattacaaccggaatccctacaatcccaggatatggacatggtccccaaggattgcgccaccgttgcgccaggaggataacggagcccccgttacgggaggaaaaaaacgacttttgagtcgacagagc

SEQ ID NO: 58778 - DNA, 830 bp, Triticum aestivum
  unsure (1)..(830): unsure at all n locations
  Clone ID: PAT_TA_58778
gccggccgggttccggttatttccctttattcctcaattgtttgtgtaattaatatactatcatcagcaaacatgtcttctcctccgccaaagggcatctacgtgcccgtccccacgttcttcgcttccaaaagggctgccaactacaacgccatctcctcgcctgtcgatgtcgagacacaggttgctcacgccgtttacttggccaagaatggtatcaagggtgtagttgtcctcggtactacaggcgaggctgtgcatattcatcctagagatcgccatgctatcctcagtggtgtcaaggctggtctggaaaaggagggcttcaaggattaccctattgttgcaggcacagcgacaaacagtgtcgaggagactgtcgagcaactcaaggatgctcaaaagtctggtgctcaatggggtctgactcttgtacctggatacaatgctgctgctgttacacaggagggtctggttcagtggttcacagctgtagctgaccaaagtcctattcctgtcatgatctatcactaccccggagtatccaacaatgtcaaggtcgccgtatctacttacgttaccctcgccaaacaccccaacattgtgggatgcaagctgtcccacggcgacgtctcagtagctgcgcaaatcgcatccaacccatctattgaccacagccatttccacgcctacacaggtctcggncacagctggctccctgtggtttcagtgggctttgcagttgccattgacggctcagctggctttctccccaagtctctggtgcgacttttacgagttgtcgacaaagacgcagcccacagatgctg

SEQ ID NO: 58779 - DNA, 850 bp, Triticum aestivum
  unsure (1)..(850): unsure at all n locations
  Clone ID: PAT_TA_58779
gccggccgggcctcgaccttctaacttcgaaaaacttcttctcggtccacagacttcgttggcagagtctatcgctcgtatatttcttcattggatacatatcttgtgcttctcgccctctggataaagcaccttactgttctctctcacagatcagcccaaccactcactcacttgcaataacatttcgagtttgctttgaaagcactcacttacacacacaaccaccaactttcatataacaacaaaaccaacaaaatgcacttctccaagttcatcctggctgttctgcctgccctcgctctcgctcaggagaccaccactcagacatctaccgccgtcgtgaccaagacttactacctctctacggtccgtactgtcaccgccactggcgagagcaccactgctgtcgagacctcggccgagatcatctccactgctattgttgaggagaagaccaccttcctccctgttgcccacaacaccaccatccctgcgtccacccccaaggccactgcctctgctggtaccactggtagcaacggtggctcttctgagccttctcaggttcccgagaacgccggagctgccgtcaccgttggcaagttcgccatggttggtgttgctggtgccatcgctgccgctcttctgtaagcgtgcgttatatggaaagcgactctccctcgagggtctcgcgactgttggcttacacactcgncaacacatctcaataccttccattgcctggtcatataccctttataccctgggcacagcgcgngctacttctttatgatgaaacgccacgataccatttgcaggatgacacttgtcgtctgcttcacacttg

SEQ ID NO: 58780 - DNA, 410 bp, Triticum aestivum
  Clone ID: PAT_TA_58780
gccggccgggccttcgataaccgccacacgcacactcatctccgtgctcacccaagacaagaagcgattccgcacagcgcacatcacagctacccatctgagtgcatgatggaggtcgagagccatcggatggcgtcggcgcccccggaaatactgcgcgccaggaaggccgctaccgcggggggaaccttctactgctccatcatcctctgagtctccaccatgttgtgcatcatcttgacctgcgccggagaagactaccgaggcaggtgacgaaaaggccgacgcgactccaagggattctgcggaagcgaaagaatgagcgacctgatcgggacacactggagcgagggataccccctctgcggatcctgagatcatgaccgagacctcgaaatcgtctcgttgat

SEQ ID NO: 58781 - DNA, 424 bp, Triticum aestivum
  Clone ID: PAT_TA_58781
gccggccgggtcgggatccctctcgagactactcactccactgcttttccccatggactaatcccagagtcggactcaccttcctcctcagccaactactcctctcctctcctccgcgcatcgcaccggggtgcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtgg

SEQ ID NO: 58782 - DNA, 712 bp, Triticum aestivum
  Clone ID: PAT_TA_58782
gccggccgggcctcgctagaagttgtcgtcgtgtccatctaattttattgctttctttttctcttgtcgattccatctacgatacccccctcacaagtaatcatgatgaacatgaggcttcttcggcagcaatgccttcgcaccaagccatcactggctacgcgcatttccaccagaggtttcgcatctcaaaaagatctcctcggttcaagcctcgagcaaggcgaccctgagatccatgccattctcaagcgcgaagagaagcgtcagaaccacttcatcaacctcatcccctccgaaaacttcacctcgcgatcagttctcgatgccctaggcagtgtcatgcaaaacaagtactccgagggctacccaggagcacgatactacggcggcaatgaacacatcgatgaggccgaacgtctttgccaatccagagctctcgagactttccgtcttgaccccgagaagtggggtgtcaacgttcagccactctctggatccccagccaacctatacgcttactctgctatcctcaacacccacgatcgcatcatgggtcttgaccttccccatggaggccatctctcccacggctaccagatccccggcaagaagatctcccatgatctcaagtactacgagaacttcccctaccgactcaacgaggagactggcctgatcgactacgaaaagctgcgcgagaacgccctgc

SEQ ID NO: 58783 - DNA, 678 bp, Triticum aestivum
  Clone ID: PAT_TA_58783
gccggccgggtctcgacgctcgacttctctgaatcacagcatcagcccgaccaacatgggaaaagagttcgagttgatagactctatcctattagattccatgtcgacaacatcatccaacatggacggaactgccaccccgacacacaccgtcatgtcagagacactcttagactacactgaatctgttccttatcctggcgctcacttcatcattcgccagcgcgacacaggcaaagtcatcactctcatcgctggcgaacttcagcttgccgagggtctgaaccccaagggtggttatcactgggaatgcatcgagaaaaacagatggcttggtttccgcaactgcgtgtcagggaccatcatcggccacaacaacaacaagaagttcgttgcaagagcagaaaagcaccagtcttacgaatacattacactcagaccgaatccccacggtggctacgagcttatgacgaaacacaaccatgatgagctatggagcatgaacgtggcagatgatggacagcagctggttgagaccaaaggacaaggcgccttgtgggactttttgaaagtctagtcccggaagtgtgaagccagggaacacacaatcattttatgttgatagcatcataataccactccttctgcagggaaaaaaaaaaaaaaaaaggccctagg

SEQ ID NO: 58784 - DNA, 791 bp, Triticum aestivum
  Clone ID: PAT_TA_58784
gccggccggtcccagcaaacgcaggtccagatgtcgtgctacgccgttgcaaatctcaatacgacttcttgaccccggtctttggaagttttgagacattcagacatgtcatattcgagaactcagaatcctgtctttttcttcccactctggtgttgtgctatcgttacgaacgacagaaagcgccagtggcccttcctttcagcctgctgccataggttggcattttctctaccccagctcaccgagccaggtatcgcagcatattcgagacaccagcgatatatgccacaatctgagcagattacctgtattgcttcttcattgccaatttcgattgcctaaagctgacctagcttacacggagataacgacacgaacatcatatggcgtttgatcggcaacagacacgccccattcttcgtcaaggtcatctgacaagcttttgatgagcttagacgtcatcaaatgcacctcatgggttgagggctaaatgtgcatggcctcgaacattgagacagataacattatgtcacatccgcaaaagagcctgcaagagcattcgtgcaacatccccaggatctacatctcgagcttcttatctttgatcactctgcctttctagcggatatcgtacaccttatcacaccctgaaatagtccgaatctacaaagtgtggtggtcagactttgagtagtctcttcttattgccgagcttttagccgagcagaggccagactgggtatcgatcgatcaaaagctgagattggtcatggtgctcgaacctgact

SEQ ID NO: 58785 - DNA, 218 bp, Triticum aestivum
  Clone ID: PAT_TA_58785
gtgcggcgctcgaggcggccgtcatctgatttataggcgggtgtggtctgtctaattttgaagtttcatgcattttccactagtaaaaatggttgcattatatgcagatctttgttctcagaagtcttttgttttcgtccaaatttgtaaaagataaaagttagtgtttgtgcccaaattcccatatttccgaaaaaaaaaaaaaaaaaaggccccta

SEQ ID NO: 58786 - DNA, 622 bp, Triticum aestivum
  Clone ID: PAT_TA_58786
gccggccgggtccagatacaattcattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaatatcgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatgcagtgatgaatatgtaagaatgaaagatttacctaattaactagtcctaaatcgctacttcaaaaaaaaaaaaaaaaaaggccccta

SEQ ID NO: 58787 - DNA, 257 bp, Triticum aestivum
  Clone ID: PAT_TA_58787
gccggccgtttcgggaactcagtctggccacggattactttaagggaatcttgggttagtctaccccctcgatgaacaaagtggacgtacactcattatacactccacttgatctatctgccctgacggtacggttttcttgggctgaaatcgtacaagccatcagctgctcacccaaaaaacggagcaggtcatcttttagcagcaacttgaaagccttataaaactcattggtgaaaccgtcaggacctggacta

SEQ ID NO: 58788 - DNA, 399 bp, Triticum aestivum
  unsure (1)..(399): unsure at all n locations
  Clone ID: PAT_TA_58788
gccggccggngatcaaattctcaaccaacacaccacatttactcactcaaaaacaactgcaatcatgtctttcggtcgaactgtcactctcaactcgggctggaagatcccccagatcggctacggcacatggcaagctgctcccgntgaggtcggcaatggtgtctacgaggcccttaaggctggntaccgtcacctcgatcttgccaagatctaccagaaccagcgggaggntggtgagggtatnaagaaggccctcagcgaggtccctggccttaagcgngaggacatcttnatcaccggnnagctttggaacaacnagcaacggcctgagnaggntgntgntgctcttgacgacaccctcgaggagnttggtcttgagtanatncgcctctggtt

SEQ ID NO: 58789 - DNA, 263 bp, Triticum aestivum
  Clone ID: PAT_TA_58789
gccggccgtcattcaaacggtgatttgaagaaggcatgtgcgccaccggtggtgttgagatcgctgcttaaacgacttgaattacagttcggataattgtggggaaaagttactaggtgcaaaggatgaaggggtaaatagccacttccaagctcttgattgcacttttcgagccatttttgtaaaacaccatgatagattaatgttcaactcaaggcgcaggggtgccattcactaaaaaaaaaaaaaaaaaaaggccccta

SEQ ID NO: 58790 - DNA, 519 bp, Triticum aestivum
  Clone ID: PAT_TA_58790
gccggccggtactgaaatcaacaacaactcgtcgtccattaacccagacacgagcatatcactctcatcgcactactcacatatcccctacatgacagcgctacccaatccctcccaacacctgggtcaacccaagagactcactcacaagggaatacccaacagcatcaccctctaatgacctctatctctggttgcttatttactgcgactactaactactatgtaaagagacagatcaggcacggcataagatcgacgtgattctctctgaaaaagcaagaatgcctgtgcctccacacccaccacatacgaaatgcggcaaggctcatcatgacatacgtggcatacctggtctactgacatcgtaccgtgcacagtacaaatatgacttcatctctgtcttgaacgaaggagatgatgatgacgctccactctgttctccaataataacactgaaccctccgattgatatttatcgagcactcatgcaaatgaccaccctagggtgcaacactt

SEQ ID NO: 58791 - DNA, 709 bp, Triticum aestivum
  Clone ID: PAT_TA_58791
gccggccgcggttacgacacatacgatccgatccaatccaatccaccccccctacaatctcacctgataaacctccgatacgagcgaagcgaaggctctctcgacctcctcctcaagatgaagatcattagggaagaccctctagcgcgaagaccatcacccttgaggtcgagacctctgagaccattgacaatgtaaaggcaaagatccaggacaaggaggccatccccccggaccaacagagtatcatctttgctgtcaagcatctcgaggatggccgcacccttgcggactacgacatccagaaggagtccactctccacttgatgctcaggctccgtgtgggaatgcagatctttgtcaagaccctcaccgcgaagaccatcaccctgctaggttgagtcctcagacaccattgacaatgtgaaggccaagatccaggacaaggagggaatccccccggaccagcagcgcctgatctttgccgggaagcagatccaggatagccgcacccttgccgattacaacatccataaggagaccaccctccacttggtgctcaggctccgagatgacatgcagatatttgtgaagaccctcaccgataagaccatcaacctggaggtgcagtcatctgacaccatcgacaacgtgaaagcgaagatccaggacaagcagggcattcccccggaccagcagcgcctcatct

SEQ ID NO: 58792 - DNA, 664 bp, Triticum aestivum
  unsure (1)..(664): unsure at all n locations
  Clone ID: PAT_TA_58792
gccggccggtccgggggttgtaattcggccttcgtccaagggtaacgatcatctggcggtcacctggaaggtcgcggatggcgtgtttcaacacattgacgttctcgagatgcaaaaggaaacggagtttgcagtgggcaagctgttgcgcgtgggcggcaagtacacatacaccgacctggacgaattgatcgtcgagcacgttaaggctatggcacgcaaagtggaggagttgatgcggcacgataagtaccaaaaccgatctcggggagagactgagaaatggttgacgacttacatcgatgccaatcccaatcgatcgacgtacgctttctgcatcgatactaaacaccctgggtacttctggctgtgcttcaaggctagtagggcagccaaggtgattgcgctgccagtgcgcgcaattccgcaagggtttgagctcaagggctatcaatatcctgacatgcgagcgctctgtaacgggttcaagctacgttatcagaatgaattctcgaaaatgggtcagcgctaggaaatgttgggcatttatcatcataattaacggcagtgggtggngtgggtgtattagaggaagactagcatattattttatcacgcagaatttgtattttctttggtaaaaaaaaaaaaaaaaaggccccta

SEQ ID NO: 58793 - DNA, 722 bp, Triticum aestivum
  Clone ID: PAT_TA_58793
gccggccggtccgggattagctcaacattcttcaaactcttcactcctcacattacagataaattacaattatttcgctacatcaagctcgattaccacaatcacgacaatggtttccttcaagtccatccttcttttcgccggcctcgccatggccgctcctacccccgataccgagaaatccttgaccaaacgcttcaacggcggctggtgcggtgtccacatccacctcttcaacggcgaaaacccaaagggatcccatgagatgaacgtctttgtttacgatggcaagcagcaacttgtctggtcaaaggaaagcatctggggcaacggtattttgatggcggagagcgagaatctccctgctgttctcaacatcaacacatatggcggcggtgctcttgccacattcacctacggcgaccaggattgggattctaacgaaaagcctcgctgctctgtcggagcctgggacggcccttcctttggttccagcactcaaacccttgagatggactgcggtttctcttgctgagcaggtactttgttgcggcccacgtcttgggtcctcaatgaccgactgtaacatcggcagagataagatataggcaaaggcgatagaaagagtagacagcgttttggcatcagtcaggtgtggagctttgtagctaaacttgaatttaaatcatcttgatcaaaaaaaaaaaaaaaaaaggccccta

SEQ ID NO: 58794 - DNA, 629 bp, Triticum aestivum
  Clone ID: PAT_TA_58794
taacgatcatatggcgcctacctgtaaggtcgccggatgccgcgtttcaacacacttgacgttgccggagatgcaaaaggaaacggagtttgcattggccaatttgttctgcgtggtcggcaagtacacatacatcgacctggacgaactcatcgtcgagcacgttaaggatatgccacccaaagtggaggagctcatgcggcatgataagtaccaaaagcgatctcggtcagagactgagaaatggttgactacttacatcgatgccaatcccaatcgatagacgtacggtttctgcatcttttctaaacaccccgggcaattctggatgtgcttcaaggctagtagggcagccaaggtgattgcgctgccagtgcgcgcaatttcgcaagggcttgagctcaagggctatcaatatcctgacatgcgagcgctctgtaacgggttcaacctacgttatcagaatgaattctcgaaaatgggtcagcgataagaaatgttgggcatttataatcctaattaacggcagcggccggcctggctgtcttagaggaagactagcatattattttatcccgcagaatttgtattttcttgggcaaaataaataaaaaaaaaggcccctaggc

SEQ ID NO: 58795 - DNA, 626 bp, Triticum aestivum
  Clone ID: PAT_TA_58795
gccggccggtcactccacgacctctcctccgacaacagacaatcaccactctttgtatacctcctccgcaaaatgtccgccttcatccgtgtcgctcgcggcgtccgcgctgctcccatccgacctgccatgcagcctcttgtggcccgctcggccgttgcccacttcaccacttcgatgccccgacgaagcgagcatgctgaagagaccttcgaggagttctccgctaggttcgagaaggaattcgacggtgtccaggatgttttcgagcttcagcgcaacctcaacaacgccttcgcttacgatcttgtccctgctccctcggtaattgctgccgcccttaaggccgcccgtcgggttaacgacttcggtactgccgtccgcatcttcgaaggtatcaagaccaaggtcgagaacaagggccagtacgagcagtacctcgaggagctttaccccgaggagaagtaaatggtaccatagtctcaatatttcgagccttgtgtatactggatgttggccgagacggaagggaatcagaccaagaggtagatgcgggagtttgattgcggcagccccaaatcgattgtgtttagtcccatgaaaaaaaaaaaaaaaaaaggccccta

SEQ ID NO: 58796 - DNA, 387 bp, Triticum aestivum
  Clone ID: PAT_TA_58796
gtgcggcgctcgaggcggccgggaatcaaaatgatgacgaggagtgggagttttgcgcgggctcaccgtgtgaccacggcgagcttatactctcctgtatctgtcgccggtccaaccggccggcgatgtttactttaccagccagcaagcggcagctgctgccggtgttgtatcgtgttactcatggtcgtagcgaggtcgtcgggcgtctcgtcgccgtttagtttcgccggagtttgttttggcgccatctttttatttcccatgcgtcggtccactgtttctttcacccttttcttcttggaataaataacaaaaggaaactagcagtagtaaaaaaaaaaaaaaaaaaaaaattttgtaaaaaaaaaacaaaaaaggccccta

SEQ ID NO: 58797 - DNA, 292 bp, Triticum aestivum
  Clone ID: PAT_TA_58797
cctgtgcgccgctcgaggcggccggttcgggataaaaatattacgtgagcaatgagattctcccattattcaacagcaagcagttcttaatcttataatcatagagcagtgggcatgtgatgtaagcaacaggaagagtaagacatctgattgatgacagaatcaggtaatgagcaaagctaggcaatgggcgtgctaggaaggtacctcatattttgcaacaatgcaagtggcatggtggtcaaactcccggatagagcgtgactgaaaaaaaaaaaaaaaaaggccccta

SEQ ID NO: 58798 - DNA, 786 bp, Triticum aestivum
  Clone ID: PAT_TA_58798
gcggccgttcgggaaaagaacagtttgatcagcaaacaacatcagattctagagacaaccaggacaagaatcctaacaagcttatcttcgtgcaaactcacttcacttacacaactcaccacaaatcgcccacaatggctcctggtggtccccctggaacaagctcgcgcggccgaggaggaaaattcagaaagcccgctagaggaggtggtaagaagttctcacgcgacatccgacctctcgatgccgatggaaacgaagtcagcatgtgggctgtcgatcatgacaaggaaaacggcgacgaagaggattcttccgaagaggaatcctctgaagaggaggaggatagcgatgatggtgctggtcctgccaaggaactcacccaagagcagacgcgagaacttcacaaagccgagaagaaggcccgtaaggaggcagcgatagccaaatcgaaggccaagacagttgaggtcggcgacctgccctcaagcgactctgaagagagcgacagcgaggatgaagatatgcccgccaaccccaaccactccaagaaagcgcgcaagcaggctaccgcgggagtcgatgaactcacagaagacatggagaacttgaaggcggcacccactcgtcgcgagcgcgaggccctcgaggctgcagcggccaaggagaagcacatgcgcttgacagcccaaggcaagactgacgcttcccagggccgatctggaacgcctcaaggctattcgcgaagcagcgccgacttgacgctgcccgacgacagccgagcgc

SEQ ID NO: 58799 - DNA, 314 bp, Triticum aestivum
  Clone ID: PAT_TA_58799
gccgtgtccggcagccgttcgcgagaccaccacgcatcccaccccaccccacccacgcgcctcttccaccggtcacgcctcgctcccctccggccaccactggcgcctgactgtcgcatggcgcgggcgctctcctcccgggcggcggcgaccctgacccggcggctggaggcccgacccgaggctgaggccctggggcggagcgccaaccacacgcattgcccggacgtctagatggtgctgaaccagcacgacgacgcggagatgccgaccctccgcgtagggggccgtgcgttgctcgcaaaaaaatccaa

SEQ ID NO: 58800 - DNA, 346 bp, Triticum aestivum
  unsure (1)..(346): unsure at all n locations
  Clone ID: PAT_TA_58800
acggggagagcgagggcgagaacaccggccacaacgaggagcgncccaaggaagcggagaaggaggagggcaacggaaagcaccacaacaagagggacgaagaagaggaggagcgcgacaccgcccagagggacaagacaacccagcgaaaccccgacgacagaacccacaccggaggccgacaagccaccaagcgaggccggaaggacaacagccccaccagcgagcgaaagaccaacccaaccgaagcaccacggccgaaacaacggaaagaaggccagggccgaccccaacgacggccacgccgacgagagagccaccagaagaccgacaaaaaccccagaca

SEQ ID NO: 58801 - DNA, 522 bp, Triticum aestivum
  Clone ID: PAT_TA_58801
ctgtgcggcgctcgaggcggccggtctcgtactcggcgatgctcctcactggctgttcgacctcggtcggtgagagtggaaagcttgttgatgtcgggtggccgtctgtctgggtcaggattgcgacccagtgggcaacggcaggtctgttcatctggtccctcgtcgctcccctcctgttcccagacagggagttctagatcgacctggttacctgctagtgcatcatccgtttggagccacctacgtatcgtatcgaacgtgtttcggctgtgatggctaagctgactatctgtatctggtctgtaatattgtgtgagcaaacccatggcaaggagctggtgtttgtgtgacgttgtcgagtgtggtctgcataatgtgtgacctaaggcattgttgccagtatttcaagatacggtcttggttgtatatatattgaagtcgatctatctctgtttcattggtgtgtcccgtaaatgctaatgaatgaaatgcaaaaaaaaaaaaaaaaaaggcccctta

SEQ ID NO: 58802 - DNA, 530 bp, Triticum aestivum
  Clone ID: PAT_TA_58802
gccggcgtgttcgggcaaggctgagaagcggccgccggcgtccaaggagggcggcgacaagaaggggaagaagaaggccaagaagagcgtggagacgtacaagatctacatcttcaaggtgctgaagcaggtgcacccggacattggcatctcctccaaggccatgtccatcatgaactccttcatcaacgacatcttcgagaagcttgccggcgagtccgccaagctggccagatacaacaagaagcccaccatcacctcccgggagatccagacctccgtccgccttgtcctccccggcgagctcgccaagcatgccgtctctgagggcaccaaggccgtcaccaagttcacctcctcctaggcgtcagtctcgtttctgaacccgttggattctgtatgtagttaggtgcaagattgtcttctgaatttgtgatcttgtgctgcttgttggtctgcagaaatgttcatgggactacttaatgatattcttgctgcttgaagaaaaaaaaaaaaaaaaaaggccccta

SEQ ID NO: 58803 - DNA, 501 bp, Triticum aestivum
  Clone ID: PAT_TA_58803
gtgcggcgctcgaggcggccggtactagaaatatgatgtgcgttaggcctgtctgaaggcgacgaggactgagaaccgatagttcttcgacagaaagactagcgtctgccgatattattatttgttgattgggttgaattgtgtggcgtgggatatgattatgttgtactgccgctgttgcacctctataatattatttgaaaaaaaaaaaaaaaaaaggccccgaatggacgcggccgatccaaaaccaggggattccccccctcttgcccgaatcgaaaatgaccttaaccgaaccggacgccgcgagggctgggccggcaaccgattcgaccaatatcttctacgattaacaggggctgctggtcgacgatttaccacaccacgggtgggaaaaaccgggccgtgccccagctgattcacgtggaccgcaatcccccttcgacgagttggatgataacctaaacatgccgagcaattcgcctttccaacggttgatgc

SEQ ID NO: 58804 - DNA, 580 bp, Triticum aestivum
  Clone ID: PAT_TA_58804
gccggccggtctcggtccttccgttcctcctcccggcaatggcgtcgcgcctccgctccttctcccgtcccgtcgcagccgccttcctccgctcagcttccgcccggagccccgcggcctctctcccccgcgctctctctccaacccccagggcttcttccctggggcggcaggtggcgctggcacgatcactgcagccgctgcacagcgcaatctcggcggcgaggctaacgtcacggcttggggcagaggtggcccgggcagtgtcgcagggtacgctctgcagctccaacccgggagtctgagtctgataggatcttaatctttgcatcctacctaaactggtctgagtgtgcctcgataatgaaagaggttgggacagacgcagcggacttttcaagaaatttattcccttcaataatgggttttgcttgttggcattcttccgcacattaatatgtgatgtactgctcagaagcaattactatgtgcacttcatatcagctcgagccttaactgaacagtgttatatttgttaacgatctagttatgggaaaaaaaaaaaaaaaaaaggccccta

SEQ ID NO: 58805 - DNA, 258 bp, Triticum aestivum
  Clone ID: PAT_TA_58805
gccggccggtcatccggaacacataatattttgcaggcgtttctggacaagacgacgataagctacgatagacaagtgacgggcgggagggcgtacggacagatggtacgaagggcaggtaggatatggaaaacaggagacaagcgacagcggacgatgtcctatttggggaaccttgttcttggagctttcatgatagctattgtatgtcaatgataatgattcgaaagccaaaaaaaaaaaaaaaaaaggccccta

SEQ ID NO: 58806 - DNA, 408 bp, Triticum aestivum
  unsure (1)..(408): unsure at all n locations
  Clone ID: PAT_TA_58806
ngccggccgggtccgccagccgcggccccggcgcccgcgctcaccgtcgcccccacgccctccgccaccgcaccggcgcccgccgactccccgatgttctcccctccggcgcccaccccggacatgtcgccctcgcccaccgccgagcccgccaccccgggcagcggcgccgctggtctccgccccgccttcgtgctggctgccgccgtcgccatctacgccttctagatgacctgatgatgtatcatttcattgtttctttgcagcctttgtttcatttctccccctctttccccccttccgtccgcacatttgtgtaccctcatcttctgctgtaattacgatcattgatttaatttatgcatttcaccattattcttgcaaaaaaaaaaaaaaaaaaggccccta

SEQ ID NO: 58807 - DNA, 809 bp, Triticum aestivum
  Clone ID: PAT_TA_58807
gccggccggtccgggaactctttcactcctactttcgcctattgcgccgttcaactcgcctacaaccccgtccccctacaaactcgatccagcaatcatgaagctgcattacatcggcgtcctccgcaacgagagccagccggctcatgagattgtcgctgagaaggagctcagcagctactcgcgattcacccgcaacaactatggcgaattcatgaccctattcgcaaagaccgtcgccgaacgcacccgtcccggacagcgacaggatgtcgaggagcaagactacactttccacgcctacggccgtactgagggcgtctgcggcatcatcatctccgaccaccagtaccctgccctcgtggctcaccagcttctcagcaaggttgtcgacgagtttctctccaagaacccccgctccagctgggcaaccggaacacccaccctcgccatgcccgagctgaaggagtacctcaccaagtaccaggaccctcagcaagccgacagcatcctcaagatccagaaggagctcgacgagaccaagattgttctccacaagaccatcgagagtgtgctacagcgtggagagaagatcgacgatctggtggctaagagtgacggtctaagcgcccaaagcaagatgttttaccagcaagctaagaagcagaactcgtgctgtattttgatgtaatggaccatttcatttttcctggcgttggacctggcttcttttcagcacataagggatgtcggcattgagattggttattcgtgcggcgcagaactttcaatcgtttatttctcccacc

SEQ ID NO: 58808 - DNA, 328 bp, Triticum aestivum
  Clone ID: PAT_TA_58808
cctgtgcggcgctcgaggcgcccgcgtacgccttggacatgccgtgtccgggctgttgacgaggaggtcgacgatcgcgtctgagaactccgaactcgctatcacgaaacaggttaacgtattactaaagccgtcatgtgaaatgtcctgaaacgtctatctatatgtgttaccaagaccagaagtatcgcggcttgtgtgcttgacattatggcgtagcgcttgggtgtgtatgttgatcgctggttcaggttgaaccacggaacttgtgagctagtaaatcagacatgttggttcatcttaaaaaaaaaaaaaaaaaaggccccta

SEQ ID NO: 58809 - DNA, 405 bp, Triticum aestivum
  unsure (1)..(405): unsure at all n locations
  Clone ID: PAT_TA_58809
gccggccggttcgggtctttcggtaccaaaaagtcaaaatgccgggttttcccgcctcgcacaaaatcaacacaactttcccttgtctgtcaggtctagccaaacacctaaacggccaatccatgttttgacattgttagtggagacatgtcggccaaggggaatgctccgtggggaaaagtcggggtttccaagctaaggtcggggtaaattcgctcttgttctgattaggttcatcctgatgcaggaatcatctggttctgtgatcttgatcttggttgaatcttatcttagatctgtataacctggtaggatcatacttaatgagtggaacaaaaaaaaaaaaaaaaaaaaaaaaaaaaaaaaaaaaaaaaaataaaaaaaaataaaaaaaaggnccctagg

SEQ ID NO: 58810 - DNA, 511 bp, Triticum aestivum
  Clone ID: PAT_TA_58810
gccggccgggttccggacgaatcgctcctctactatataataaccaccgctaacgttgttccgtacaggtcatcatgtccgccgcacccttcttctggcgagctcccctcaagtactgccgctgggcagcccgcgagcgtcccgccctcttctggtccgtcatcatcggcgctgctggtcccgttgccatgcccattgtacctccgatccgacactactttggcgatattgatgcgcccccggttcctgtgacctaccccattcccaatactcccaggaaacagctcaccggctacgacgattaagatctcgaattaaagaggaaggaaataacacggctcggaacagaaaagaagaagcgagcatacactattgtacaaactacggcgtcaccagagaaagcgctacagcggagggggaggaatatcatagaggaattaagggacaagagtcgacgtccaaaatttaccagcaattgacgctccaaaaaaaaaaaaaaaaaaggccccta

SEQ ID NO: 58811 - DNA, 467 bp, Triticum aestivum
  Clone ID: PAT_TA_58811
gccggccggttcgggagatagcaagaacgttcgtcgcacgctgtcccgtgtagagagtgggcagcattgttgacagggcctttgggctcgaggacagttcttagaagaatattgggaaattggatccgtcgttaatctcgacacctagctatcccgtctaggtgtcgtttcatttttgagatctacattctttcgcctgacgtactattatatgttgtagctgagcgaggcgtataggcgcggagctctacgattgatgtcatattgcatgcgtgacttggtactgttgtgcagactttatgttgttgttttctatccagtaacttagcgctgatacactgctctgtacctttcaaattcttgcagtcaagctttgaagcatggtgcagacgatcaaacagagattggactggccctataggttaatcttttcgtcaattgaaaaaaaaaaaaaaaaaaggccccta

SEQ ID NO: 58812 - DNA, 717 bp, Triticum aestivum
  unsure (1)..(717): unsure at all n locations
  Clone ID: PAT_TA_58812
gccggccggtccgggaaacccttctccccttgctttccttccccaacccttccgccgacctcggtccgctcctcgatccctccgccgccgtctccgcgctcgccttccactccatcggccccgtcccgcgcaacctcctcgccgcctccgacgacggcctgctccacctctacgacgccgacggcttcgcgctcctcacctcgctccgcgtcttcccgcggggccgcgaggcagccgacgccctcgccgtgcacccctcgggccgggtcgcgctcgccgtcggccgggccgggggcctctccatggtcaacctcctccgcggccgccgcagcttcacctgccgcctcgagcgccccgcctcggccgtcgcgtacgcccaggacgccgccggcggtgaccgcttcgtgatggccgctgaggagaaggtcaccgtgcatgactccgaggacgcccggatcatccatgagatgcgctgcgacaagagggttctcgccttagctccatcaaagaatggaattctttacaccggaggagaggatcgtggtattactgcttgggatttgacgagcggcaaggtttcatcgcgcatcgagggcgctcattcaactcgtggaaaagggattgtcgttcttcgatgaccggaatgacggatctgaatcgagcantctagttgcctcggcttcatctgatggcatcataaggatctgggatgttcgg

SEQ ID NO: 58813 - DNA, 518 bp, Triticum aestivum
  Clone ID: PAT_TA_58813
gccggccgggtcgggaagctgcgcgtgtactggaacgtgtaccaccactcggtgggctacaccatcatcatcctgggcatcgtcaacatcttcaagggcatgagcatcctggacgtggcgcggaagtggaagactgggtacatcatcgccatcggcatcctgggcggcatcgccgtggtgctggaggtgatcacctggggcatcgtgctgaagaggaggaagacggaggacaaggcctacaacggcagcgccaacaacaacaacggccatctgccgatgtgacgcgatgcgattctttctcggtgacgagaaatctatgggttgtgttgagttgagctgcgtgtgtgtgagcatggattggcagatatttaggttagggtcgggccttagtggtcttcggtctctctgtttctttttgtatgatgatgatgattgatagatgtgtgtatagtactgctgcacattatattaattattatactggaatgagagaaaaaaaaaaaaaaaaaaggccccta

SEQ ID NO: 58814 - DNA, 456 bp, Triticum aestivum
  Clone ID: PAT_TA_58814
cctcaccgactatcgaaaccccgactgaaagtgactactcagactgaatcgcttgaattcaccttatcctcagcaacgcttgacatccaacaccgcaggaagtcaatcgccaaacgccgccgcaatggctcacgaagatgctgactaccctgccaagctcgctgagccggccgcgcgcaatgaccagatggctgagaacatgaacatcgccaccgcagaagaccgagatctcaccggctaggagcgaaacactctctctggtggcaacaagaacgccatcggcgccagccgtgcctcctgtttcacagtcccccccacccatcagaacgaggcgtcaaaggccaactctaccccggttaccctcatcaaggagcaccgaccgaggattgaggccgagctcgccaagatctgcgaagagatcctcgaggcccttgacccgcacccgatcccctctgc

SEQ ID NO: 58815 - DNA, 540 bp, Triticum aestivum
  Clone ID: PAT_TA_58815
gccggccggttcgggcgaaaggaagctttctaccctagcagagaaaaaaaagcagaggagaggaagcggaggcgacgatgtcggcgatgacggcggcggtgcccttctggcgcgcggcggggatgacctacatcggctactccaacgtctgcgcggcgctggtgcggagctgcctcaaggagcccttcaagaccgaggtctcctcccgcgagaaggtccacttctccctctccaagtgggccgacgagaagcagcagaagcccactgtgcgcacagatgatgaatgaagatcgggtgccatggtgattgatgttttgagaagttgttgagtcagggcttaagaacttgagaataaattcttgcggtgacaatggatctattccgatactatgttgttatatttactaattgctccttttctacttgatgaacctgaaccatgtgaaactcgtgtcttgtggtgctcgagtgagcgtgtttttatgcgttatatcttccgatgctttaatttggcaaaaaaaaaaaaaaaaaaggccccta

SEQ ID NO: 58816 - DNA, 626 bp, Triticum aestivum
  Clone ID: PAT_TA_58816
gccggccggttcgggaagtcttcccagcaacaaccaataaccagcctcttcttcactctgtgtccaactagctagcatctgcagcagcatccgaggagagaaataatggtgtacgaggcagtggaggccattgccctgaggagccaggttcagagaagaaacatcagtgcgagaagccatgagcatcaggtgaaggccagagagaatgagctcatatggggcattgttatctgggtcatcaggaaggtttgcccggccttctagcccatgctgtgccatgacggatgattattagagtgtaacagctgaaggcggatcctttttgcgtcaagcagacatttcgcatacgtcatgcgtttttatgtactccttccgcaactaatataagaagcgtttagatcactacttagtgatctaaacgctctctacagtattgtttttaggggcatacatactagtgtgtatctcacttgtagttagtaggaacaattcatcaaagtaatgtaatataatatcagtgtccaagaactccggtcttggcccaactgagtgtattttgtggtgtactacttatgaataatgttagctaatatctccaagaaaaaaaaaaaaaaaaaaggccccta

SEQ ID NO: 58817 - DNA, 352 bp, Triticum aestivum
  Clone ID: PAT_TA_58817
ctgtgcggcgctcgaggcggctggcctcgccaagtcgggacagccgacggacgctctaccgacgtgcatcgggcgctgcgggtgtgtgccctgcccgaaagggaaggtctgcatcgctatttgcactcccccgccgccctgcgcagccagatgccgctgcacctattctggcacgggctgctaggctggctgtgactctggtgacgtcgcctgcgcgcaagcgcatgaagctctagccagctgtgtattgtatgtgtgcgtctgtgtgctgtgatgcgctaataaagtgtaaacggatcgatccgtgggacaaaataaataaatagaaaaaaaaaaaaaaaaaaggccccta

SEQ ID NO: 58818 - DNA, 557 bp, Triticum aestivum
  Clone ID: PAT_TA_58818
gccggccgttatcgagacaagttgaagaagagacgtacggcgatgaagcctctcccggtgaccctggctctcctggccctcttcctcgccgcctcgtaccaggatctcgccgtggctgctgcagatgcagatgcagatggagtcggcagcggcgctccggtcctggacagcgtgtgcgagggcaagtgcaagaaccggagctcgcagaaggtggccgggcggtgcatggggctgtgcatgatgtgctgcggcaagtgcgccggtgcgtgccgtcggggccgttggcccccaaggacgagtgcccctgctaccgggacatgaaatcacccaagagcggccgccccaaatgcccctaggactaccaccattcatctttttttttaaggtgaatgggaacgtaggagatggatcttgacgagccgagtgcgtgggatttaggggctccccttgtttgtaagtttgatttgttcagaataaacaacgtagatctggtttgaggaggagtgcttccatgtaacgtcttctcgcaagaaaaaaaaaaaaaaaaaaggccccta

SEQ ID NO: 58819 - DNA, 700 bp, Triticum aestivum
  unsure (1)..(700): unsure at all n locations
  Clone ID: PAT_TA_58819
ngccggcccggtttacaaanaaatatatngtaacatgctgcgctctcattaacattttgcacaaggatatatcaggccaatttttttgaacaagccatgcccctgtaagcacaactggtcatgttcgctcatatgaatagtacttaatcttcatatttacaggtggaaataaattgctgcgggcagccagtgaaccctacacaacctctgcgcaatttagtagagttgtgggtgagggggcgatcagcacaggcaacacaggccattgtaggctcccccgcggaagagtttgtgatggtgctaaattatggacggccaaagcccatggaacctttgagtgcacagtaatgattcaacccatttccttttgaaaggtggggtcttttctgccatagccagccatttgctgggccgatggaagaggttgtcgaaagatgaagtccccgttggtacacaacgtcgcgatgtggctggcttcctcgacagccaaccctcgtcgacatattcatgtattcattcatgttggtaggtgttattgttcttcgattccattatgacatatttttttcttatttattatacaccaaagatagatgaaaaatgatctttagattggatataaagagagggaacggtctcaaccattgatgcttctgattgtaagaggtgactatgactatgagtggattgaaaattgcca

SEQ ID NO: 58820 - DNA, 857 bp, Triticum aestivum
  unsure (1)..(857): unsure at all n locations
  Clone ID: PAT_TA_58820
gccggccggttaccgttacatggaagatgaagccgagaagctcatggcagagtcattctccaagaactttatcgattatgaagagtaccctcaatccgccgacatccagaaccgatgcgttaacatgatcggcgatcttttccacgctcctcccggttcgtcagtcggtacatcaaccgtcggttcctcagaagctatcatgctcggtgttctggccatgaagaggcgctggaagaaccgcagaatcgccgagggtaagagtacagaacatcccaatatcgtcatgtcctcggccgttcaggtctgttgggaaaaggccactcgctactttgagattgacgagaagctcgtctactgtacgcctgatcgttttgtcatggatccagaacaggccgttgacctgtgtgacgagaacaccattggtatgtgtgctattcttggaacgacttatactggtgagtacgaggatatcaaggccatcaacgatctcctcgttgagcgcaaccttgatgtcccaattcacgtcgatgctgccagtggaggctttgtggctccttttgtagttcctgacctagagtgggatttcagatgtgaaaaggtcgtctctatcaacgtctcgggtcacaagtacggtcttgtctatcctggtggtggttgngtcatctggcgatctcccgagttcctccccaagaactcgtcttcaacatcaactacctcggtgncgatcaatcatctttcaccctcactttctcaagggtgcatcacaagtcattggccaatactaccagctcatccgcctcggcaagcacggttaccgcgctatcatgagcaacctcacccgtaccgncgactacctg

SEQ ID NO: 58821 - DNA, 548 bp, Triticum aestivum
  unsure (1)..(548): unsure at all n locations
  Clone ID: PAT_TA_58821
gccggccggngtcaaaaacaaaagaaacgtttctctcgtctccaccacagcgccagatcggcgagcggcggtcggacaaacagcaaagtcgtcggcggcagcggcagcggctgccagatccaggcacgtgagcgccctcctctctctctctctcaggcctgattgcgctggcggcggcatgagggcgcgcgggagatcgcttgtggatggacggtggctgacggagcaggcataattgcgccagtggtggcctgatggcgcacgggagctcgcttgttcgaagcatggtgccgattttgttggatcttgatctgtctctttgtgcattgttttgtttcaggcacgcgaacgatgacttagctttacaacagctgctgcatgaaggagataatgaggagagcaagtggtacgagtagtagatcgacttgtaatttaaaatgcttcacggtcacagcagcattttttcagttaaaatgctttccagattgctacagatattattgtcacatgggtgatttttgaagaagaaaaatgattttagttttgtg

SEQ ID NO: 58822 - DNA, 242 bp, Triticum aestivum
  Clone ID: PAT_TA_58822
gccggccggtccgggacttccagtgtcgaagcgtggcttgcagagacgggtttcggaaaacaggactgggaaggggattttgtagcgaacgaagctaccttggttgattttacgggagaagatgcatacggcatagattgatttatagatgcgatgagtgacgtgatagaatgattatgaagtaatggtacacggctaaactcctctttaaaaacaaaaaaaaaaaaaaaaaaaggccccta

SEQ ID NO: 58823 - DNA, 386 bp, Triticum aestivum
  Clone ID: PAT_TA_58823
gccggccgggctggaaatgtacggcgagaaggtccagcagaagaaggtggaggcacagaagagcgagctgctgcagcagcaggtggcgaggaaaaccggagacctggagctgaatgccccttgatattattggtgtagtaaactttttattttttgccattcaaaagtacaaactatagtatagagacaaacatttcgtaagacattctttcattctataccagctaggtagcacaaagaaatcatgtggtaccgttgagttaataatgcgtattcagaaatgttcattttgtataaaatgcctattcagaaatgttcacttctcggaagtgggagatgtgagtacgccatcgtgatccgaaaaaaaaaaaaaaaaaaggccccta

SEQ ID NO: 58824 - DNA, 782 bp, Triticum aestivum
  Clone ID: PAT_TA_58824
gccggccgggctgcgacttcatcggtagctttgaaatcttcgttctgcaatacttctacctgctgtaagaagcaagcaagcaactaggagctaaccagccagccaggtgaagagagcatggcaagctaccaccgggtccacccggtgatcgtcgacggcgcgccgcccccggtgccggagcaaaacaaggacaagctgccaccgccaccctacggcgaccggctgccgatcaccgcccctgcgccgggcgcgccggcgcctctgaaggcacctcggcggaagcggcacagccggtgctgccggtgcgtgtgctgcacgctgctggtgctgatcgtgctcgtcgtcgcgctgggcgccacggcggggatcctctacgccgtgttcaggcccaagatccccacgttccgcgtggagcggctgacgtccacccggttcgacgtgaacaccacctccatgacggtgtccgacgcgttcgaggtgcaggtgataacggacaacccgaaccggcgcatcgggggttactacgacggcggctgggtcgccgcctccttcaacggcaccgagctctgccgcggcgccttcccgaagctctaccagggccaccgcagcacggtgcggccgctcatcacgctccagggggagacgaggctcgacagcgccgtggccgcgcagctggcccagcagcggcagggccgggttcgtgccgctcacggtcaccgcgcgcgtgcccatccgcatcaagtttggcgccctcaagctgtggacgatgaacgggaaggcgc

SEQ ID NO: 58825 - DNA, 402 bp, Triticum aestivum
  Clone ID: PAT_TA_58825
gccggccggtccggacctgggcatcagccagaacaagctcatcgaccccatgctggagtgcctcaaggagtggaacggcgagcccctgcccatcaacgtctgaagcatcgccggggccaccgtggaggagaggaggaggaggcttccagagtacatccaaaaataagacgcttaattcgttcgtgcatgttcttcttcttcaattcctgtcgccttttgcctttcgttgttcgtgcgttggtgttgatcgacgtgtggcgttgttgttgattgtgtagctgctctgccatggcggccccgcagctttacctaaagatattgtcgttgtattttggggtgaatcatgctaatactatgtggcttcttttttgcttgcaaaaaaaaaaaaaaaaaaggccccta

SEQ ID NO: 58826 - DNA, 801 bp, Triticum aestivum
  Clone ID: PAT_TA_58826
gccggccgggttacgaaaccatattacctccctaaagtctatcaccagataatactacttcgaaatcatggcttcagaactcaatgctggttccctcttcaacgtcgatggcgttgttgcggtcgtgacaggcggtgctactggcattggcctcatgttcgtcaaggctctgctccaaaatggtgcttccaaggtatacatcgctggtcgaagaaaggaaaagctggaccaggtagccggctcattgggtgacagggtcattggagttcaatgcggcgttacctccaaggatgaccttaagaatgctgtgtcacaaattgaaaaggatgtaggatatatcaacctcttggtctgcaactccggcattggagggccccaggtcaagcctattactcccgaaacgaccttggaggaatgggcacagtccaacctcgatactgacttcgatgcttacgtcaacacgtttgccatcaacactgcttcggtttggtacaccagcatggctttccttggactgttgaagaagggtaacgaaaaggccaatgttgaacagacatcgcagattattgttaccagctctattgctgcctttaacaagaaggctccctggtggttgggcttatgggcaatccaaagcgggtgctgttcttgccgcaaagcagcttgcagtcgctctacctcaatggaacattcgtgccaactgtatctgtcccagcttattcccctagtgaatgtctgagccaatcgtcaagatgtactcggacgaatcagggacacctggtgcgattccgacatcattgc

SEQ ID NO: 58827 - DNA, 460 bp, Triticum aestivum
  Clone ID: PAT_TA_58827
gccggccgggtcgggcatgcacattctacctgctcagtgttctacatgctcacacccggctgagaggaaccaggactttgctctggatcaccatgagaaggacgctgacgaagcactgcttctccgcgtagcggactacctattgtaaaggggacagaggtgatacattggataaacatgtacctgacactatacctgatcggaataccgtcccatggatcttgatcatcactgtgacacatgctggattcaacttgtatgagactatggactgtgatgactcttcactgcggcgtataacgtttatgtcctcatggtggcgatggcacccttggtagctaggagcgctcgtgaagatccaaagaccaagtcatggtcctcaaaagagctgccaaatcctgacgaaacggcattgcgcactatgacagaccgaaagaaatgtataagataccggcaagct

SEQ ID NO: 58828 - DNA, 391 bp, Triticum aestivum
  unsure (1)..(391): unsure at all n locations
  Clone ID: PAT_TA_58828
gccggccgggtcggtactacacaacagaaagcattctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgaggtcccttctcgggggtcgacgtctgtgacgacgcccaccccaagtgtcccaagggctgctcggcgtgccgcgtggtgtcgacgagccccgaaatgtggcgctgcgcggatatgaaatccaccgtcgacggnacctgcggtggaccctgcaagaagtactgatcggttcatgccngnnttatgatatgttccg

SEQ ID NO: 58829 - DNA, 401 bp, Triticum aestivum
  unsure (1)..(401): unsure at all n locations
  Clone ID: PAT_TA_58829
ggccgccggtccggctgcaatctcttccagttcgtccctctctctctcaattcctgtgagatcctccttgggtcctcacaattggtattcagagccatgaattcgcgtccgactacgctcaaatcctcttgatccggcggtaaaattccactgcaaagggtgtgaaatttgctttggcaaaatttgctcaaaatcccgagcagggttcgctggattctgagcgagcaggaacggggccggcggatgatccgcttggggcggngctgatgattgtgtagctgctctgccatggcggccccgcagctttacctaaagatattgtcgttgtattttgggttttttttgctaccccttgtggcttcttttttgcttgcaaaaaaaacaaaaaaaaaggcccctaa

SEQ ID NO: 58830 - DNA, 533 bp, Triticum aestivum
  Clone ID: PAT_TA_58830
gccggccgggttccgataagaccggttcattttctccgttggacatattcatcgtcatatttttcagctttctcttacatcagagaagttcaagtttgcacctaaactccatcatggccagcaacgaccccaagcccgacaccgctaataacaagccggaaaatgcctcagacgatgctcgcgctgatgttacagcggccgttgaagagctcctaaactctctctccaacaagtttgcgggtgtttcctcagagatctttgctaagatggatgagatgtctcgaagattggataaccttgaggcagcccttcaagagagcaacaagccaaaagacggaagcgcaaacaaaccttaataggtttcatacatatatcaagagtacagggcgtttaggttatctcacgagctttgcttcattatacgcaaatagaagggccagcatgtctgcttgttacggtattttcattatatcgttacttcaagtaacccaagaatcaactacatacaaaaaaaaaaaaaaaaaaggccccta

SEQ ID NO: 58831 - DNA, 710 bp, Triticum aestivum
  unsure (1)..(710): unsure at all n locations
  Clone ID: PAT_TA_58831
gccggccgggtccggactgtgcgccggccgccacggcgttcgcggtcaccaagacgatcagcgtgacggggcgcgacttcaccgtcacggacgcccacggcgcggccgtgatgcaggtggaggcggccgtgttcagcttcctccagcaccgctccctcctcctcgacgcggcgtcgcgccgccccgcgctcaccctgcaggactccacctacctagcgagcacgaggtgggaggcgttcaggggggacagcaccagccggaggaacctgctcttcgtcgcggtgaagaccgcgcccgtgcagctcgccaggaccaaggtgcgcgtgttcctcgccggcaacggctccggcgagcgggtcccggacttcgtcatcggcggcagctactacgccggcgcgtgcacggtctctgctggaggtggcggcggcggcgacgactccgatggcaccatcgtcgcgcggatcagccgccagaacacggcccggcggcgcgnttcctcgggaggcacacgtataccgcgaggatcaaccccggcgtcgaccaggcgttcatcctcgcgctcaccgtgattcttgaccagatacatcactagcattggaaccgatcaatcgccgccaatttcgtttgtaaatcacttggtgaatacctccatttttcgttgtgaaaaaatcactacattcgaccagnnggtctttttttcactttctttt

SEQ ID NO: 58832 - DNA, 485 bp, Triticum aestivum
  Clone ID: PAT_TA_58832
gccggccggtccgggtttcttcctaccgatacgagctaggaagcgacaccttcatccgaaaccacctccgtcgcctctacgacgctatgttggagcagaaccttatcaaggttattgagcctttctcgcgcgtggagattgatcacatcgcaaacatggtcggcctcgacacccagcaggttgagcgaaagctctcccagatgatcctggacaaggtcattattggtgttctggaccagggcgctggctgccttatcatcttcgacgagacgcaccgggatgagtcgtacgatgcggctcttgcaaccattgagaagttgagcagcgtcgtcgatgttttgtacacaaaccaggcgtctatgctggaatagataggggttcatccgttgtatgtaatatgtcacacagtatcttagactaggcgtttcaaagagggaacacgatcgtctatgctggtcaaaaaaaaaaaaaaaaaaaggccccta

SEQ ID NO: 58833 - DNA, 325 bp, Triticum aestivum
  Clone ID: PAT_TA_58833
gccggccggtccgggttgaaactgtgcgtagatttcattgtgataaaaagtttagtaacaataactgtcttcaggctgttagtagaacaatgcacatcagaagggctctgtgttatggattgaaacgaaatgtcatttctgactggaagaaatgcaatgaggaatgaatcagcgtatttttggatatatactgcaaaatagttataatgtcagacaatgtgttacacatttacacatatacagcgaacgcaggtattactacacaaagttacattattgtacaagctatcattacgatcaaaaaaaaaaaaaaaaaaggccccta

SEQ ID NO: 58834 - DNA, 290 bp, Triticum aestivum
  Clone ID: PAT_TA_58834
gccggccgggtcgggtgcatctcgcccgacctgtttcgtggggaagaagctttcgcaaacactgtggaactactaggcatgcgccgggatagacgggtccttggctgcgatgttgcttgacgaacgatggaaaaagaaactgtacttagccatgtattacgtgcgttgtcagcggaggcaaagccagcgtgtttgagctggaagttaagaagaacagggtcacagcgcttcatttcaactatttattacatatatagcactctcaaaaaaaaaaaaaaaaaaggccccta

SEQ ID NO: 58835 - DNA, 404 bp, Triticum aestivum
  Clone ID: PAT_TA_58835
gccggccgggtcgggatccttcttctcgacactctcccctcaatctcagagccctccctccctccacatcatcacaatggcttctcgcaacctctccaaggccctccgtggccctgcccgccagctggcttcggctccccgtgttcagcagcgaacttttgtatctgctgctcgcgctgctgtccgtgccggtgctgttgcccgacccgttgcttctggtcctatccagcagcagatccgtggtgtcaagaccatggactttgccggccacaaggaggacgtctatgagcgtgccgactggccccaagagaagctccttgagtacttcgagaacgtggacgcctcgaaggtttgttactctggttgttatgttgtgccaaaaaaaaaaaaaaaaaaggccccta

SEQ ID NO: 58836 - DNA, 591 bp, Triticum aestivum
  Clone ID: PAT_TA_58836
gtgcggcgctcaggcggcggtcgggagccctcataccacaatctgtgtttacgagcatcaccgactcattgaccatgcatctcaaccggcaccatgatcggtgctcccgactagcccccaagatcggaatgctaacctcgagttctccggtgagactctaccgcttcctgcctcgtctgaagcgatgcctctctcaactatgttgtgctctccatccgctgggtacacccaatacccaccgacctcccgactccttgacccgcattggctgcacatctatcaacatggagagggaaaacttgatcgtggtgggtggcacaaccatctcgcgactgactcactgtctcggctagtcgacgcgcaaggtgaccgcacgatgctctgcgtagtctccgccaccgtccgtgccctgaccctcgctgatgctgcagtaggtgtatcacgctgttaccacgttgctctgccgtgcctcgcattggaagaaacactctgaccatcctcgtgcccaacaacgcccgtgaggctgccaagcacatccgcttacgaccccatgagacactaccaatgctcatgtctcagtcttgggtactc

SEQ ID NO: 58837 - DNA, 448 bp, Triticum aestivum
  unsure (1)..(448): unsure at all n locations
  Clone ID: PAT_TA_58837
gccggccggtccgggtggttcttgagatggttggtgcaagggataagaatatcagtccaaatactgaatctagcagccaatatttccctcaatggatttatgaacatctagatgaatattgtgttagtgcttctgagattaatggagaaatcacggaggttgtgaggaagatgatagtggttgggctgtggtgcattcagttacgttctacagatcgtccaacaatgactagagtcgtcgagatgcttgaagggagcacaactggccttgaattgccaccaaaagtgctcttgagttgataggtttatattgttctcgccaacttactccagtattgcctaatctgtaaacagactgaaaattttaattttcaaaaaagagtaaagtttgaataanaaaaaaaaaaaaaaaaaaaaaaaaagaaaaaaaaaaaaaaaaaaggccccta

SEQ ID NO: 58838 - DNA, 230 bp, Triticum aestivum
  Clone ID: PAT_TA_58838
gccggccggttccgggaatagcctacctgttggttgctagggttgtctggtagatatcctcccatccatgaatgccaagatgaccttaccccaccactaacctgtggaagttgagccttgcaatagaagctttctataaagaaagggctagacatatgtttttttactttttcataccaatccattgctacctattgatcatccaaaaaaaaaaaaaaaaaaggccccta

SEQ ID NO: 58839 - DNA, 496 bp, Triticum aestivum
  unsure (1)..(496): unsure at all n locations
  Clone ID: PAT_TA_58839
gccggccggtccgggcggtttcccaagcgacgaggaaaccaggtcaagaagaccacctacgccgcctcttctcagatccgagccattcgacgcaagatgaccgacatcatccagcgtgaggcttcaagctgcactctcacccagcttacctccaagctcattcccgaggtcattggccgcgagattgagaagtccacccagggcatctaccctctccagaacgtccacatccgaaaggtcaagcttctcaaggctcccaagttcgaccttggtgccttgatggctctgcacggcgagtcaggtaccgacgaccagggccagaaggttgagcgtgagttcaaggagcgtgtccttgaggaggtttaaaaggattattttggcaggttggcgcggggtaggcaataggggcctcgcggcgaataaactcatccctaccnnaaaaaaaaaaaaaaaaaaaaaaaaaaaaaaagaaaaaaaaaaaaaaaaaaggccccta

SEQ ID NO: 58840 - DNA, 487 bp, Triticum aestivum
  Clone ID: PAT_TA_58840
gccggccggtccggggatggtcgattatcccttccggtgccaagatcggcatcaacccttgtgtcgtcacacgcgatgtcggcgtcttcggagaagatgttgatgttttccgtcctgagagatggttacgtggcaagggagaaacagaagaaggtcatgcttctcgagttagacgtatgcatgagtgtaccgagttgatgtttggccatggatcaagggtttgtatgggcaagtacatgtccaagttggagatgtacaaaatgtttgcgacactttacgtgaactttgatgtacgaatcacagaccccagccacacatggaagtatgagaacaattggttcatgtaccacagagatatcccttgcaaaataagtcgtcgcgaaaaggcataagcgcgtaacagattaaatagcaatagttctttctgtctcatcttaatgaagaacatactttttcaaacaaaaaaaaaaaaaaaaaaaggccccta

SEQ ID NO: 58841 - DNA, 372 bp, Triticum aestivum
  Clone ID: PAT_TA_58841
gccggccggtttcgggatgtattactgaataaatatgacggaacgcaatggcacacctgggttatagagaagggaagcccgcgacaggggaggcaaggcggatgaatgggcttcagagtttcactcttggaaggcatcagtattttttctaaattatccattatcaattaccagatgattgccgtcaaggcaagggaactgtggcggggttattacacaggcaaaagagctgcgggcggaaaagggaccttggcagacctgcctagtttataattgagacacaagtcgttaaatgcgttgaaaaaaaaaaaaaaaaaaaaaaaaaaaaaaaaaaaaaaaaaaaaagaaaaaaaaaaaaaaaaaaggccccta

SEQ ID NO: 58842 - DNA, 142 bp, Triticum aestivum
  Clone ID: PAT_TA_58842
gccggccgtgccgggaagtatagtcagcgggtagacgtgagccggtcaaactatttgctcagtttttttaatcactctatgtattatattccattcaataaaatgtcatttgcaagaaaaaaaaaaaaaaaaaaggccccta

SEQ ID NO: 58843 - DNA, 733 bp, Triticum aestivum
  Clone ID: PAT_TA_58843
gccggccggtccgggattgaagcatcccactaccaaaagatccgtgagggagactcaaagagctcatcgctcgagtaccgcactatcaagaactatggccgaactcttgctggcgttggcttgtatcctcttgacaccgagaagctagatgttggcgagggacctgctttggagtacgatatgtacttgtacaccaatacttccgcggctaacgtgaccattttcatgtcccctggtgcgaactaccttggagaccgaaacccactggagtatgccattgtgctgtatccatccggcgaggagcagcctgatccaactcttgtccgaccaattggacccaacgtgggcaccaacatgcctgatggatggggttacgcagttggaaacgctgtttggggtctatatggtaactataccacgtcttcattcgaggttcccaaggagggagcctatactctccgtatctgggccttgttgcccaacatcttgattcaaaagattgtggtcgaccttggtggtgtgcgacagtcttacctcggacctccagagagcttcctccttggccgggatgagcaaggcaagtacaacggtacttcgttcgcaagcacgcctggcattttgggaggaacctatgacaagtcctcataatgaaggcatggacatgatgtaacgacctcaacttcatagtaatactatttttgcactacaaaaaaaaaaaaaaaaaggcccccta

SEQ ID NO: 58844 - DNA, 766 bp, Triticum aestivum
  unsure (1)..(766): unsure at all n locations
  Clone ID: PAT_TA_58844
gccggccgggtcgggcactgtgccacgactcatgcttgtcctggaccctattcccgtgaccattgaggatcacgaggaaactgtagaacttgaggttccttactcccctaaggaccccaagttcggtactcacaaggtccgatttaccaagactgtctacattgaccgatccgatttccgagaggaagacattaagggctacttccgacttgcccctggtaagaccgttggtcttctcaacgctcctcaccctatcaaggctacttcgttcgagaaggatgagtcaggtaaggtcactagcatcaaggctgtgttcgacaaggagagcaagcccaagacctacatccagtgggtgcccgagggctccatcaagttggaggcccgtgtgcaaagccctctgttcaagtctgacgaccctactgcggttgagggcggctttttgaacgacatcaaccccgacagtgaggtcgtctaccctgaggctcttgttgaggagggttttaatgaggtgcgccagcgcgctccttggcctgttacagctggtgagaccaacgaggctagcggccccgagagtgttcgattccaggctatgcgtgtcgcctactttgccatggactcggatagcacagatgacaagattgtgcttaaccgtattgtttctctgaaggaggatcgcgaaaagaactagttacagtttataaactaagtcngaagaaaaaagaagaaaaagagaaagaataccaaaaaaaaaaaaaaaaggccccta

SEQ ID NO: 58845 - DNA, 785 bp, Triticum aestivum
  unsure (1)..(785): unsure at all n locations
  Clone ID: PAT_TA_58845
gccggcccggttccggagcagcaaccttcaggtctatagcaaagcagaggatctaggaagcccaggcagggtcgagatcaactactaaagcatccggcgagaatggttgcgacaaagacgggcgagctgagggcgctgttcttgtcactggaccgggacgcggacggcaggatctcggccgtggagctgcgggggtgcatgcgggcgacgctgggcgaggacgtgccggcagaggaggccgaggctctggtggcgtcggcagacgcggacggcgacgggctgctatgcgaggccgagttcctcgagctggcgcagcaggcggcctgggcgggtgcggacaaggagaacgatgagctgaggatccgggcgctgagggaggcgttcggaatgtacaagatggaggggcaggggtgcatcacgccggccagcctcgggcggatgctcggcaggctcggggccgagcggggcgcgggcgagtgccgtgccatgatctgccggttcgacctcgacggggacggcgtgctcagcttcgacgagttcaagatcatgatgagctagcaacctcgcgcctggacccaagtatatacccctagtttgggcttgcatataggccttcgctacgttcgttcgttcgttcattcattcattcattcgattgtcatatggtactagtacaaagttgtaatggtgatgcacagacagtaattgatctatgtgaatacctttggtctcgatctcgatcgattgtcggtactcttggaaaaaaaaaaaaaaaaagcccctan

SEQ ID NO: 58846 - DNA, 381 bp, Triticum aestivum
  Clone ID: PAT_TA_58846
gccggccgggtcgggcttttgagaagaaacaggaatggcggtgtcgtggctagggagccggaggatctgtatgatacctagacttatctgacctctaaaacttgatgatgacctcttatctcctacaaaaaaaaaaaaaaaaaaaaaaaaaaaaaaaaaaaaaaaaaaaaaaaaaaaaaaaaattttggttaaaaaaaaaaaaaaaaaaaagggcccctgggcccggggcggtccaaaaataagggaacccccggggtggaggaaatccgaaatcaggttaacaaaaccggccaaccccgggggggggccgggaccccaatccccccaaaagggggccgattaaggggggtccatgggcggtggtttaaaaccgccgggcc

SEQ ID NO: 58847 - DNA, 430 bp, Triticum aestivum
  Clone ID: PAT_TA_58847
gccggccgggtcgggtcttccgtagtatagtggtcagtatgcaagatatgtcagcacgtacttcatacattgcattttggattgtgtcttgtacagtgcactagtcacgaaccgactatgccttgaatcattgtatggcgacgaacgaatacagccagcgattgcgatcaacttttgcattgggaggagcccacgtggcgttttataccccgaagagagggcggtgcaggaatctctcggagcatcagcgacatcagacggtcgacgctgttgggtcctggaataagatgccgctcttagaacttaacttgtctatgtaatgtctttggattggatagtgtatagtgtctttctgattttggtaattgaaatcctctcttgcctttgataaaaaaaaaaaaaacaaaaaaaaaaaaaaaaaaggccccta

SEQ ID NO: 58848 - DNA, 363 bp, Triticum aestivum
  unsure (1)..(363): unsure at all n locations
  Clone ID: PAT_TA_58848
gccgggtcggtatagangactgccgggccggttcgcagaatccagctcctccaggtccaagcacaggtactgggaccagtacagcaactgaaggaagtactgcagtgacacgacgtaccgtgtcacaggctgcttaattgagatatatctatgttgttttatacaaaatgttcttatgtgtctctgagagtgtgggtttatcgtatgtagggtagcgacgtaactctataaattgttccaggaagtaaagagttgactggtatgtgttacagcgataggttagatacaattagttagaatagtgaaccaatcttttatgtgtgtacctaataaaaaaaaaaaaacacgtccctagggtcgtct

SEQ ID NO: 58849 - DNA, 505 bp, Triticum aestivum
  Clone ID: PAT_TA_58849
gccggccgggtcgggatgatttcttcacaccatttgtctatagtcagaccatagaaagtcgaaaccacagtttatgctttacttaagatcttacaagaaacagatgtacaattatgctttgccctttgattattctctcttgtactccacagtgtgcagtttgactattaattctcaacatgatttagaattttggattaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccgcacataaaaaaaaaccccctcccaaataataaagaaccccccgatctagaggaagcccccaacccaattcacaccctagagagcctcttctcgcgcgccgactgggaataaatttaaaaacccccccgtgtgaaaaacctctgtgagacgccaaataaaaacgctcgcgacagataacccccttgccacacctagctacattgcaaaggggcc

SEQ ID NO: 58850 - DNA, 384 bp, Triticum aestivum
  Clone ID: PAT_TA_58850
gccggccgggtcgggaaaaaaaataacctctcccacaaccaccccaacctcgcaaaaccaatccacccgctgccacaatggagaacggtgccatttctcaaggagagggcaaggacccttcaagcttcctcgggaacatcatcggcaatcctgtcactgtcaaactcaactctggcgtcgtctacaagggcgagcttcagtcggtggatggctacatgaacattgctttagaaaagacagcagagtatgtcaacggtcagaagcgcagggaatacggtgacgcctttgtgagaggaaacaacgtcatgtatatttcagcagactaatgggagcttgacgtataatgaaaacctatcacaaaaaaaaaaaaaaaaaaggccccta

SEQ ID NO: 58851 - DNA, 356 bp, Triticum aestivum
  Clone ID: PAT_TA_58851
gccggccggtccgggcccttcagaagttgagagtgacgctcccaagaagaccaaggaggagtggaaggagatctcccagaagtacaagagcaagaagctcacaaaggaggagaaggagaagcgtgtccaggagcgcatccaggagatcatgcagcgggattaaaaagttgctttatctcattgggtcacgggcatttgaggattgttggcctttgcattgggtttggagtttcgaggaaagggacggtccataaaaagggccatatgaatgaattaccaaaaagataccttccagccaaattccatagttctggtgaaacggcatctcataaaaaaaaaaaaaaaaaaggccccta

SEQ ID NO: 58852 - DNA, 212 bp, Triticum aestivum
  Clone ID: PAT_TA_58852
gccggccgggtcgggtgctcatagcgagttcccaaacgttgcggcaaaggcacgatagcatttgggcggctatacctttgctgggaagggtttggtagaccacgttgcggcgctccgcctcaggactgcttagatacgcatatttgagttccgcgctgtaagagaaagaaacacgcatgcatgaccaaaaaaaaaaaaaaaaaaggccccta

SEQ ID NO: 58853 - DNA, 326 bp, Triticum aestivum
  Clone ID: PAT_TA_58853
gccggccgggtcgggacgaggagacagcgccgctggcagcgtcagcatcaacatggctgtccttgccctcgccggtgtcgctgctctcgcccagatcttctaagcatagatgaggcaagattactagcttttctctttaaaggcgtcattctctgtcgtcatcatgtttcctgacttttcttttacgacatcttgcgcttgatcattcttcatggggcacaaattgcttttcatgggggcggtaactgcgtgtaaaggataacccgttagagcttaataatcgattgtatttggacttttaaaaaaaaaaaaaaaaaaggccccta

SEQ ID NO: 58854 - DNA, 261 bp, Triticum aestivum
  Clone ID: PAT_TA_58854
gccggccgggtcgggctactcgcgtcagccctgaccagcttcctcctctgcccgctcacgaggaggtccccgccgagaagatcgacgcttccattgacaagtggttcttcatcagcggtgcctctgcttaagttttgtagaccatcttgcataaaaagaacaagtcggatgggcatgttttcttcataaaaagttgagcgtatacgcttagagaaaaaatgatgccaattgtcggaaaaaaaaaaaaaaaaaaggccccta

SEQ ID NO: 58855 - DNA, 832 bp, Triticum aestivum
  unsure (1)..(832): unsure at all n locations
  Clone ID: PAT_TA_58855
gccggccgggtcgggactacaacccatcgcccgccatggccgaacgcaatctctctcagatcatctctcaactcaagcactccccctccatgagctatactgatgccaacgccctcctctctaaggccaagctcgctctactcaaactcaacgccctgacgccatctccttcgacccccacccagcttctgcctctcgcccgtgagacttatgaacagggcgccttatttgccatccgcgctcgcaaccccgaagccttcactcgctacgtccagcagctccagcctttctacgagctgccagcttccgttctcccacccaaccttctcgagcgtaacaaggttactggtctgagcttgcttcttctcctgacacagggtcgatatggcgagtttcacactgagcttgagagcttggagaaccgtgaaggaggtggcggtgacgtcgagagtgatcgatacctgggctatcctatccgtctggagagatggttgatggaaggatcctacgaccgggtgtggaaggccatgaagagcagtgaggtgccttgcgacgagtacagcgtattttctgagatccttaagaaccagattcgttccgaaattgcttctagcagtgagcgtgcgtaccccagcttgcctattagttctacaaagtcccttctcttcctggattccgagggcgacgtcatttcctttgctcaccaccgtggctggattgttcgcgacggtcacatctatttccccgatgctgctgaaggcgagaatggtgaccagaacaaggagatgagccaaatggtgatagangatgctctgggctatgcccgcgagct

SEQ ID NO: 58856 - DNA, 766 bp, Triticum aestivum
  Clone ID: PAT_TA_58856
gccggccgggttccgaaaaactctctctctctctctctccgcagcaagagtgaacggcgaccggagcggtgcgggcgctggcagaacgaccggagcggcgcggtccccgtgcagcgctgttcctcgtcagcaattcaatctctctgacgcatctctctctgcagccgcagaacgaaggaagggctcccctgtagcgccgttcctcgtcccgatccgcacggatccgccccacctaagggccccgtgcacaaggagcaaagatgataaaccttttcaagatcaaggggcagaagaacgaagaggcagccaactcgaaaggggggcctcccgtcaagaagcaaagtcctggggaattacgtctccataaagatattgctgaacttaaccttccaaagacaactaaaatttcctttccaaatggaaaggatgatctcatgaactttgaagccactctacgacctgatgaaggatactacgtaggtgggacatttactttcaccttccaagtatctccttcctaccctcacgaggctccgaaggtcaagtgcaagaccaaggtttaccatcctaatattgacctagaaggaaatgtctgcctgaacattctgcgtgaagactggaagcctgtcttgaacatcaacaccataatatatggcttaaaccttcttttctcacaacccaatgacgaggaccccttgaatcatgaagccgcggccgtcctccgagacacccacagaagttcagagaaatgtcaacggcgatgtcg

SEQ ID NO: 58857 - DNA, 454 bp, Triticum aestivum
  Clone ID: PAT_TA_58857
gccggccgggtctcgaattggagaaaaagactagaatttgggtgttgacgacgcggcacaggtacagatgggagagaatacctgcctgtatggtgctatgatgggatgaaaggaagggaagaaaggttcgggaagcgcggggaccgataataacctgttagattgttgcaggaaccgaattgtggcttgtccaaacagatgtggctgcatgaaagtcgacttgctcttggaccgacgttgatggacggattaaagttcaattttcgtgttcgtttgtcatagttactctagtacctattccctgggattgtctgcttcatgcacacagcctgcctccaactctgtaggtcctcctacaaacagttagttacctagtagtcgaaattaaccacaggcggctgaataattgccccggtcttagacctccgaaaaaaaaaaaaaaaaaaggccccta

SEQ ID NO: 58858 - DNA, 655 bp, Triticum aestivum
  Clone ID: PAT_TA_58858
ctgtgcggcgctcaggcggcgggctcatcaagacccaagctcatctgccaatccacaaaccactccaaagcaaacaagtaccggctaaggagcaaacaagtaccggctaaggagctcaaatggcgtcccagctggttgagagccaccgtgccggctccgaggtccacaaggggaacgatatctgcaagaagaagaccgtcgagcttctcgaagtgcttggcctcccgaaaggcctctttcctatggatgacattgaggaggtcgggcacaactgtgagagtgggttcgtgtggatacttcaaaagaataagaaaaagcacatgttcaacaagctcaaccagaccgtcttctacgacactgaggtgaccgcttttgtggaaaagggcaagatgaagaaggtcaccggggtcaaggtcgaggagttttctttggtcgaggtctatgtggatgagtcttctgctgataaggtcaccatcaagaccgacaccggtctggctgacacccatgatgcggtcgtgttcgctctgggagaataggaagctactagttaagaaggccagaggaataaagtcagtgaatagtttggcactacagttcacatgttatgcagaagtatatgtttccgttttctttataatccaatagagaatgttgc

SEQ ID NO: 58859 - DNA, 786 bp, Triticum aestivum
  unsure (1)..(786): unsure at all n locations
  Clone ID: PAT_TA_58859
gccggccgggctgcgggctggttcctttggttatgctgcccccgaagtgatgcgtaaggaaggccacggaaagcccgtagacatgtggtctatgggtgtcatcacttacactctgctctgtggttactcgcctttccgaagcgagaacctccaggatctcatccgagaatgcactgataactctgtcgtcttccacgaacgctactggaaggatgtcagcaacgatgccaaggacttcatcctgaagcttatcgatcccgatgctgacaagcgttggactagcgaggaagcgttaggccacatctggctcactggtgagaatgccactgactacaacttgttgcccgagatcaagtcgttccgcgccagaagccgattcaggcgtatcatcgaaaagatcaagctccaggcccgtatcgaaaagctcaaggctatggaggaggatcccgacaactcagatctgtcggcaatcttctccgaggttgccagagcaaagcttgcagacgaaaaggaggaacgagaggttctccgcatcacgcaagaggtcgaaaaggaggtcaagcgacgcagcttccaggcttaagaacaatatttgtgttcgttatagactgcaagaatcttgctttattccagcgtacacatcgatatgtgactttacaaaatgtcaaggcagtggnttcaaataagaaagatggggatgccagatacaataagttgggggcgagatgatggacaggggaacttggaccaaaatccatgtatgtctcatcgggatgggcaaagcga

SEQ ID NO: 58860 - DNA, 669 bp, Triticum aestivum
  Clone ID: PAT_TA_58860
gccggccgttcccggatacacctcactgcggccacagtaaatccaacacatgcatttaccccctccagatctcgcccgccgtttggcgatggcgattaccaagggcgatacctcgatggttcattctcttatcatgcagaaatctccctcgttcaactggactggcggacctctcgatgaagagaagcgcactagtgccatgaacatggcagcccatcgcggtcattctaaaattctcgaattgttatcacaggttgaaccccgcgccaaccttgccgccaacgatcccaacgacaatggcatgacccctctgcattgcgcttgccgaggtggtttccccatcatggtccgctggctactccaatttgacaccgttaaggctgcagtcgacaagaaagacaacgaaggccggactcctctctcgtatgccgcccaggttggattcgagcgtacggtccggtcgctcctcaagttcgatgctgtcgacccattttcatacgatcatcgggaaaaaacgccttatgactatgctgttaatggcgggcatagatacgtggccaaaatgatccataataagaaggatacccgaaaccaagtacgctggtaattgctacaagggacgactgtactttaattacaagcgataatgctacatccacgtttattgtg

SEQ ID NO: 58861 - DNA, 303 bp, Triticum aestivum
  Clone ID: PAT_TA_58861
gccggccaggctcggctgccagacccactatgacgcctatgtgtagccgccaaaggggagggaacggtggctgctgagcagtgtgtaccaccctcctctggacctttgatgagttcagcggttgaagatgctggtacaaatggcgtgcaaggaaattgattgccctggtggcgatctccttgtacaaggacaagtctgctttgctacaacgcgtccctgctcgttgttttgtcgcagtattagttaattaactaaacaaataaaaaacatgttcaataaaaaaaaaaaaaaaaaaggccccta

SEQ ID NO: 58862 - DNA, 585 bp, Triticum aestivum
  Clone ID: PAT_TA_58862
gccggccgggctccggaaaaaaaaaaaaaaaaaaaaacacaattccccaccgctcctcgacccccatcctctcgcagctcgaaccaagaagagatcttcagccatgtcggggcgcggcaagggaggcaagggcctcggcaagggcggcgccaagcgccacaggaaggtgctgcgcgacaacatccagggcatcaccaagcccgccatccggcgcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggtcgcaccctctacggcttcggcggctaggctcttccttgcccccttgcagatcccaaaagtttgatgataccgcgacttgtgtagttctctacttcctctgtagttcgctatttcctctgtatttcgaactgaatcgtggagcaaacctattcgcagtttgttagaattcacaaaaaaaaaaaaaaaaaaggccccta

SEQ ID NO: 58863 - DNA, 398 bp, Triticum aestivum
  unsure (1)..(398): unsure at all n locations
  Clone ID: PAT_TA_58863
gccggccggngtcggactcattaattggaatctctggcatggtcagcttcttgcaggatactaccttgaacgaagagcaacttgattataccaacacgatccagacgagtgccaatagtttgatcatgatcatcaacgatattcttgatctatccaaggttgatgctggtatgatgaagttgaaacacgagtggttccacacccgttctatgatcgaggatgtaaacgagctcgtttcaacaatggccatcgctaagcggctggagcttaattatcttgtggaagcagatgttcctgcatgggtcaagggcgacaaagttcgaatccgccaggttttgcttaacgtcacgggtaatgctattaagttcactgccgaacgcgaggtctttagccgctgc

SEQ ID NO: 58864 - DNA, 426 bp, Triticum aestivum
  Clone ID: PAT_TA_58864
cgggcagaagaaaaagatcaccatcaccaacgacaagggcaggctgagcaaggaggagattgagaagatggtccacgaggctgagaagtacaagtctgaggatgaggaggagatgaagaaggtggagtcgaagaacgccctggagaactaatcgtacaacatgcgcaacaccatcaaggatgagaagatcacctccaagctgccggcggacgacaacaagaagatcgaggacgccattgacactgccatccaatgactggacacaaaccagctcgctgatgcggatgacttcgaagacaagatgaacgagcttgacgctctgtgcaaccccatcatcgccaggatctaccagggtgctggtgccgaaatggaaggccgcatggacgatgaaagcccgggctgcatccggcggtgctgggtccaaga

SEQ ID NO: 58865 - DNA, 425 bp, Triticum aestivum
  Clone ID: PAT_TA_58865
cggttgttccggttgggtggcctcagtgttagtaccacttggagtgggcggtagtaccactcgttctggagcagcgaggttctcttcctccttctcttccatgcttggccttggtccttggattctccatggtcgtctcggttgtgccttgtgtccaatggtgtatattcgaggtctcgtcatatgtcctcttggggcttggagagtagtacgagtgtacatggggatgaacgtgggatgctccacatcaatcccatcctccgaggactttgagttaaaatcatcaagtgaggaaaacccaaatcccaaacccattcacctacgaacccaaagtgattgagcatcacttaagagattgttcctgtgtggaaccgacgcttgttaactttgagaactgtgtatcctccagaccgttaggcatcatg

SEQ ID NO: 58866 - DNA, 386 bp, Triticum aestivum
  Clone ID: PAT_TA_58866
ccgctgccgctctttaaaagcaaggtttgaagaaggtaaacgctgtaaggagaaaaattcccatccctttcaaataaagacgcgagaactttgaaattcattccaaatagtggcaaaccagctatagaaagcaagcaaaagaatagtcgcgtcgggcacctacactagtcttctggtcttcccgccagcgcgaagcatggaacttccactaagacgtgggtgggacccccgtgaggctctggggcaacactcaggagactccggggcgtgtaaaacctcactcattattacatagagtgtcacgagcagagacctatgaggcgcatggtgataacccacaagtttatggggatcgcaacagtttttgagggtagagttattaaccc

SEQ ID NO: 58867 - DNA, 411 bp, Triticum aestivum
  Clone ID: PAT_TA_58867
tatcaattaaaaatccaacataattttccctgcaaaaaaaacaatcgaatttgaaattttgaaatgctaaaaaactattattgaaactaattgtcggtttgccatgtttttaaaatttatacccatttcttactacttatagcccattttctgggcaagcgaatacatccctctcgtcttgaaagatttacagcttagcagggctgagaaaaggaagtaggcctccattgggtattcttttaagaaaatagaactggactagccattttcaaaagaaaaaacaacaactgggctcatcatgtggtgaatattatataaaagcctgggctatacggaccacagcccccgcaaagccccgttgataactgctccacctctaaaactaaataataactacccgacctgctgagt

SEQ ID NO: 58868 - DNA, 332 bp, Triticum aestivum
  Clone ID: PAT_TA_58868
cggaaatctgatggtctgtaatgtgaaagcgaagttctgttctgtcttcacaaaaaaaaataataaaaatgggtaaaaactaaaaaaaaaatcaagtcaagaaaaaaaaaaaaactaaaaaacaaagaacaattatcaaaaaggtatctaaaaaaataaataaatgatgcaacattaaaaatgctcaactaaccaaaaacagatcatacgaagacccctgcctagtgtttgcacttcattaagtgctgcatacggtatagcaaccctgagaatactcccaataatttattatctatgattttttttatgttactggtgatgtgaaaaccctg

SEQ ID NO: 58869 - DNA, 326 bp, Triticum aestivum
  unsure (1)..(326): unsure at all n locations
  Clone ID: PAT_TA_58869
caccgggaatcaagcaaaaaaaagggaatgtgttttccttaccaaggttggggttccggcgctcaagggcaacatttatatggagtagtgggagttgttnagacaagccggccggggtcaaaccgaatgctcgcctcccagtgaacctgcgcatccgactgctcgcatgcctaccaaagtttcacacaactactcgcacgcctcctgatgacactgcgcagcgagcaaccctccgttaaatcacacacctgcacgcacgcctccccgtctgcctgcgcggcggactgctancatgctgatacgtcccaacatatctataatttttg

SEQ ID NO: 58870 - DNA, 331 bp, Triticum aestivum
  Clone ID: PAT_TA_58870
cgcaggtggaaattcgtccggctatgccggcaccacccccccaggtgcgcattgatgtccatctcctgacacggatatggaggagcctcttaattgccggtagagcagttcctgatatatatcctacatggtagttgccaacttatcagccatttcaaggtataccatatcctgcagacagacgatttgctgctcctgtttgtgcatgcgtacatgtgcgtatgtatggttctctgaacactctgtatgatatcctaatctatctaattgtccagcgtttgcctgtgcaaatctcaagcgttgagttccatcagaatatgcacgtgaattg

SEQ ID NO: 58871 - DNA, 439 bp, Triticum aestivum
  Clone ID: PAT_TA_58871
cggcagatgcaataaactggcgaatgaagaaatcctgagtattgaagcttttgccattgagaatgtggaagaccaatgtcttcattgcaccgtcgagctttgctgatgaggaatgccctttgatgggcactagagttcgccttatgatatgatagatggtgcggggtagatactctaggtcttcaacaaagaattcctttggatattcagcgtcacgtggcagtggcttcatcatgctcagtatttggctcatgttgagctcagccttctgaaagatgctttccacaacatcgcggtgaagctgacaaccaggttcgtacagttcgcctggagtggatatgccggtaagctcaatgagatcaaaggctttggcttcatgatgaacattgcctgtgatccactcaaggacccatgtcgttgtatccctattgtagccgcg

SEQ ID NO: 58872 - DNA, 418 bp, Triticum aestivum
  Clone ID: PAT_TA_58872
cggtgcatcggaggataagtcgcgttgcggtggaagagaaggtcgcctgagcggccccggcatagaggacgacggctctgatgaagcatgagtacatgatgcaatgctattggtccgtcggcgtaggtgatagacgtcgatctctatcagtggacgacgcgagtcttggtaggtgctcccgtatgctggaagacagtggtcatggatgtagtataagactgttgctatcggtgatgtgtctagtgaaggctggtgtcaccatcgagtgttctaacactgactgtgtacgaatgggaaaatggacggagatgtctggggaaccatgtttttgggacgccactgtcagagatatgggaaagttacgaacttatacgccgtctataatttgggcatcacgtcggttgtggctcgcatcatg

SEQ ID NO: 58873 - DNA, 422 bp, Triticum aestivum
  Clone ID: PAT_TA_58873
tactactcattattccttcatccatcgtaagataacccaaaacttgaaaacttcaatcacataaaactcaacaaaaccttcgtgagatccattagtataagaaaataaatcactactataagtgttgtatcataccaattcatattttattcttgcattatatcaactgtattccaacttttctatggcaaaaactcatcaaagaaaaccatagagccatcaaaacatgcacacaacgcaaataaaacatgtcaaaaacagaacagtctgtagtaatctgggtgtttctaatacttatgtaactccaacaactctgaaaatttaggacggcctgagcaatttgcatattgatctactgcaaaatgaatggttattttatcgctctctggttaaaaatgagaattattttcatgaacataaaa

SEQ ID NO: 58874 - DNA, 148 bp, Triticum aestivum
  unsure (1)..(148): unsure at all n locations
  Clone ID: PAT_TA_58874
ntggtggggagtttgtggattagcgcgccagcgaggaggctcggagtcgccgccgcggggtcgcgctgtcttgtggcgagaggcggtgtccaggcccaggctgtatgagggtgaggcagattggcgttagtggtgcaggaattatggg

SEQ ID NO: 58875 - DNA, 333 bp, Triticum aestivum
  Clone ID: PAT_TA_58875
gggcggagtcaacagtaacgtctccacgaagtccatagttatcatctcagcgcaggatcgggacactccgcctcaatcaagtggtattaggtttcaggttgctcggtgagagtttctagttttcggagattagatatattttcttacctagtagccaagaataagccatacaacaaagagttatatccgttcatcctttatcgaagcgagtctgagcctttgcaattttctaatcattgcttgcatagtgtgaattatcggttgcatccacctgtaagttgctggtcttatcctcgaggatctttaaagtttcgagttctgttcacattagtc

SEQ ID NO: 58876 - DNA, 419 bp, Triticum aestivum
  Clone ID: PAT_TA_58876
cagcacctgtagcttaatgaggccagcgaaaatgtcgtcgttgctggcccgggacttcagcaatgccagctcgtcgtgatcgccgacacggcgagcaagcttgtgagagcccttgcatgctagtgagagctcgatcgagggctccgcagtgcgccgggacatctctgctacggttgccgcatggcggcgggacctctctagtgcttctgcggccttggtcttttttccctggtcacatgtccacccgaaactcctcctaccggtcatggcggaacgacttgacatgaaagaccgggttgtgggtgatgaggagaggaactatgaagtaatttttgagtgggtagtttttatagcccggtgctaagtgtgaacacatatttgtttgatcggtgtgaacagatttgcaattacttagtgca

SEQ ID NO: 58877 - DNA, 395 bp, Triticum aestivum
  Clone ID: PAT_TA_58877
tacattacacttcaccattatttgggcctagaggaaggcattgggaagtaataaatagatgatgggttgctagagtgacagaagcttaaaccctagtttatgtgttgcttcgttaggggctgatttggatccatatgtctaatgttgtggttaggtttaccttaatacttcttttgtagttgcggatgcatgcaataggggttaatcataagtgggatgcttgtccaagtaagggcagtacccaagcaccggtccacccacatatcaaattatcaaagtaccgaacgtgaatcatatgagcgtgatgaaaactagcttgacgataattcccatgtgtccttgggagctcttttctcattataagaaattgtccaagcttatcctttgctacaaaa

SEQ ID NO: 58878 - DNA, 291 bp, Triticum aestivum
  Clone ID: PAT_TA_58878
ctgtgtcagaactcagcgagcttccgatcgttctggccgcacatattatggacatccagttttggccactgtgggagagactacgacagacagcgatgttcacagtgatgatgtcagtctaagggccgactatacgattcctccgacatgcgtagccgatcgacttcatggtatccccgcggatgctactcttgtggcgaacctttcttgcgctctatgctcgaacgacttggaatgggtactcgctattatatcgcatttgctcgatcagttacctccttatgctatcag

SEQ ID NO: 58879 - DNA, 180 bp, Triticum aestivum
  Clone ID: PAT_TA_58879
tacggctgcgagaagacgacagaagtcgacggggaagacgcgacaatggatgcccatgctaagaggagtgcgacggttgactggttcggctgcgatgtgaggctgtcgtcgtcgcaaaataacaggggttgtgggtgagtatagggatggcctgcctagaggttggattaaggtcgggcc

SEQ ID NO: 58880 - DNA, 412 bp, Triticum aestivum
  Clone ID: PAT_TA_58880
gactactatgaagatgtatacaaggtttgatctgatcattaccaacttgtggcagacgcggaagaagagttggtgaagatcatcggtgcaggttgacgcagctagggttttacaacctcccaaccgcaagattatttctgggtgatggagcattacgaggctaaaaaatgggctttcaagtaccgaattgacttgtcaacattggtggcgtcaagacaactgtagtcagcttattccaaaaaggataggataagataatttgagtcaactgcgcagccgttgagcgacatggctttgctaaaccagtgtgagttactggtcatttccaacaaaaaccatgtgctacgctactgccatgttgtgaccattggaaagtgagtaatgcatgccgcttaattgcaccaactccaag

SEQ ID NO: 58881 - DNA, 386 bp, Triticum aestivum
  Clone ID: PAT_TA_58881
gagtaaaagaaaataactaaacacgaattttaatttaggttcacattagttcaaattaaatccattaaattataaaattccaatttaagctttgttaccaaataaaacaaacgaaaattttctcgccctaaattttggaaaactttttcttaagcattccgataatcgggatgttacacaccctgttcactaaagatgagagaactcgttacttttatatccttaaaatatttccattctcattaaagggtgatgctaagatatggtttaattctcttgatcctggttgtgtgcgtagtccccatgatatgatttattacttctctgctaaatatttccctgctcataagaaacaagctgctttaaaggatatatataattttgtg

SEQ ID NO: 58882 - DNA, 288 bp, Triticum aestivum
  Clone ID: PAT_TA_58882
ctatgctatgcctgatttggtacatcgttaatgtgtgttgtactgatgatgcattatatgtcttcacatgttcacttgggagatatttcatataccgccagctgaaataaatatactaccattaagttttgttcacatgtacgaatgtcgtcgtacatgttaacttttgttcccacattggtcctataacataccgttgatctaatgcattgcttctctaaccaattgttttcagttgcggtcaaataacaattgtacgtaccgctgaaatgtcagtcatgatcagtt

SEQ ID NO: 58883 - DNA, 253 bp, Triticum aestivum
  Clone ID: PAT_TA_58883
agtatccttgacgacattactgattgtaaactgcaaaactctgactggatatgcacaagctcctcttgagccattggcgtctgaaaggagtcggcacctgataagtctggagtctcttagcatggaggtctgccaaagttcactagagatgtacaacgtagcggcaactctcaagaatagtacgattgatgggtgaatgaagcctgaatccacatttgggaagatgcatggcatggcacagtgagtcggagtc

SEQ ID NO: 58884 - DNA, 384 bp, Triticum aestivum
  Clone ID: PAT_TA_58884
attcggacacgatggtgaatggcaatcgcgggacagatggggaaaagccacgtcaacctgatgcaaaggagatgcgtggaacaaatccaacaaaacttcatcacaccaacaaatcacatgacacggattggggctatttttggcggggattttcggatttaggacgaacacaccacaatcaatctagaaaacacggggtacgggctccataaacgtgatcaccgtggctcaagataccaacatgatgtagggcggaaccctaggggccgatctttcacatttggaatggatcctacaggggaaacacgaataacgcgcgaaaaacacaaagggaaacacggcgagatacagtacgatcacttgactgaccaggaatcaatcaca

SEQ ID NO: 58885 - DNA, 248 bp, Triticum aestivum
  Clone ID: PAT_TA_58885
tgggctgatagatcgtgggagtcagaacaactgcctgattggaggcgatgatctcaagagtgggcagactaggataaattccgtctgggcggagatgcatgtgggcgctggatgcaagctcaggcgacttggcagcgctgataacctggggaagtacgatggggtgggtctgtaggcgcatcagctgtccagtggcgggggtatgtccagcagtgacgtcgcggaggacacggacgcaagcaccggag

SEQ ID NO: 58886 - DNA, 165 bp, Triticum aestivum
  Clone ID: PAT_TA_58886
tgacttcaattgatggatggacccgatcttcgacatgctcctacactcaaagcaagtacatccctagtgtgggccgcagatgacgtggaggtctggcttattacaggacttgttcctgtttcggtagtcgaatgcaaatcaccttcgttaagggatgacgggatc

SEQ ID NO: 58887 - DNA, 382 bp, Triticum aestivum
  Clone ID: PAT_TA_58887
tacggcagcgagaagacgacagaagtcgcgggtatttcaaacaggtatgacgatcgttagcagagaccacctgggtattgccttgtacgtctgagcccctagctttcttggcgtatccgtcccgctatggatccgatgagaaggtttatcagaaacggcctcgagaagacaaaaaacttgaaagaaagagaaacgtgaaggtatgtggatccaagagcggttgagccgcattgtggaccatggtctagccgtgcctccgtccatgcccatggtattttaagtgcatattgtgtacggcgacacgaatttcatcgctttgttggggctaggacgtaggccggattgctagctgagctccggacgagtcagacggtcctgttgc

SEQ ID NO: 58888 - DNA, 226 bp, Triticum aestivum
  Clone ID: PAT_TA_58888
agtgggagcaacttcattacactacggaactgtaagtgaatgtcagctcagcgtgagtcgatttaaaacgtcggaactgggatggaactgtctggacatatgatatgcgtgttgcagtacagctgacattggagagcgtttcttgaagaaatttggtgggtagctatcactcatctgaacattgtgcgaattctgaactgtagactgtgaccctaaatgatactgt

SEQ ID NO: 58889 - DNA, 259 bp, Triticum aestivum
  Clone ID: PAT_TA_58889
acgatgaggtcatcatattgacaatgtcggtcgacggccagatcataggatggtgtctcatggcaaacaatccaccaggtaccgtcaataatgcctctcagctgcagaacggagtggcgtgaatactactagtactatccatgcagtggacgaatctggcagctgcagccattcaactcaggatactttagagggtaatgtgagctttgagttaagtgtaacattcatgcacatgagagcgtctaacgagtttcaatat

SEQ ID NO: 58890 - DNA, 187 bp, Triticum aestivum
  Clone ID: PAT_TA_58890
aaccacctggttgtgtatgcgtttgtcagggcctgatgtgtgcgcatgcacgtgtaggttgagcacttgagcatgaaagtgtgtgttggtcgtgtggtgtgtgcatgcatgcgtgcgtgtgtgcgtggctgcgtgtgtacgtgtgagtgttgcgtgcgtgcgtgtgtggctgcatgtgttcgcaccc

SEQ ID NO: 58891 - DNA, 481 bp, Triticum aestivum
  Clone ID: PAT_TA_58891
cggccatgccccgatagcagccacagggctttggaaggcgcgaatcccgcctaagattaaggtcttcctatggcaactatgccaagatcgccttcctacctctatcaatatagccaagcgcaatggccctgcttccggtccttgcgctttgtgtgatgatgcggaagatgctgaccacgtgttcttccggtgtcctttggtgcgctttgcttggagcgcggtccgtgaggccgctggggtggattaggatccacgctcacgctctgagcttgtgtcatacctatcgtcgatccagggccctctgcgccgggtcatgtggacgtctgcttcggccatgttatgggccttatggcatattcgtaacaagtttactattgagggagtgtttccccctcactccgctgatgtaatcttcaaatgcatcttattcttgcagcagtgggcaacgctgggaaggcaacaggagtctgatcttcatcac

SEQ ID NO: 58892 - DNA, 421 bp, Triticum aestivum
  Clone ID: PAT_TA_58892
cggcgcaaggaggcgccgagttagtcatgggcgcagtggtgttgaagtagtggtgcatcgagaagaaggcgttgtttatgaaggcatgtgtcagtgtttccagcatcgagcatgcatagacggatgatgacaaagttgacgaagcgccgcactagccttgccaggcacggggatacgtcatggacgaagggaaacatcggtattgctagcatcaagcatgtgtagatgtgggacttgcacgagctgtacgccttgttgaggagtcggagggccagtagagaagaagactcaataatggttgcggtgccaatcagcatggggccgatgtcgccattaatagtcggactagacgaagtggtcagggtagatgatggcgacgctggtgacaggctggtgctcgatgaagatgaaggggggttga

SEQ ID NO: 58893 - DNA, 463 bp, Triticum aestivum
  Clone ID: PAT_TA_58893
cggtataaggacaatgacagtggataataattgtcttatatatttaggaacataattgaaaaaagccacatgatgtaacgcccgaattacgcaagggcaaaagaagcgggaagacaatgatatggctcgctggtctctagtttcttgatgcgttgttgcaggccgcgggagctagtctctggggtgagcggcgatgagctctttcctgtcctcaatatgctacttgagagcgtccacggattcctccaccagccttttgcgcttcatgtgcagcacgacattctcgtccaaaagtttctcgacgatgacgttggtcctcttcaacaaggtagtggtctcctcctcctactccgcacttccgacgatcttcgccctcagcaggtcgcgctcggactggagcttctcattgctctcccttagttgccagatggcgccaatagcctgttcaaacgaggctttcatg

SEQ ID NO: 58894 - DNA, 429 bp, Triticum aestivum
  Clone ID: PAT_TA_58894
cggggtaaagccaatgattagaggcatcggggacgcaaccattatgtgcatgtgcagatatctgagtggaacttcattttttttccagttcaacttttgaatgtgtttcagttcgtctacttcccggtcgtcctgagctggagaattgctgctactgtttatgtgtttgcaaatttttgaaaacaagcttcagtacaagaaaaatgggtggtcagtccagctcctgcaaccaacacaggtcgttgccccttttgccacaacggtagcagcacaaacattagtgtggtcatcctcaaccagtttctcacgcggcctccccgcaagccctgctcatgatcaggataacctcgataggttacacatgttgctcacgaagctgataggttccacatgttgcccaggagtatacccgtatggagcggagatgac

SEQ ID NO: 58895 - DNA, 362 bp, Triticum aestivum
  Clone ID: PAT_TA_58895
tacggctgcgagaagacgacagaagtcgacggggctggcgtcggtggcttgctggccgtccttacttcttgcctgaccaacatggatggcttcattcacagccacctcaacctgcttgcgatagccagccatgcatgcacgcacgcgcatgtaggtgcgcacctgcctggaatgcagctcggtcagcaggctcgtcctcctgcatgcaccatcgagacagcttacctacgtccctctcgttcgtttgatccaggtcggcactgagcgcactcacctattcacgcagcatgcggtcagtcagcaggcagtaatcacccgccgggtaggtcaagctgatagtttatttccaaccaagaatttgg

SEQ ID NO: 58896 - DNA, 391 bp, Triticum aestivum
  Clone ID: PAT_TA_58896
ctttgatgaaactggcatgtaggacgccttcatgcaagattacgtcggcctggacctggacagcttcccgctcgaccactagtttccagaggactacgggctcgaggaagaggatgagttggacatcgacggggagcctttgttcgaggacgaggtcgccaaccaagccgtcgggttgtagccgaagcgcaagagcaggcggacgaaggcatacatgatggccgacgacaagctcctttgtgagtgttggagggacatcgggcaagaccccaagactggcggcgaacaaaaggcatcaacattttggactcgtgtccatcgcgagttccatgaacgcaagaagtctccatcgtagcaaatccaagcacgcacggggtgggtgtccattttg

SEQ ID NO: 58897 - DNA, 394 bp, Triticum aestivum
  Clone ID: PAT_TA_58897
cggaataatacaagatgctattctcaacacgagcaacctaccgcccttaggcgcctggtgaagacttcttcgctcactctaccaatcattggtggctttatgccccgcagctacttctaagcctcggaggaagggcctggcatccattgcactcatcccttgatgatgcggaatcacaggagcggctgcacctttaactgtgagcagccaagcctcaaccgcctacttgagcaaatcaaggatgaagctattgcctggggtcgcgcaggagctacagagtgtctcccctgtacttgggctgtccactagcttggtgttgcgtcgtaaccagcatttttaggctttaaaatagttctttctattcattcgacccagttggtgtggcacctcagtt

SEQ ID NO: 58898 - DNA, 369 bp, Triticum aestivum
  Clone ID: PAT_TA_58898
ccgggccgacgggtacggctgcgagaagacgacagaagtcgacgggtacggctgcgagaagcgacctgagctgtgtgcggtggtgtcataaggagcctgtccatctccactagagttatcccaagtttcacttcacatcgtgatgttgttttaccttttttttcttgtcgtcgtcccgctgcctgctataacgggcagcgctccctgttggcgccgccgccggcgggggtggtgccctggcggcggagggtgtatgtcctctgccgccgggtgctcccctgcttgtacctagatggttggttactctttccgtccaccattgtcaccggctaacattgtgataatatcagtctgggtaatgtttagaca

SEQ ID NO: 58899 - DNA, 412 bp, Triticum aestivum
  Clone ID: PAT_TA_58899
gctcatattaaagttctccgtcgcactgccatccctcttggcactaccgtgattgacaagatcaaccctgctgaattggtgaacctggttgacattttgggcccttcatccacaccggtaatgatcaccatcactatacggatgggagctaataacatgagggtgaagttgcctcatcccatccgtgctgtctgcaattctggacatattgtcacatggattactgatcccatgcacaggaacaccatcaccgccacatgtggactgaagactcatccatttgactctattaagaattacgtgcctccaatcttccatctgcactaccaagaaggaagccatccacgaggcatccaccttgaaatgacagtacagcatgtcatctaatacatcggtggatcacggaccgtta

SEQ ID NO: 58900 - DNA, 406 bp, Triticum aestivum
  Clone ID: PAT_TA_58900
caccacggagcccaacgacacctcttccctgcgcgcaaacagctgagcacgtcgcggtcgccactgatacacctcagcgccatgctgcaaagtaccaccagccgacacagcttgaagtccttggaagatatgtcgtgcgtagcacctgccgaccaggcatgacaaagcgtagcacctgtcggtcaggcatgacaaagcagttcgataacgggcacgcatgcgtcttaataaccattctaaaattctttcatacagcagcaagcagcaacagtggcgtgcaaaatttacatcccgatatttttgccacggcgcaaactcgaccagtagtccagtagtagtccgccgtaccaagtttatcaacacccgacggctaatcctagccactagctaagctgatgcttctccc

SEQ ID NO: 58901 - DNA, 416 bp, Triticum aestivum
  Clone ID: PAT_TA_58901
cagctgcttgcctatgctggcgagtgcaagcagctcgctggcataggaggtgggctgggccagtaggtgggcctgctaggtgggcttccaggtaagtcctctgttcctttttgttttctcttttttatatgctctgctctgtgtattgaaatgattaaaataccattccatttctaaaaatcctggaaataatcagaggcacatttgaaaatattctcaactgcctaaaagtacttccaagagtatttgagcactttaaaatatttatagtattgaaaatgcccaaattcaaatacttatggcttgttcaaaaatccagaatggctccataatttgcaagaccatttttggcaggggtttaaaccagagccaaaaatggtgggcttttatgaagggcattttggtttcattgaaat

SEQ ID NO: 58902 - DNA, 396 bp, Triticum aestivum
  unsure (1)..(396): unsure at all n locations
  Clone ID: PAT_TA_58902
cgggtcgtactgggacgtggcagctactgcctaaaggtctgcaacatggaggcaagtggcctccacctctctctcatactcgtttgcctcctctctagttataaaatatctcctttttacctgaaagttaaagaaggcaagagaangangggtaatatggacagcatgctgtctgtcaaagattattcggtacaggagggactgctcgttccttacaagaaactggtagcataccagagcattataatcaagaaaagtangtgctaattcaatgtcattcccctttatgggcaccctgagataattagctagacgagtggcataaattccaccaaagaaaactccatccttagcattaagatgtaacctcctcgcagtaatacccccaagttatat

SEQ ID NO: 58903 - DNA, 372 bp, Triticum aestivum
  Clone ID: PAT_TA_58903
tacggcagcgagaagaccgccgccaagtcgcccaagaaggccaccaagtcccccaagaaggccaccaaggcctagatcgtagtagtgcggtgtgctgatggttccagtttggttagatgtagtagctgtttcactctgtatcctgcgcccctgatgtaatcggaatcaaaggggaagccgcttgcttcctcttgacttatgaattagtatcaactaaaaaaaaaaaaaaaaaaaaaaaaaaaaaaaaaaaaaaaaaaaaaaaaaaaaaaaaaaaaaaaaaaaaaaaaaaaaaataaaaaataaaaataaaaaaaaaaaaaataataaaaataaaaattaaatattgaaagggtttgaagagaattttttttt

SEQ ID NO: 58904 - DNA, 99 bp, Triticum aestivum
  Clone ID: PAT_TA_58904
agtgcattcggcttgtgtgggagacatgccgcagcgagttcaagtcgcgtcagcacagtggcggccagggtcatcttcctctatgcttccgctaagggg

SEQ ID NO: 58905 - DNA, 367 bp, Triticum aestivum
  Clone ID: PAT_TA_58905
gctatatttttattcgccacatgatatgtgttttgcttggagtgtcttgtattatattagtatttgctttttagttttccagaatcatccttgctgtacccaccttttgggagaatcccacttgattagaatttattagaatactttatgtgcttcacttatatcttttgagctagatagtttttgctctagtgcttcacttatatcttttaaagcacggcggtggattaattttgaagaaattgttgatatctgatgattcacttatattattttgagagtcttttagaacagcatggtattttctatggttctgaatttggtcctagaatgatgagcatccaagttgggtataataaaaactatc

SEQ ID NO: 58906 - DNA, 419 bp, Triticum aestivum
  unsure (1)..(419): unsure at all n locations
  Clone ID: PAT_TA_58906
cccggaagagaccacggacatgacgagcagtctcaatatggtcgggacataaagattgatatattggaccatgttattcggacaccggaagtgttccggattgtttcggataaaacaggagtgccggaagggttaccagaaccccccggggaagtaatgggccttagtgggccttaggggagagagagagggcagcagccaagaggtggcgccccccaaggggagtccgaataggactaggggaggggggtgcggcccctctttccctctccctctccctcaccttccttcttctcctacttggactaagaaaagggggagccaattcctacttggagtaagactcccacccttgggcgcgcccccctaggaaggacngccttctcctcccctctttatatacaatggagggggcaccc

SEQ ID NO: 58907 - DNA, 283 bp, Triticum aestivum
  Clone ID: PAT_TA_58907
ctacagcatcgggatggtgctcctggcggtggtgaccgccaagggcgccgcggacggcggcgaggacgagggagaaggggaggagacgatggggatggtgaagatcggcgtgctgtgcaccgccgaggcgccggaggagaggcccaggatggcgcaggtgctcaccatgatgagcgagttcatgtagtgttttgctggtgtagtgtcacggaatttcttcgagctttgcagaagtagcctgtaggcaagaaagggtattgctttcaagaactggatacaacag

SEQ ID NO: 58908 - DNA, 383 bp, Triticum aestivum
  Clone ID: PAT_TA_58908
tgccacccaaagactgactcgggaaaagtgatagacggaaaggaactttttcccctcatctagatcgccaggcccccgcacagctggatcacctgtgtccgttcatcactcgatttggccttcttgaccgactgagagcggcaagtgaagatgtgcttgaagagtccccaatgggggcggcaacccaagaagttttcacacaagcaaacgaaagcagcgagatacacaatagaattgggagtaaagtgatggagctgcgctccgaagaagttcaagaagctctggaaaaaaggatgaggaggcagagagaatccacggcgatatgggtggtgaggaggattcactcaccatcaagaggctggggttcgacttccttccccgga

SEQ ID NO: 58909 - DNA, 397 bp, Triticum aestivum
  Clone ID: PAT_TA_58909
tgagtcacggaaggctggaagctatgttgagtagtgaacagatctgcacttctgcagttaggacacatgtaccaggctctgaagctttcctatgcatggaattgattgccgggagctcaactctatctggttattagtttcgtaatccaaactactgctgaaaccattcccctgttctaatcttgtagcatgactagcatctgcaggacttgttctgcttgtatcatttcctgtttcttgtctttaggtgccagtgtgtgtgttacatgtatactgtgttaccagcgttctgcctcaagaacacgcatgcacactagaatacgcatttgttagctgccagcaacttctggtcaagcttagcgataatttcgttcaagtagggatcgacatcgaggaa

SEQ ID NO: 58910 - DNA, 420 bp, Triticum aestivum
  Clone ID: PAT_TA_58910
cttggcttttcttaggtgattttaacgagatcttatcactagatgagaaggttggggggggggatcgaccacaatgattactggataatttcagggaggccctggagtcatgcgagctcagtgacattggctattacggtgataagtttacctggagaaaccatagtaaggagctcagtacatacatatgtgaacgcctcgatagagccacggtgaatgcaccctgttgtgattggtttcctaacttcagtgtcctcaacggggctcctcgtcactcggaccacaggcccgttattgtatgcactcagggatgaaatagaacggagcgatgtggggatcacgggttctgttttgaggcgtggtggctacaggacgaagggagtagtgaagatgtgcaatgggcacagggggaatgatgct

SEQ ID NO: 58911 - DNA, 359 bp, Triticum aestivum
  Clone ID: PAT_TA_58911
cgaagaacccaatgacgataagcggctgccggccgggaagtcagccgccaaagacggcggcgacaagaaaggcaagaagaaagccaataagagcgtggagacgtacaagatctacatcttcaaagtgctgaagcacgtgcaccccgacatcagcatctcccccaatgccatgtccatcatgaactccttcatcaacgacatcttccaaaaactcgcctgcgaggccgccaaactggcgcggtacaacaagaagcccaccatcacgtcccgggagatccagacctccgtccgcctcatcctccccggcgaactcgccaagcacgccgtctccgacggcaccaatgctgtcaccaagttca

SEQ ID NO: 58912 - DNA, 428 bp, Triticum aestivum
  Clone ID: PAT_TA_58912
cagcttgagagtaagagccgtagttcttggacgagtacttggcatatttgaagtcatcttgcacttgtcgctcggccttggtcgcttgatgaactagatcgagaaggttggagtatggttggaagtcggcaatccgcttgattgggtggttgagaccgttcaagaagcgtgccattgtttgctcgtcgtcttccttgacattggatgtatcatggcaatctccatttcttggtagtattcttccaccgtcttcgtgccttgcttgaggagttgcaacttcttgaagagatcatgggtgcagtgtgtaggcacgaagcgagctctcatgacatccttcatttacgtccaagttgtgattggtggttcgcctcttgtatgccgtcgctagatcacttgttcccaccaaatgagggtgtagtcttgaaact

SEQ ID NO: 58913 - DNA, 388 bp, Triticum aestivum
  Clone ID: PAT_TA_58913
cgctgtgtgaagcacacccgttgcacgaaagcagcgaacggagcacgatgagcgtgcgcgcggggtgaccacgcgcccagtccttctagcagaggagtaagatgacaaggggggggggcgttggcgggctgggccaccaggtgagtgccagctacgttctcactctctctttctctgtttttctttttcgatttgatttcctctgttctgatttactttagccactaattcgtattaataaattctgtaggttattatatggcttgctaaaacatataaaaagccactcacgaacttccagaattattggagttacatttagtatataataaatattaatacacagcaaataagtattgggttaattcaaatggccaaaataaatgtt

SEQ ID NO: 58914 - DNA, 294 bp, Triticum aestivum
  Clone ID: PAT_TA_58914
cgggacgattaaaccgtcaattcgcctacatccgacgaccaggcgcatctaaaccgcctttgggccacacgttcctcgacctcctctatagacatccatacgttgacgatcgtggcggcggccgaagtgatcgccatgtactaaagatttctagcgacggatgggttcagtgtgtctttgtcagcggaggttttgcggtctgtctgtgtctcaacgtgagggggcaatgtgaagtattatgaagcagcacatgtaactgcagcttttatgatgctaaacacatagtcatggcta

SEQ ID NO: 58915 - DNA, 421 bp, Triticum aestivum
  Clone ID: PAT_TA_58915
tacggctgcgagaagacgacagaagtcgacgggtcatccgcatagccaccaccgacttccgcaacctaacccattttgttcaccatagcattagtggttggttgagtactgatttgagtctcctaaggtgtttcggctacttagggataattgcttcttcatcaaccaccaccgccacttccgcataagcgtgcccaccatacacttccgccaccaccaacttaacccaattttgtttgagcttgtttgagttgtggcttgtgtctcctaaggtgtttcggctacttagggacggcaacttcaactcggagacgtatatagccatcattccacttccgcattgccaagtgcaaaccaccaccgcattcccgctaccaccatttgacatttgacatttgagattttgagttcccgggttttc

SEQ ID NO: 58916 - DNA, 155 bp, Triticum aestivum
  Clone ID: PAT_TA_58916
ttccacacatcgtcctcaaccagacacatgaacggtaccaacccattccgatggaatggagccgtgacatttcattctactttattccccaatcaaacacaccctacatacatagccaacaaccgaaatttccaatggcaccatagtccggcaaa

SEQ ID NO: 58917 - DNA, 360 bp, Triticum aestivum
  Clone ID: PAT_TA_58917
cggggcggctacggagttggacgaccggttcaaactggatatcgctcaactcgtgccatcgtcgttcgaggacgtgtatggcgggacactcttcgaggagagtatgaccatcctcgactctgagagttaaaagtcattcaatgatgctttatctgcgcatgaccatatgggaatcggcacattattgcgggaatgccatggcttactcaatggcttgcagtcacgcatcgacagtcgaggtggtgatggaatgagatctagggccaatgtatacgccttccctcaaataatatgcatcgtgttggacccttcaaagagtatcaataaagctccaagcgatggcctcgttaacgatatctc

SEQ ID NO: 58918 - DNA, 392 bp, Triticum aestivum
  Clone ID: PAT_TA_58918
ctctatatataaagggatgacccggcggcggtttagggcaagtaacatcggatcgagagctaggtcaagcgatttcgctccctggtaatcgagacataagcaatcccactcaaaactggatcgtaggcttttaccttcactgcaaggggccgaaccagtataaaccccgtgtcctttgtcccgattaacccctttaagcttcctagttgcgatggctccacgactaagtccttccactaggacatctgacatgacaattccatgatagttggcgcccaccgtggggctagcgcacggtggatttgagttcttgaagggcagctttgaagggctcaagagatacgctatgggccggatgaccaagagtcatcgcggcaagctctacatcaacg

SEQ ID NO: 58919 - DNA, 414 bp, Triticum aestivum
  Clone ID: PAT_TA_58919
cgagccgcgcatgctggaggctgtcggcgtgcgagtttggacggccggggaccatcggaatttgttggcagaggggtccttggatcgacgcccatgcgaggtcacaccaggcggatccagcgcctgcaagtcagtggccacgcgaggactccggatttgaagctcgggcgccggcggcagggcgtggaggcttgcagcagtagcagttgtggcgcagtgggaagcgatggcgcttgggcggccgacgagtaacggatctcgtcggatttggctcaggggaggcacaggaccaggaggacctcgccggatctagcttgtgtaggcgctggacccatggaggcgcggctagtcatcgggaacgccgtggggccacgggggctgcaccggagatgaagagtacggtgttcccggggg

SEQ ID NO: 58920 - DNA, 387 bp, Triticum aestivum
  Clone ID: PAT_TA_58920
cgcgctgagcaagcatctgttccactggaagcagcatgagctggagcccctctcgtggaagaagaggctcaacatcgcattagatgttgctcgcggaatggagtatcttcacaccctcgcacagcagtgctacattcacagggatcttaagtcggcaaacattctacttggcgatgatttccgagcaaaggtgtcggatttcgggctccttaaatctgcgccggacgggaacttctctgtggcaaccagaccagctggaacttttggatacttggcgcctgaatatgctgtgaccggaaaaatcaccacaaaagcggacgttttcagcttcggggtggtgctgatggagctgataaccggaatgaccgccatcgacgagagacgtat

SEQ ID NO: 58921 - DNA, 396 bp, Triticum aestivum
  Clone ID: PAT_TA_58921
cggagcaacaaaatctgagtacagacataagttacacatgttgccataagatggctagcacaagctgggatacagatcgaaagacgggtatgcctcctgccctggatcctcctaaactactcctcgtcgttgtccgcggcctgcacatagcagtaggcacctccagtgtagtatgagtcatcatcgacagtggcgtctggctcctgggctccaacatctggtcgtaacaaccatgtatataaaggggaaaaaagggggagaaaagcaaccgtgagtactcatccaaagcactcgcatgcaaggaactacactacatatgcataggtatcaatgaaaggggtggtatatgtggactgaattgcagaatgccagaataacatggggatagcttgtcct

SEQ ID NO: 58922 - DNA, 403 bp, Triticum aestivum
  unsure (1)..(403): unsure at all n locations
  Clone ID: PAT_TA_58922
cggtaagatggaggtgttgtccgaacagtggttgctcggctgcgaccatatgaccttttcctattgtattatcagctgtgtgacgagaggatagaccgaccaatctgaagctgctactcccttttgtccctaagcagaacaagttggcatggagcagtctgttctaaaagtaatgtatccatatgttactgccaatcaggatagggacatgagttttaacttcctctggttgtgaggagataataaagaagctgagagatcgactgtttgagaagcgggttcaggagatcaaagccaacaacaacctaggctttgaaaaagatgtttacaatgaaaaactgaggaagttgtgatggactgaaagatttgcttgaagcanaggcatccacctgngatatatatg

SEQ ID NO: 58923 - DNA, 268 bp, Triticum aestivum
  Clone ID: PAT_TA_58923
aaggttagaaatagtaaatatgcatagttgtatcgcgacctgaatgaatgaaataaacgaaataacgctcatgttcaaaaaaaaaagaggaaaacaaaaaaacagaaaatcaaaaaagacaaaaaagacaaaaaaagaaaaaaaaaaaacaaagataaaaaaaaaaaggggcggcccaaaaggatcaaacctaagtaacccgtgaagggaatgtcaaaccccctccaaaagggccaccaaaatcaattcaacggccggccgtttaaaa

SEQ ID NO: 58924 - DNA, 323 bp, Triticum aestivum
  Clone ID: PAT_TA_58924
tggtcatttactaccgactacaatgcattagcggtcagcgaacttgtcttgctagctcactttgatcattgttcacgagatatggtgattatagggtcactatctcagcgtagatctccgtagttgtatggttgaccagtcagacattccgcatgtgcctcattagctcgtgttctttatcaatctaagggctcacctgtcaatggacattgactgtataaaaatttatgcatacgtggggaatcatgccacagactcatcgctgcatcgcaccctcatcagccacactcagtgtgaaataccttgcgtcagaccctcatgct

SEQ ID NO: 58925 - DNA, 159 bp, Triticum aestivum
  Clone ID: PAT_TA_58925
cagacgagatacgctacagggagggagggaaagatgcgacgcgggactcgccgaccgtgagggtttttatagcaggctggtaagcagtgggatggggggggatgatacgtccactttgcggcatgcgtctagagcgacatgtagtgcattatgggctgt

SEQ ID NO: 58926 - DNA, 224 bp, Triticum aestivum
  Clone ID: PAT_TA_58926
cagtatcaccacttttccatggatggttggagcgctgcgccactagatgctcgactcgtgaaggtgttaggcgatgttcgtcccattgggaatgttgcccgtgggtcgtctcgaggcatgcgtgagggatctcagcaggatcctcaggtgcccagaggggtctaagctcgcattaggactcgggcatgccgtctcgtgtcggttctattcgatggcggacgcgg

SEQ ID NO: 58927 - DNA, 362 bp, Triticum aestivum
  Clone ID: PAT_TA_58927
ggatgccaaacgtgaggtaggccccggagccgaacgtgattccaaaggccaaccgaacccggtccttcaagggcgtttcttagagccctggagcatttcggctccaacagggcgacctctctggccaatgaggtccggaagctttgccggggtgccatgaccaatgtcctcaccaaggtggcgtactggaaccccaacctcgacttcgatgccgcgctggagagcttgccggaggatgcggaccttgcgacgctcgaggagcgtatcaagcccatcatcagccgcggcgacggagttcggagggtatagggccagcgctgagattatgcaccccatttctcatcgccgctgcaagttcttga

SEQ ID NO: 58928 - DNA, 253 bp, Triticum aestivum
  Clone ID: PAT_TA_58928
ttgccatgtcttcaggattcagtagctgttgtcgggtatcctcttggtggagatactatatctgtgacaaaaggcgttgtgtcacgcagtgaggtcagaccagatgcgcatggaagatcagatcgtcgtggggttcacattgatgcagtagtgaaggcaggaaacagtcgtggatcggcttttaatgagcagggcgaatgcgttggagtaccatttgacgtgttcaggtgagatgaagctgaaagtattggat

SEQ ID NO: 58929 - DNA, 374 bp, Triticum aestivum
  Clone ID: PAT_TA_58929
cggtaaattgtgtgtaatgtctggattttgtgtggaggctatatatacccctccaccccttctccatttgagagagagccatcagaacgtgcctacacttccattactcattttctgagattgaaccacctacgcatgtgttgagaccaatatattccaatagtaccacaggattcctaatctctatccttccccgagttgatttccactcaaagaatctttccaccatatccagatctctgagagagagttgagtgttggggagactatcatttgaagcacaagagcaaggagttcatcaacaacacagcatcgattaccttttggagaatggtgtctcctagattgggtaggtgtcactttgggagctccgt

SEQ ID NO: 58930 - DNA, 285 bp, Triticum aestivum
  Clone ID: PAT_TA_58930
atacgcctgcgtctaacgaggtgaacacaacggggaatactacaggccgatacaaggcaagatggccagtcatgatgtgatcaggtacacaatttacatcagcaatgtgctcgacccagtgcacgcggacatctgcatctcctccaatgccacgtccagcaacaagtccatcatcaagcacatcatcgacaaactcacaggggactccgccaatctcgcccgctacaacaaaaatcccatcatcacatagctgtacatccagacctccgtcgtcctcgtcctccc

SEQ ID NO: 58931 - DNA, 279 bp, Triticum aestivum
  Clone ID: PAT_TA_58931
tctcccgcacatggagatcacgtcaaacatccggaagcctgagatggtcatgtgagcccagagcacagatatgcatttaggaaggatgttgtgtggcgtcattgttcgagtggacactgtggacatcttaatctatgtggaacttgcgggacttgttggtctgatgataatgtatgtgcattagtcactaccactgttggttcccattgagatccacgtccagcgttattacatcgttgtggggatatctgcctgttgacttcattttctcggttcgca

SEQ ID NO: 58932 - DNA, 348 bp, Triticum aestivum
  Clone ID: PAT_TA_58932
taagtaactatctcatctgaagggtgtagcagatggacggtcttagtggtgcaaacgattgaagcagtatgcgcttttaaccaattcattcccagaatgagatcaatgctacaggacttcagtacgataggagagacaagaaattccagcccttcaatttcaacagtaacatcgtgactaaccatagaggtttgacattggcccgcaggggtgtgtaccactagcggagtgtttatctcttcgtaatggatgccatgcaggaatgcaaattctgctgatatgaatgaatgggatgctcctgtatcagataaaacggatgcgggtactgaatttacgaagagtgtaccc

SEQ ID NO: 58933 - DNA, 457 bp, Triticum aestivum
  Clone ID: PAT_TA_58933
acacagcggagctctaaatgaaagcatcaatgtcggtgtcaaaaccggcagatctcgggtaggggccctaagctatatgtctgaggaccgaaggtaactatgaacaaaggacaccgtgttttacccaggtttgggccttcttaatggaggtaagaccctactcctgcttgattatattcaagggtataggggttacaagagttgatctacctcgagatcgattcggctaaccctagatcagctagcctagcaatgttgtgatcctgcctccgatataccctccggtttatatagacaccagaggggcttaaggttgtaacaaagacggttttaccaaaaggaataacatatccgaacacctatacttgccatccacgcatacaggagtccttccagacatgagaagtgatctactatcttgtatcccgaatggccatcaaatctggcccgcatccaa

SEQ ID NO: 58934 - DNA, 430 bp, Triticum aestivum
  unsure (1)..(430): unsure at all n locations
  Clone ID: PAT_TA_58934
tacggctgcaagaagacgacagaagcgggggacaggaagatatcggaggcagctgccccaaccctaggctctcacagtaaaagtgtaccaaatggaccatgggagttccccaacgaagatatgtaagtctgttgtggatgaagatatcatcagcaatctacccgaagctctcagagacaaaatcctttgttgtctgccaataaaagaagctgttggaacatgcctcttgtcaaggacttggaggtacacatgggcttcaatgaccgaactgatgttcaggacagctgatttcgcttcaggaaatgatagtgcagacgatgaccgcagacttcttaagttcactgatatgtttctcttcctccacaacggcccaattctgaagttttgcctgaataccgtancgaatgaaatggtatccactggaggacac

SEQ ID NO: 58935 - DNA, 442 bp, Triticum aestivum
  Clone ID: PAT_TA_58935
tacggctgcacgaagacgacagaagtgacgggaatgttcattatgtatttatcaaattttcattatgtatttccaaacaaaatgttcacaccatcccaagaaatgttcttcatgcatttaaaaaattatcctgtgtttattaaatgtcgtcctgtgtatctgattttttatattaaaaaacgtttttccaatttgtgaactttttgcaaattcatgaacatttttttaagttctcaatcatttttcaaattcataaatattttttatatcaaaaatatttttcaaattcgtgaccagttttagaatttttcgagttgatgaacattttttaaattttggagctctcttttgcaatttctcgaaatttttaaatttgtgatgttttttaaaattcattaacattttcatgtttgcatttaaaaaaagagtcaggaacacattt

SEQ ID NO: 58936 - DNA, 270 bp, Triticum aestivum
  Clone ID: PAT_TA_58936
gaaacgttgggcgacatcaatgcaaacgatttcacgttctgatgtagaagatctagatcctcaacgtgctgatgtatgttctttgctagatcgacatctcgtccatcgtcatatcaagcattaagtcgttcatgatggatatcatcgagaacctcaccagcgttgtcatggtgcttttttcgtaagcaccgaatctagtatcagatcataggagattaaatctccgtgcttgttcatctttcccggtaatttccccaactacgtattctc

SEQ ID NO: 58937 - DNA, 101 bp, Triticum aestivum
  Clone ID: PAT_TA_58937
cggggccacgggtacggctgagagaagacgacagaagtcgacggggcgaggcaaaccgacgaagggcggcaacacgtgatgctgggtgccagaggagacag

SEQ ID NO: 58938 - DNA, 319 bp, Triticum aestivum
  Clone ID: PAT_TA_58938
cggagaacatcatcaaaaactttcttgacatttgtgtagtctatcttggagttacggttcgggtcgaaatacgtggccatggaaaatttcgggcttaagaggatgagtgtgcaatgtgtgtcactgcacagaagcaaaaaaaaaaaaaaaaaaaaaaaaaaaaaaaaaaaaaaaaaaaataaaagaaaaacaaaaacaaaaacagaaaaatacaacaaacagaaaaaacaagaacagaccaacagataaaatgccaagatagataaacttcaataaaaaagcagttaaaaaaaaatacgaaggatccacgaaagaggat

SEQ ID NO: 58939 - DNA, 407 bp, Triticum aestivum
  Clone ID: PAT_TA_58939
atacggctgcgagaagacgacaaaagtgacgggaggggacatgacacgtatgtatcgttgctattaaggataacaagatggggtctatttctacatgaatagatcttgtctacatcatgtcattgttcttattgcattactctgtttctccatgaacttaatacactagatgcatgttgtatagcggtcgatgtgtggagtaatagtagtagatgccggcaggagttgttctactaatcttggacgtgatgcctatataatgatcattgcctggatatcatcataattattttaagttctatcaattgcccaacagtaatttgtttacccgtcgtatgctatttttctctagagaagccactagtgaaatctactgcccccgggtctcttccttaacatatttgcct

SEQ ID NO: 58940 - DNA, 347 bp, Triticum aestivum
  Clone ID: PAT_TA_58940
gagggtcactgagtacagcttgctcgcgttcggcattgccgtttcaccacgacgactgctcaattgtcttatgaagttggtctgaactgtacctcgtcgatgtagatcagtatttggagtttgcgtcatttgagtgtgttgcgtcggatgtaattcaaggcacagtggatcagtatgtggagtttgactcatttgagtgtattgcgtctgatgtaattcatggcatagtgtgatggaagactcgtgatcacactgacatgacatggctttgttgtctgatacaatttgattttatatatcaaaatgaaaacatgtatatcgtgttttaagtattgtataacatgcat

SEQ ID NO: 58941 - DNA, 205 bp, Triticum aestivum
  Clone ID: PAT_TA_58941
tacggctgcgagaagacgacagaactgggatgagacaagaggacgggatgcaaggatcccggtgcgaagccgtggatgagagaggtcgatcgcttgtaatgtccgacggcgtctgggtatcagctccggcatggtggatgaggacggcggtggatggcgtggcggaccgaggagattaaagcttacatacgcttgcatgcaacct

SEQ ID NO: 58942 - DNA, 342 bp, Triticum aestivum
  Clone ID: PAT_TA_58942
tacggctaagagaagacgacagaagtcgacgggctctggtgttgtcgtctatgaatctaaaagtcattgtgtgggagattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaagataaaaaaggataaaaatataaaaaaaaaaaaaaaaaaaggtaaaacctaatgaataaaggtcaacaaaattaaaataaaaggccaaagatttaaaaaatgataacgggaaaaacattgaagtaaccaactttaaaacactagaaa

SEQ ID NO: 58943 - DNA, 386 bp, Triticum aestivum
  Clone ID: PAT_TA_58943
ccaacgggtgcctcggtcatagacaagcgtggcctggccgttgctgctgccaacataaccgcgcacagtgtgacatccacattgtatacgttgagccacctagcgatggagctcaattctttcatcgattactacaagtatatggttgatttgatagtgagcgtcattcatgacttgcacgcgggatgagatgctcaagtgatataccaaaagttatatgatgcctcattgtctcattgatgcccctaagttgccatatggcattgttgcagggatccgggaagaatcctgtgtgggaagagaacatagaaaacgaagagttggcccaaatagccagtagcatcacatttttcgaaataggctttcaccctgcttttaagtctcgg

SEQ ID NO: 58944 - DNA, 362 bp, Triticum aestivum
  Clone ID: PAT_TA_58944
ctgtatgcccaggccgacaagtgcgcacatgctgaagaggggaggaggctcctcggagagaatgcagaagcggcaggatcagatagtgatgggaccgccgcggcaaagagaaaccggcggcgcaacaacaggaagaagaaaggcaaagacgtgctagtcgttgaacagtccgtcaatggagccagcgccaaggaagccaaagttggtagctctagcaaggaggttgccgcggccgccgacaagcagggcggcaacgacaagcagtactgcaagatccaccgcaccaagggccatgatctccagagttgcaagaatgttgagcagcttgttgagctgcagaaggccggatacgagcgacgcga

SEQ ID NO: 58945 - DNA, 439 bp, Triticum aestivum
  unsure (1)..(439): unsure at all n locations
  Clone ID: PAT_TA_58945
cccgccggcttacagagtcccgatgccggtttatacacataccggcccggtctctactttgtcataccttacaatacaagacatgtactacatgacggtttatagctacatgccttaatctacctttgggccttgggccttcgagtctctgtagtaaactgctttattccttgtcttcatgggcttttaagtataaacaatccattatggggataacccggcttccttggccggtttacacctagtagtaatatccccaacagggtcctcgggcatccggcctatgtgacgtgggccggactgatgggctatgaagacacaagacagaagactctctcccgtgtccggataggactctcctttgcgtggatggcaagcttagcgtccagatatgaagattcctttctctgtaaccgactttgtacaancctaatcccct

SEQ ID NO: 58946 - DNA, 220 bp, Triticum aestivum
  Clone ID: PAT_TA_58946
gctcccaaaccctagcgccggcgcctccacttctctgctctctcctctcatctcgcgcatggcccggcgaaagggaagcaatatgtacaccgccagtaagattatccagatggacaagggcgtcaacccctcctatttcaaggacaccgtctcgcaggctttctttgacctgcaaaatggcatccaggagctcaggagcgacctcagggacctgtacatc

SEQ ID NO: 58947 - DNA, 261 bp, Triticum aestivum
  Clone ID: PAT_TA_58947
gctagcataatgttttcatggctttccgttttttgatgtcattgctacgctagatcgttgcacatcccggtacactgccggaggcattcatatagagtcatatctttgttccagtatcgagttgtaatattgagttctaagtaaataaaagtgttatgatcatcattatagagcattgccccgtaaaaaaaataaaaaaaataaaaaaatgaaaggccaaagaagcctaaataaaaaaaagggggccaaagaagcccaccc

SEQ ID NO: 58948 - DNA, 411 bp, Triticum aestivum
  Clone ID: PAT_TA_58948
tacggcggaagtgctagagataggagacagcagtacgagatagaaaggatgggcggagactctgtttcatgtgcgtttccattacgtctgggtagatgttctgtttcccgtgaaaatcgctggaaagttgcctttcccaacgaaagtgttacgctctttcctttgtcccgaacgcctccaaaagaaaatatccataggaaaggaaagttgtatgattcctgtgataaatccttcgtcgcgaatatggcctgagagacacagggctgggataccgcagatcgggagtggtaaggtcaaaggaaccgattgacagtggactcacgttcaggggtttttttccagcggaaaatcaacgtgggggagaacgctatcgggtgcccgaagggattaaccattcgggccacatttttt

SEQ ID NO: 58949 - DNA, 375 bp, Triticum aestivum
  Clone ID: PAT_TA_58949
caaacatcctcggacgacctccccgacgccgacttagaaagctccaaagcaaccccgagcggcatcatcaaaaccgatgaaggccctgccgaagatgatgatggagattcccaccatttctgggtaatggcataactcgtgtttcctcatttaacatggatatactcttggctgactcgttcactgaccgactaatttgtgaaatcgtagtgcttctacttctgagacctcagccagacatgaagatcaagaaatggaggatgctgccacttgcaaccctggtatgatctaaatagtttcgctttcggtcgataggatcctcatttttaactttgaatcttttctgtagctccacctagtatcatcattgatctc

SEQ ID NO: 58950 - DNA, 389 bp, Triticum aestivum
  Clone ID: PAT_TA_58950
ctagggactagctgccttgtactatgaaatgcttcctgcagccggacaaataatgagttgcagctcgcagagcgactgttcggtctgcaggagttaaggctgaagggatgtctgcctaaaaaatggctaaggacccaaggcgtacacatagtccaagtcggcttcccgcctcaccgaccaactgtcaagcagccgaccagccggcccctacttaacttgctagaaaactccaatcggctaagtactttccttcccaaaagtggctaagtacttgacccagccacagtccgtggaatggctgctcggctggcaaggtggcaaccgagggaaggcggcaaaggaaaaaagccaaagagcagaagcaaggaaagatattacttggcaaaaat

SEQ ID NO: 58951 - DNA, 299 bp, Triticum aestivum
  Clone ID: PAT_TA_58951
cgggtatggctgcgagaagacgtcgacgggcattgggtttgcgacgccttgcatcgtatcggtatacgcatcttcattctgtatcttccacgaggtagctgatgtttacacctaccaccgtaccttctgcaatgtcacttccagtacgctctatctcaccgaacacctcctcatgcagttacgatcgggatgtttcttagcctacgcagacacattactgcttcctatcatctcatctcctaatatttgtccttctcttcacttttgtctccctagctagctctgtacgcacgcctatc

SEQ ID NO: 58952 - DNA, 382 bp, Triticum aestivum
  Clone ID: PAT_TA_58952
cacgtattcgacgaaaaaaatatatgcggccaatgcatggctatgaacgtcttcttgtgtggttaaatatgtgcacgtgtactctataccgaggagcattttcgcacaggatcttccttgcgtgaggtacagaaggtggccaagcacaagacgacgcgaagcactcgttaaaaagaaaggaaaaacgagctgggttccgcacctgactgctctaggttcgttcggagctagcggtcagatccgtcacgatggatgtacagaacctgcatcgacgagccgactggtgtcaggtgaggttgaaacagcctgtaacgtggttagtacctcgaggaaccggcgcgtgtgcttttcgaaagaagtggaacctgtggtagacgtgatc

SEQ ID NO: 58953 - DNA, 397 bp, Triticum aestivum
  Clone ID: PAT_TA_58953
tacggctacgagaagacgacagaagtcgaggggtaagaagggcactgggagagttgaacgtgtggagcagttaacatttttgacacgggtggcaaaaacgcctgcccagaagcttgaaattctttttcatgtgatttctgcccagtttgatgtcaaccctagcttacttggtcatatgccagtcaatgtgtggaagaagtgtgttaataatatgcttcttgtgcttgatattctgcaacagtatcctaatattgtagtggacacctcagtggaggctgatgagaaggaaactcagaagggtgccgactatgatggaacaatccatgttactggtgacctagttgcattcctggagagaattgactcggagttctttaagagtttgcaatgtagtgat

SEQ ID NO: 58954 - DNA, 275 bp, Triticum aestivum
  Clone ID: PAT_TA_58954
cagcacctgcagcatagtggtgacaccgacactgtcgtcaacagaggtcagctgcttcacaaaccaccgcttgatcgcaaaaggcaacaccgcgaatcagattgtgaaaaccatcacgatccagtgctacctcgtgctaaggcacgtccacccgcaggtgcacactctcgctgaaggttctctgcatcacctctccactgattccgcagacctgctatatgctccccggtgagtcgtccaacctagactcctccaacaggtcacggagcatcaac

SEQ ID NO: 58955 - DNA, 351 bp, Triticum aestivum
  Clone ID: PAT_TA_58955
tacggctacgagaagacgacagaagtcgacgggtacggctgcgagaagacgacagaagcgggcggggtaaacccccagatcatgtgatcagtaaaaacaattatttctccttccttgggctcaggaggatttttgaggcctgggaccctccagtggatgtcagctttcttggataagacgcgagtttctacgaaattgttcagatcttccttggtgacccgggatggtgcccagttgcatgtggtgaaagtcttagtcattgttgataatgatctgaaaatgaaaactttgccggtttaaggttatgttgttatgccgaccattgatctaagggtaagaatgataatcatt

SEQ ID NO: 58956 - DNA, 215 bp, Triticum aestivum
  Clone ID: PAT_TA_58956
cggtcatcaacacgcatcgtgtcatagctgctggctccgtgcggccaaaagcgggagctgctgcagccctataaccgacttaagctgtgtgcggtggtgtcataaggagcctgtccatcaccactatagttatcccaagtttcacttcatatcgcacatgttgtattacctttcatttttcttgacgtcgtcaacgtccgcctgtctataacgtg

SEQ ID NO: 58957 - DNA, 405 bp, Triticum aestivum
  Clone ID: PAT_TA_58957
cttctggtggcagagcttctgcggattcttcatcatcattatattcgctttctctgaacctttcagcacgacatgggcgatgctgaacgaatcccctttctcaagcgcgaattgccattcattgggtgtgatgtggaaccagtcctagtttgaagtcacggtcgccttcacctccacatactctgcggcgccaccctcgggagtgatgacaatgtcatagggaagccccgattccttctcttcgttcacccacttgacattgctaggtcccagctgcccggcaaggtattggtgtaccgcagcttcaccaagcctgccggttcttgaccgctcatctggcttttgaactgtggctttacaaggtgtgccagctcctagctcgctttcatcttctgcaacatcagc

SEQ ID NO: 58958 - DNA, 430 bp, Triticum aestivum
  Clone ID: PAT_TA_58958
ctctccgtatgatgggagttcaacccgaaaggaccgcgaactattcagcaattcttcggcatgacgctcgaagggatgtatggattgttctttggatcacgaataaagtgtccggacaccaccgaggatgcgggtctaaactgcaaccgtccagatacccacataagtaatctacggccgaacacgctgtcttttcatttgtcctaacatcattctgaaaaaattgctcttggccaggactggataagaaaggcgaaaatgatcaggtgttcggccccccttcctgaaggctcactggatcccgtactagccaggatgcttgagctcgtaccttatcaagcgccatcaggggaagatagagggaggaataaagaagctgaaagcgggcctcgcgcattactcatccaaaccaggggaattagcgtctccg

SEQ ID NO: 58959 - DNA, 423 bp, Triticum aestivum
  Clone ID: PAT_TA_58959
ctgtcatcgcaagttcaacatgtgggtgccatggagagcatcagcgtgacgatggcggaggacggagctttgcacgagcctgaccacgacctctccgacgtgtcgatgagcagggttttctcacagctgatcaaagccgaggggaggtgaaaacgcgccggatgatgtgtagggtaccggtagaggtgtgagcaagccttggatttttcttttcttgttgaagtttacctgagatgtgtcacgtgtaattggttgtttcatcccttgtaattgtactgaactacggtttggatttctgatggccttacctcacccacttctgggggcacacgatttatcagatataggtatcttcttgtaaaaaaaaaaaaaaaaaaaaaagaataaatgggaaaaaatgaaaaaaaaaaaagcggccgctct

SEQ ID NO: 58960 - DNA, 366 bp, Triticum aestivum
  Clone ID: PAT_TA_58960
cttgaacttgatttcatgcccatggaaacgatgtagatcttatcattaaagcttctcttacattaattattcccttggtataagttcatctcatatctgggatctggccttgtcgcaatcgtggttccgaccacattttctccttgattccatttctcagacaagttgaaatacttgtcttctgttgatcgatacatctccgcaacctctattttgatattccttcgagtattgccctccggtatctcgagaatatcgaagaactgtgttgcttcccatgagtcttcatctagtattgcttctcaacgttttcaaattcccccaagttttgagttaatagtcactccagaacaccgataagtgaat

SEQ ID NO: 58961 - DNA, 363 bp, Triticum aestivum
  Clone ID: PAT_TA_58961
ccgcccataccaatacgtacgtacaatggggtaggtgcggatggaggtggaggtggagatcacgagcatccatgatgctctagcgaccggagccaggcgagcggtatcgtccgcggtcgcgacgacgacccgcgcgtcgctggatccaaggacggagtcatgctgcctacaggcggcgcggcaacctccaagggtggaaaggcgacctccaagacacccccgctagcgcatgcatcacggtcctcccaggtcatgcacgacgagcaacgccgcaacgctggtgactccgagcgtccccacggaaagagccctcaccatcaatctcgagatgcgcaggccggcatgcactccaagatgatggtg

SEQ ID NO: 58962 - DNA, 151 bp, Triticum aestivum
  Clone ID: PAT_TA_58962
ttcctacaagttatttgcgcagagaatcccgatgggcaggaagttggtgagatggtatatgtgctcgtcagattctgcatgatggtcgcggtgggtgagaattcgtatcttttatgtgaacggcgttggttatgatcgtggggagttaggg

SEQ ID NO: 58963 - DNA, 386 bp, Triticum aestivum
  unsure (1)..(386): unsure at all n locations
  Clone ID: PAT_TA_58963
acgtcgagaagcagatgccgacgtacattcgcgcgactcgtaaaacccgtgacttccgcagatgtgatccttgttggggttgcgacaagttcatgagaagagatgcccttgagcgatcagccagtctaaagtctgattgtttcaccagccggtgtgatattgtggtgtgcaaggacaacaccccagatgccactggctccggcaccggcaccgaggttctcctgcccgacatacaccaacattttagcaacctccttcagaataaggtgggtgctgatgtgacattcgaggtcngcggcgagacgttcgctgcacaccggtgtgtgctcgctgccaggtctgaagtgttcatggcgcagctctttgggcacgctacgcccagcgtc

SEQ ID NO: 58964 - DNA, 380 bp, Triticum aestivum
  Clone ID: PAT_TA_58964
gttgctgtaattgttgctgttgctgttgctattgttgttgttgctgttgttgttgttgttgctgttgttgttgttgcagctgttgttgctgttgttgttgttgatgttgttgttgttgctgttgctgctgctgttgctgttgctgctgttgctgctgctgttgctgctgctgctgctgctgctgttggtgttggtgttgttgttgttgttgttgttgttgttgttaatgttgttgttgttcttaatgttgttgttgttgctgttgctaatgctgttgctgttgctgttgtatgatgctgttgctcttactgttgcagttgttgttgctgtagttgatgctactaattcctgtaactgttgcagttgcaattgttgttgct

SEQ ID NO: 58965 - DNA, 431 bp, Triticum aestivum
  Clone ID: PAT_TA_58965
ctctgcctcaaccttggccactgcatcaacctgggcacaccagagcatcgcggcaacctttcacgtcttcctcagctccggtaaaccttctaacctttcccctgcagatctgttttagggtttcacagttcttcagtattcatcgtctgcctcttgctcatatgatagatctttagatgaatccgcaaatctttactctgtgcaatgatagttgtttgacctttgcctttacttatgcatctcaaaaccatagatctacatgaacgtttttctcattggttcggtactgctcctttgaacctctaagtatttatctcttttctgaacttgcttcagatccaatgctataaggaaatcttgtgaaacctgtttctgcgtacttgtccatccgcaatgcttagattaggcggtttaaccttatagaaaatttt

SEQ ID NO: 58966 - DNA, 152 bp, Triticum aestivum
  Clone ID: PAT_TA_58966
ccctatagtgagacgtattaaagatgtatgacttcttattgcctaagattgacatctcggactatttgctaagcatatattgtgcgggtactgcatctgccagcgcctatgtaaaaggcttgaatgctgctttggtaactgccatcgctatt

SEQ ID NO: 58967 - DNA, 127 bp, Triticum aestivum
  Clone ID: PAT_TA_58967
tacatcgaaatctctaccactagatagttcacgctaaatccgatcagcgaacctattatggtatcattgtacttgtgactggccttctacggagcatccactccggtttagatacatacaggatacc

SEQ ID NO: 58968 - DNA, 396 bp, Triticum aestivum
  Clone ID: PAT_TA_58968
cgagtattttattttgtctttttttttttttaaattaataaatcttatcatatatcatagaatgcacatattaataaatcttatcatatatcatggaatgccagccaaccaaacctttcccatcatgctcaaacacaaacatagcatcatagcactctcaacacaaatgccaaccgcactcggatacaccactgcgtagacctggaattctaagctgggagccatgctacaagaaacgcctacatcagtgctatggctcagcagatggcattgcatcagggctgccaggaatgcttgtatcaatgttggctagtgctgtggctcagcagatggcattgctgcatcagtgctgccaggaatggttgtatcaacctgcagcccgggggatccactagt

SEQ ID NO: 58969 - DNA, 198 bp, Triticum aestivum
  Clone ID: PAT_TA_58969
agaagatatatacagagcagcgagtgggagaaaaatcatgcaggtcacgcgagcacagagtgtcaccgcctcagtgtttgctatcacagacgtcaggacgtcccccagacgggtaccgtcatcatcgggcctcaagcaccttacaaggaaaggaaacaccaacgggaacagcaccatcatctacgaagaaaacgcagt

SEQ ID NO: 58970 - DNA, 278 bp, Triticum aestivum
  unsure (1)..(278): unsure at all n locations
  Clone ID: PAT_TA_58970
acacangcaaacatacagccgcggttgagcaagcaccattacggacccatcacgatcacacagttgctacagacagcaagataaccgacatagaagccagcaggcagcagcacctaacgacagccagagacgtgaccacaggagagaatcttggagacggcggcggcgcagacgatgccgaggggaacctggtgacggccatggtgccctccgacactgggtacgcggagagctcccccggaaggagcaggcgcacagaggtccggatctcacagccg

SEQ ID NO: 58971 - DNA, 160 bp, Triticum aestivum
  Clone ID: PAT_TA_58971
ccctctctctatctctctcgctctctctctctctctatctctctctctctctctctccgtgtcgaactcctggaggaaggcggatacactaggggatgaacgggcgccagagcggtggagatcgaggttgtgctccatttagtgagggttaaattcaagg

SEQ ID NO: 58972 - DNA, 371 bp, Triticum aestivum
  Clone ID: PAT_TA_58972
cctcgagtagcttatgtagtccagtcaggactctaaaggaagtcgtatcagttagcgtggcgacaccaggaaaccttcattgtccgcaaatggagaacttggatccaatttgaattgggaagcatgattcgagcttgccctagcttgattactggtgaacggtgatctcccctggctggttgattctgggagaaacactagctgtgtcggggtggagcaacactagttggcggttgcaacaggtgctctcactgcactggtatcgtgcttgtctgacataccgtactatttgcatggcatgctggtgatggtatttgtgcaattactgcattatgttcaaaaaaaacctgcagcccgggggatccactagt

SEQ ID NO: 58973 - DNA, 302 bp, Triticum aestivum
  Clone ID: PAT_TA_58973
tgcaagattcacggttgagatatttcagtacagtcctcaggacacagatatttactacggcgactttcaatataaagtcaatcctaagggggcgtctcaccgtgcaggtactggaacgcacagtcaaactacagtacacatgcatataacttgcaagcactacagatctggtcgaaaaactaatgcatgctttaaacaccatatctcgccagttatatacacacaccacaccagctagttgttgcactgcaatcctgcactgcacccacagtcatgacgcatcaaccgtacatcgacatcac

SEQ ID NO: 58974 - DNA, 216 bp, Triticum aestivum
  Clone ID: PAT_TA_58974
caattaaccctaagaattaacccaagcggaagcatttcaatacattcactcagagagatagacatacatttatcactacatagatgacatgtttccttaacaggaagatgtcgatgagcaactgagcatcacgacgagatgaaacacaggacaacttttcatttcgagtacattattagtatcgggctcctagcatcgacgcgtttacttcgtgcc

SEQ ID NO: 58975 - DNA, 367 bp, Triticum aestivum
  Clone ID: PAT_TA_58975
ggccaggcaggaggacctctgcgtcctctgtttattgttttgcagcaggaggcccaacatagaacatactcgccagtactcggctgtgcaaaacaggggctagcgctgaagtacaaatgggaaaacgtgattcttttgttttaaataaatacttagaacacgacttggctcctacaagcatctggactctaggtctcagtactggagtgtctcacccatgggccccacgcagggacgccacggttccctcccaccccgtgatcaagacacggaatcggctgccgatggttggatcgcaatgcgccccttttctagagccttccccggccatctacaggcaggaatccgccgggaaaaaagacacctg

SEQ ID NO: 58976 - DNA, 380 bp, Triticum aestivum
  Clone ID: PAT_TA_58976
cgggtacggctaagagaagacgacagaagcgacaggcaacttccttacagagggtccttcattaagggttcacgttgatccaggggtgcaggctcctccctgggcgaggtgcttggctgagcttgatgtttgtgatgctgtgtagtgaatgatgcagcatatggactgtatcatctgtttgccatgtagcgctgtaagccatgtgtttggtttcagcaattgtttagctgcatcaatttacaccgtgcgtcaagttcatcggtgtcgaagctgacatcgtgtctagaatgcaccttgccttggaactgacgctttcaaactaatcttgtttacctcataatctggtgtagctaaaaacttggtgtgcctaaaaaaaacat

SEQ ID NO: 58977 - DNA, 380 bp, Triticum aestivum
  Clone ID: PAT_TA_58977
acggctgagagaagacgacagaagtcacgggagatatgacgcacgtgacgcaagcgttcgtatacacgcgcatatactcatccctatgaacgcatacacgcacactctatccctatgagcatcttcgaaatactgattcgacatatcatttttaaaacttacgaagtcatcgtagtcacctacgtctcatcccactgaatacgcattgccagaaatcttgaagtaaatccaggaacacatgcgggcaccaagacttaattctgatgggttgggataccacagttcctctaaccatccaatcacagggtgggttcgctacgaagcacgttattgaaatactacctccctctgggtgcacaggttatacacgtagttctacg

SEQ ID NO: 58978 - DNA, 279 bp, Triticum aestivum
  Clone ID: PAT_TA_58978
taggactacgaaatgtcaaatgaaaagctcttgaagacattctcttggtccggatttgggcatttttatatcgtgcagtccgcagtttacctgcatctttcgctttgaagagtgtacatttgctatgtcatccacgagatttgttcttgtaaatgtgggcaagtcatttgcattttcataaagcaaacttcccttgcctacattgtatcaaatggacaaaagctcatcacattggtcaaactgatgcggttatgactaaaaacaagggcgtgaacagaa

SEQ ID NO: 58979 - DNA, 368 bp, Triticum aestivum
  unsure (1)..(368): unsure at all n locations
  Clone ID: PAT_TA_58979
gctgcgaaaagacgacagaagtcggcggggccacacagagtaattcctcaattggacccaacacaaaggccaaattgtatggtgtacaagatgcaggaaaaggagaatttcacatacccaacagttaaaggctttggtcctcttccaaaatctaccttcattgcaaatgcaagagactcaatcccagtagcaagagtgacaacagcaatggcaagtggcagggtcagaagaaatgcagatgcagcagcagaatctagtgccgggaaaaggcaagctagangagggactagagctccaagaggaaggaggagtgctggaagaggaggagctacagctccaataggagggaagagtgctggaagaagaag

SEQ ID NO: 58980 - DNA, 398 bp, Triticum aestivum
  Clone ID: PAT_TA_58980
ccgggccgacgggtacggctacgagaagacgacagaatgacgggcggtgctttaggcccttctggccagcggagtgaacatcccatgcgaatcagcgtacttgaacatatggtgcaggccctccataaccaatataaacatcaatataaacatcagcccccttaggctcatcaatcagcagttttgtacttatagcatactaaataaaatgctcttgtatacaattctgatctatccgtaaaaatgctgacatgtcaaatatgtttgttacttttgcagtttgttagagaagcaatttcttcgatgatgctggagactcggctaatgcagttttgtgctggttgcatgaatgtacagtcgtcgcgctctcagtctcggtgtatcgggatttttaacct

SEQ ID NO: 58981 - DNA, 334 bp, Triticum aestivum
  Clone ID: PAT_TA_58981
cctgccgacagatgatgatatgcagaagctggatatgctcacgaagttcatgtctcagcacccggtgatggacttcccaagggagaagattacttgtccatcggatagtattatggggcggaattatgcactatattcagcaatcgcggagcttttctacctttgtaagatgccttgatgaagttgctactcatggggatcgtttgaatggattagggtctgcgaatcttgccatgtttggggcaatttttgtggtgacttccagaggaataagggaagaccagaggagggggagaggggaaagggattttttgttttgaagttctgttaccag

SEQ ID NO: 58982 - DNA, 388 bp, Triticum aestivum
  unsure (1)..(388): unsure at all n locations
  Clone ID: PAT_TA_58982
cggcttccagcagccagggcgagcggtggtagcgcttccttctgactttattcctgcaatcatttaccgtgcctcgtggaggcgtaaacctttgccttgaatttgtgaaacacccctgtttttgtataactaatagaactctgcgatttccttttcgtgcttgggttccttcgtgtttgccttaacgttccgcatcggcagggcccggccccgtgcatacctcgactatcgttggggcatctggatcaccaagacgagaacaaagggtgaaggggtacgtgactttgtaaacccctgagtcaagatgctcaaagggttccctttacgtacgaacaacctcaatgttctgtgttagtanagcccaaacccgtgcatacctcgactaccg

SEQ ID NO: 58983 - DNA, 370 bp, Triticum aestivum
  Clone ID: PAT_TA_58983
cggcgcaacatggtcacaaccttccatctccatcaggggtgatggagaacgtcgtggttcctactctcaagaccttctctctgcgagcgtacgacccaaagcaggtgataattgcgggcggaaacaagaaggccttgggaattcccccgaagggaacccaacgaaaatcaatcgacttcccggggcctcgaaccaagccgctaaccctcaaggatttctccggcgacggtctgactgatatcaccctggtgaacatcggggggattgtacgggtttgtgcagacaaaggaacccgggggccctcttcttcagcacgcttgtcggcttcttgattgttgtgatcggggtgatctttgtctctctgcaactc

SEQ ID NO: 58984 - DNA, 408 bp, Triticum aestivum
  Clone ID: PAT_TA_58984
cggagtcgaaaaagagatcgaaggaggtgcaggcagagaagctcaaggagacggccaaggagaagaaggagagcattgagtcggtcaagaagtggaggaagcagaggcaacaggggggattttccaaggggaacgaggacgggccaaacctcaactttgaagttgaaggactcaagcaacacaagaagcataggcctggcgtttctcctggtgacaggtctggtggtcttgctaagcgaggcaaacaaggaaagaaccataggtcaaaggattccaagtttgggcatggcggccgcaaagggatgaagaagcaaaacactgctgagacgacgaatgacttcagagggtttaacaaccagaagggcgagtcaagaaacaagaagaggaagatgttttgatacggtgttg

SEQ ID NO: 58985 - DNA, 247 bp, Triticum aestivum
  Clone ID: PAT_TA_58985
cggatcccgcggggcagagaaaacatgagccctggcctggaggctgaagcacgggacttggctgaatctgaattagcatggaccaacaaatcaggagcgaaccgagtgaaagaattctaggaaaagggcagggtctctgaagacagtcctaagctattctgtaactaccttaaaacggtgtgctctgtatgcttgtaaaagtaacattgaccgcattttttgtggaggttgaaatgagaggagctag

SEQ ID NO: 58986 - DNA, 383 bp, Triticum aestivum
  Clone ID: PAT_TA_58986
ctaacctctcagagaagctcataggagtaaggtgtgcgtgtgtgcattcataaagatgagtgtatgcacgtatgtatgagcgcttgcgcctgtactgtgttaaaaaacaggagcctagtttcccaacccggctcaacacatttccgacgaaggccaacccggagaccaaacaacatgaggcgtttctccgatggccctcgtctgctgcggccccctgatgtcatctccggccacggctcctaaaaggacattgacccaccggctccgctaccaagcccgccttcggcaacagggatctcgatgcttggcggagcgaaacaggttttctttgtcgcgtcgtcgcaaaggctggactcgccagcgtcgccgcccttccttttgcc

SEQ ID NO: 58987 - DNA, 357 bp, Triticum aestivum
  unsure (1)..(357): unsure at all n locations
  Clone ID: PAT_TA_58987
ccaggtacatcaactacgcggcgctgcgcgccgaccagatcccctgcgacaagcgcggggcgtcctactacatcaactgcgggtccatgcagcaggccaacccctacacgcgcggctgctccgccatcacgcactgcgcgcgcaacatgaactgatccgtcgtccgtaggcctggtggatcttgcgcacgtacggcactgatcgatgcgtacgcacggagcggcgaggaggtgtgtggccgtgcgatcacctaattactaattgtacttgtagaacgcccgtgcattgctacatacgaatgattataaataaatgaagctgactgtacanatttacangtcaaaaaaaacnnnnnnt

SEQ ID NO: 58988 - DNA, 337 bp, Triticum aestivum
  Clone ID: PAT_TA_58988
ctcttctcccccgggaaccgatggctgccgcgctctcaaccccaagattgcgcagttcgctaaccggaacccggacttgcggtcccggaagttcacctacaaaaaccacagttcaatgtgttaaaccctcaaggtcaaggtcctccctttctacaggttctacagggaagccaagggaagggtcagcagcttaagctgcacaattgcacccatcacgaatttcaaggacgccctcgcaaagcactcgccggacaggtgaagcctcggcccggcgcgggggctcaaggaggcggagctctgtggtctggcggcaaaaagggacctggaattcacctac

SEQ ID NO: 58989 - DNA, 335 bp, Triticum aestivum
  Clone ID: PAT_TA_58989
cggccccgtggtggcaaccgcgcctaaggtcctccggcatcgccgtcgtaccccaaaataaggcttaaggccattaaaatcggtaactgggggaaataaaggtttgaacccaaaacctaaattccaaggggtttgattcggcaaaaaaaaaaaaaaaaacaaaaaaaaaaaaaacgggcgccccaaaagattcaaacctaactaaccctggaagccaactcaaaacccctccaaaatggcaaccaaaatcaaatcaatgggcgtccgtttaaaacgtcctgaacgggaaaaacccggcggtaaccaacttaaaccccctggaacaaaatccccct

SEQ ID NO: 58990 - DNA, 332 bp, Triticum aestivum
  Clone ID: PAT_TA_58990
cgaagttactgacttgccattatagttgacctgaagctccgttgtttaggaccattgctgctgctgtaggttagggagaaggctcgaggcagccacgaattccgtcctgcactacttcaacaccgacctattctagcatgaatcttctgccgtgaggatttgatgcagcaagggccatttgtttgacagaaacagagtggttaccgcaagagaggtacaaatcaaggaccgaggagggacgagggcggctttgatctaagttgggtcactttctatgaatagatgatgtgattgctttgttattttgtttaattaatagaaaaattgatgag

SEQ ID NO: 58991 - DNA, 344 bp, Triticum aestivum
  Clone ID: PAT_TA_58991
acgggtcgtattcttctctaaatccattttcctcataacagatgcccttgttcaccgcatcgtaacattgcacccgtcgctccgtgttgggcgtgtagcataccaaattgttcatctggagatgcacggcagttcggtccattgtaccagattcatttgaggtcagcttgatgtcctagatgctgttccaagagtgctacgtggcgtcattttcatattcttaccagagtaacgacatattgtcacttctgccatgtttactgacgatgacatgacgaacttggatataatcacacatagggcatacatgcatatttgccacgtgatttctagtgcacactatt

SEQ ID NO: 58992 - DNA, 331 bp, Triticum aestivum
  Clone ID: PAT_TA_58992
gagatttcttggagggattcccagatcaattcaactagcagcgtcatcgtcaaggagtaccttctcaatgtcacttctggtaaactgggcattgagttcacccccgatgaaggatccttcgccttcatcaatgccatggaggttctacctgtgtctggcacctcaatttttgattcagtcaacaaggtggacggtcatgggttgaaaggcccttttagcctctacggcatcgggatcgagaccatgtacaggctgtgtgtgggattcatcgatgtactggctaggaaagatgatccaggattgtggaggaggtgggataaagatgaccatt

SEQ ID NO: 58993 - DNA, 404 bp, Triticum aestivum
  Clone ID: PAT_TA_58993
ggaaaaaacaatgttgctttcctctgtctctttatgcttggtaaattggaagattgcatacaattgcttgtagacagcaaccgtatacctgaagctgcattaatggcgcgttcttatcttcccagcaaagtttcagagattgtagcaatttggagaaaagacctcagcaaagttaatccaaaagctgcagattctctggcagatcctgctgagtatccaaatttatttgaagactggcaggttgcacttactgtagagcagaatgttgcttcccagaggggccactatccttctgcagatgagtacttgaaccatgctgagaagtcagacactactcttgtggaagctttcaaaaggatgcgggtcattgaagaagaggaaccagtggaagcactggatgaaaa

SEQ ID NO: 58994 - DNA, 306 bp, Triticum aestivum
  Clone ID: PAT_TA_58994
tgactggagctggtagcgggccactgcctcatcaaggggggcgacgacggcgatgtctcacacatgcttacagacagcaaccgtgggacgtagactaccggcctcagccttcacgacacccacatccgacttacaaagactggctgagctaggagctcccaacacacactcaatacgcccgggtctgcagattctcaggcagatcgagcagagtaccccagtaacgtgtgtgactggcaagttccccttacgctgtagcatctgctgacatcctacaggggcagaccatccttgcgcagatgagta

SEQ ID NO: 58995 - DNA, 394 bp, Triticum aestivum
  unsure (1)..(394): unsure at all n locations
  Clone ID: PAT_TA_58995
gggactacgcacacaactaggagcaggagaattaaaccataacttagcatcaccctttaacgagaaaggaaacaacttaagaatcaagtaatagcgaattttttccacatgagcaaatagggtggctatatcatccaatttagtaagatgtgccacaacagtttcagattcataaccatagaaaggatcagattcaaccaaagtaatcaacttaggatcgacagagaattcataatccttatcagtaacaaagataggtgaagtagaaaacttaggatcataccgcattctagcattcaaagacttttctttcagcttagctaaccgtttcttaagatcatctctatcattacaagcannagagtctctagcagtttcttcatccataatataa

SEQ ID NO: 58996 - DNA, 393 bp, Triticum aestivum
  Clone ID: PAT_TA_58996
cagcagaagctcagaccatatatatgatcagggtggtagaaaacggtggtagggttgcagatcagcaacgcaagctgcaatccgcaagctgcagtggcagcgtccgaaagagatgcgcggaatgtacataagtagtgcgggcgcgtggaacttttgtctgaagagatgattttttcgtatgtaattgcaggatttgactctcaaaaaaaaaaaaaaaaaaaaaaaaaaaaaaaaaaaaaaaaaaaaaaaaaaaaaaagaagaacaaaaagaataaagctaaaaataaaaatccataagacatcaaaaaacttcaaaaaatgtcgccaaaattcacataagggagccatcaaataacggggccccccaaggggaaaaaccttgcgttacccaag

SEQ ID NO: 58997 - DNA, 420 bp, Triticum aestivum
  Clone ID: PAT_TA_58997
aacatctcctcccactgaaagcgcatcgccggaaatcctgaaataaatccaggaataatgcgagcaccaggatttgaaccctggtgggttggggataccactgtccacctaaccaactcaaccacaggttgattcgcaatgactacatgtattaacgaattactacatgctcattataattgctcttttacgatgctaagatggttagttatgatcaattagtggtttgagggctaggcgtcgaggtaacttgttactattggctttttttttgaggaatgtgggcctgtcgaagcggtggactctggtgttacgttagaattttcacagatgagcgcaatgcacaaaaaaaggaaaccaaagacttcccaaatctggcacgattccccaccatctccttcctctagaacattctgtctc

SEQ ID NO: 58998 - DNA, 417 bp, Triticum aestivum
  Clone ID: PAT_TA_58998
tgactgatgcaaactgtgagattagctttaccgctcccgtctcctgctactctttagttacttagtactactaccggtagtggttatccgtctccattttttcaccatcatttttttaatcagaaacatagtactacagtacatgtttgtatttgtgtttgatttgaaaaaaaaaaaaaaaaaaaaaaaaaaaaaaaaaaaaataaaaaaaaaaaaaaaaaaaaaaaaaaaaaaaaaaaaagaaacacaaaaagaggaaaaaaaaaaaaaaaaaaaaaaaaaaaaagggggccccccaaagggttcaaacttaatttacgctgaaaggcaagttaaaacccctccaaaggggtccccaaattaaattccaggggcgttcttttaaaacgttggaacggggaaaaccccggggtttcc

SEQ ID NO: 58999 - DNA, 409 bp, Triticum aestivum
  Clone ID: PAT_TA_58999
gtcccgaaatgaaaaatggatttactttatgttgtcaaataataaattccttggaaagtgttgggatggaaggcacccgtggatacgattagccatggaaagtgaaagtatatggtggaaaaaggaataaactttattttctgcttgggaacctcctatgatatatctagcatggaaggtgttgggaactctaagtcgttttcgttggtgggaaggacacacctcccaaaatgtttttatctctaagttttttgctttgagctctggaacctctacaaatccgtacttccctctacgaagggcctttctattactttgtgaaatttttatttttaaatttgagtctccatcttctcttataaaagcaccaactttggaggcactatgatcgtacttgagcattgtgtgt

SEQ ID NO: 59000 - DNA, 217 bp, Triticum aestivum
  Clone ID: PAT_TA_59000
acgggttgtagtctgcgagtagtacatattctgcatcttagatgcggttgtgcatttcatcgtaacgttatgggcatctaaccgtgatgggcgtgtagcatacatatgagctcaactggagatgcacatcacttcgatccattgtaccagattcatgagatgtcaacgggcagtgccagatgctgctcaactagtgctctggagcatgatcttcata

SEQ ID NO: 59001 - DNA, 403 bp, Triticum aestivum
  Clone ID: PAT_TA_59001
gagttccaacggtgcccggactgcaacgagaacggcctcatcggatgccccgtctgctgctgctgatgctactgtttttttccgttacagtctaccgtaggctaaagttctcctgctgttttagatgcttctactttgtacaatgtgaagagcatttacagaagactcctaatatatcacggcaagaggttttgcttacgatcctacagtaataattatcaccctcacgaataagttcagtagtagatccatgatgtcaggttttgttggtgaagactgaatacaaccatagaaatataaactgagttaatactgacgctaataagcatagttgcggcggcattgcatcgatgatttacgacgtttcactttttttccaagcatttttcatatcgctgttcac

SEQ ID NO: 59002 - DNA, 365 bp, Triticum aestivum
  Clone ID: PAT_TA_59002
gagtccgcatggctcgcgaggtggggccacaagttaacgtgtctctgtcagtacgcagtgtcaggggcaaggcatgttgcgctcttttttttcctagaccgaagcaacagctttgcctttgctaacaactagtaaataaaatttggacagaaaatcccttttggaggcagagctccatggagaccggtttttgaaaaattcagagtccatatttttacatgtcaaaaactgagataatacatacatatgaacgcataatgcataagtgtgtaaattttcacgatgaaataagttgatacgaggagtgtgccaaaaaacacagatgatgacaggttaacccatgaaacggttcagcctttcaggcc

SEQ ID NO: 59003 - DNA, 305 bp, Triticum aestivum
  Clone ID: PAT_TA_59003
cactagaatgtactcgcgctatctcaagaagatctactcggtctaagcttctttttgcggtgtgtttgctgacacagatgaatattgggtttacgaataaatctaactaagaccaatagttacagtcactctgaaggcatgaatgctagagcaggtctaggtttgaaggtctctgcgacgtattaaattgatttgggataatatataggtttttcatggcaaataaatactgcctagcgttgaggttaatcgaggggtgtccattcacaatgacagtaagggcagtagggcatacagcgtgttgt

SEQ ID NO: 59004 - DNA, 386 bp, Triticum aestivum
  Clone ID: PAT_TA_59004
ggggggcgcgcccagggggggcgccccccaccctcgtggacagggtgtgggccccctggtcttcatcttttgcgaggatttttctttattttttctaaggtgttccatggagtttcaggacattccaagaatctctattttctgcacaaaaacaacaccatggcaattctgctgaaaatagcaacagtccgggttagttccattcaaatcatacaagttagagtccaaaacaagggcaaaagtgtttggaaaagtagatacgacggacacgtatcaactcccccaagcttaaacccttgcttgtcctcatgcaattcagttgacaaactgaaagagaaaaagaaaaacttttacaaactctgtttgctcgtgttgttgtcaacatg

SEQ ID NO: 59005 - DNA, 128 bp, Triticum aestivum
  Clone ID: PAT_TA_59005
acagatgtacagccttaaacgcatcagacgaacaaagttctgcagtatacgcgacgatcgcatacgatccagacgatattaggcctgcatcaccacgttcctagcgcttgcagaatcgtcacctgttc

SEQ ID NO: 59006 - DNA, 234 bp, Triticum aestivum
  Clone ID: PAT_TA_59006
gcactcgcatgccacgatgctgactgtgatgaccattaagctgatactcgctcttctcggcgtacgcatcacactagcgtgacttgtgaagatatcaagtgcagcatgtaacaggggcagttagcctgttctggaccaatgagtgatgagtaatctgctgggatattgttcaggcgttcatgtgtatgactcaaaataatgagtgtgtttcctttccacacttagcgatataaa

SEQ ID NO: 59007 - DNA, 372 bp, Triticum aestivum
  Clone ID: PAT_TA_59007
ggttgttcaatggtatgtgactcctccaatgatctagataatttttgttctagtgctttattcattgcgattttttgcttcttaagtgaccctattcttgagcttgcatgtcaaatttatgaagtaccaagtaattctaatgcatgagacaagctctacgcacatgtcggagtagttgctatcaatttcattaaattgtttcacatttgtattgagtcactaccaattttagaaatttttcagaggaacatatatgttcaggaaaatgtatcaacgtggttcatcaatgtagaatgaatcccggctcctgagacttgagcatgatgacacatcatcaagggaagctgaccttctgccatgtgtcttaccatc

SEQ ID NO: 59008 - DNA, 345 bp, Triticum aestivum
  Clone ID: PAT_TA_59008
aagcacctacgtaggcaggaactgaagtggcactcagccttcactccaggcgaggataacgagtgtcttgtaccatactatcagagtctcatgctacgcctcaacattgagcagaaccgtgtatattgcagctgtggacacatctaattgctggcctgcgcgaatcactgagagacttagggtttgctgccactgtacaactacgttatcatacgtaccttacgtcattgctcggagtggtcagttctgaaacgtgtcccagtttgtgcatccagatcctgttatggttcgcattattcactgagtctcggtaagtagtcattgcccaggtaagacacccatgat

SEQ ID NO: 59009 - DNA, 363 bp, Triticum aestivum
  Clone ID: PAT_TA_59009
agagcacaagaaggacggcgagcacaagaaggacggggagcacaaggaaggcatgatggagaagatcaaggacaagattagcggcgacggccacggctacggcaagaaggacggcgaccacaaggagaagaaagacaagaagaagaagaaggacaagaagcacggcgatggccacaaagacgacgactggcaccgcagcagcagcaacgacagcgacagcgactgagccaactcccgccgcgctccggcaacagcgttcactgtatgcgagatctatgaacgcttgtgaaaaatgtggcatacatatatgtttcacagtttttagcgtctggtaccatatgtatgttatgcgtgacatgtctc

SEQ ID NO: 59010 - DNA, 186 bp, Triticum aestivum
  Clone ID: PAT_TA_59010
ttttgctcatgtttagtaataaataatttatctagcctctgttttggttgtgttttttgtgtttaattagtgtttgtgccaagtagaaccgttgggaagacttggggaaagtctttttgatcttgctgtaaaaaacagaaactttagcgctcacgagaatctatgccatttttatttggaaggtga

SEQ ID NO: 59011 - DNA, 141 bp, Triticum aestivum
  Clone ID: PAT_TA_59011
tagtccacattgctctcgaggtgaggtcacaggttaaccttgcacagtgattaaccattgtccagggccaagcatggagaacacggcattctcccagggcacaggaaccgctttaccattgctaacttcaagacattgaaa

SEQ ID NO: 59012 - DNA, 364 bp, Triticum aestivum
  Clone ID: PAT_TA_59012
cactagaggatactgccgctatctcaagaagatctactcggtctaagcttctttttgcggtgtgtgtgtctgacacagctgaattttgggttaacgatcaagtctaacgatgaccaatagttaaagtcactctgaagtcattaaagctatgagcaggctaggtttgcaggtctctgcgaagtactaattaggtttgggataagctagtgattgatcatggcaaagagatcgatgctagccttaggtataatcatgccgtgtcctttcacactgatagaaggggcagtagagaatatagcgtattgttggtatccaggactctgatatagggttattaaccaaatgcatgaatgtaactctgtac

SEQ ID NO: 59013 - DNA, 289 bp, Triticum aestivum
  unsure (1)..(289): unsure at all n locations
  Clone ID: PAT_TA_59013
acagatgtacagccataatcgcatcagacgaacaaagttctgcagtataccgacgattccaaatcgatccnacacgatattctaggccctgcatcaccacgttatagcgcttccagaatctcacctgttctcatttcactggccgtcgctgtaaaaccttgtaactgaggatcacgtgctttaacacaaatcatccgccttgcattacaacacccattcgctacctaatgtaacagtcaacaggctggcagcactagaacttcagatcattgtcacatccaaagctgct

SEQ ID NO: 59014 - DNA, 401 bp, Triticum aestivum
  Clone ID: PAT_TA_59014
caaaaacaaaggtggtccaaggaaccacaatagtattccaagcactatcctttggcactatcatcctgtacataagcaaggcaaccccagtccccaatctatacctactttgtaaggggagaaggtttcttactgctgaattttcatccgttaatttcgtttgtccatcacggtaaaaaaaaaaaaaaaaaaaaaaaaaaataaaaaaataaataaacataaaaaaaaaatcaaaaaacaaaaaaaaaaatcaacccccataaaaaaaaaaaaaaataaaaaaaaaaaggggcgccccaaaaggttcaagccttacttccccttaaatgcaatttcaaacccctccaaaagggcccccaaatttaattccagggccgtccttttaaaaagtccttaccggg

SEQ ID NO: 59015 - DNA, 328 bp, Triticum aestivum
  Clone ID: PAT_TA_59015
ggttgttccatggaatgtgactcctccaatgatctagatactttttggtctagtgctttaatcattgcgattttttgcttcctaagtgaacctattcttgaacttggatggcaaatttatggagtaccaagtaattctaaagcatgatacaagctccacggacatgtgagaatagttgctatcaatttcattaaattgtttcacatttgttttgagtcagtaaaaattttagaaatttttcagaggaacatatatgttcaggaaaatgtaccaacgtgggtcatcaatgaagaaagaatcccggctcctgagacttgagcatgatgac

SEQ ID NO: 59016 - DNA, 314 bp, Triticum aestivum
  Clone ID: PAT_TA_59016
aagcacctacgtaggcaggcactgaagtggcactcagccttcattccaggtgaggataaggagtgtcttgtcccatctaatcagagtctcctgccacacctcaaccttaagaagaaccgttcatatagcatctgtggcaacgtcgaattgctggccttcacgaatcaatggtcgatttatagtttgctgccactgtagatctacgtcatatacgtaccttacctcattaatgtgagtgtcacgttctgatacgtgtccccgtttgtgcttccagatcctgttatggttcgcattgcccactgaggctcggtaag

SEQ ID NO: 59017 - DNA, 399 bp, Triticum aestivum
  Clone ID: PAT_TA_59017
caccgtcgaactggaggagctgacgtctttcttgacggtaccaccgcggtatctacatggggctggggcgtccaaggagttgcctctccacgttcgcatcgacaagatcacctcctgatctcttccactactcttaatcttccagtgggcatatgcctaagaagtgatgtattttggttacttggttgtactcccttggtcgcaaaattcttgtcttaatttttttaaataaggatgtattaagtcatattttagtattagatacatcctatctagactaatataagacaagaattttgagatggagggagtgcgtaatacatgtcttgtggcaggtattttggttgtagtactttgagatcagacgaggtacttcgctagttccgacagtggaagggt

SEQ ID NO: 59018 - DNA, 331 bp, Triticum aestivum
  Clone ID: PAT_TA_59018
ggaagaagatggtcggcgtctccttggcgcaggacgcctcggaagaacagaccaaggcgatgagataagaattgcctgccatcagtgtgcatgccatccaggagaagcggcctgcatcaatggctctgcagttgttctacgtactagtacttctttgttcgaaagaaacacaattctgtagttgatcgtggcaaaattctttgacatggatccaccaacggggcatccatctgaacttttgttgcagcatcagtatgtgcactgtttaacccgcagaaaaaagcatgtgctatgttttttggaaaaaaaaaggcaaataaaataaataaaa

SEQ ID NO: 59019 - DNA, 388 bp, Triticum aestivum
  Clone ID: PAT_TA_59019
aagtaaccaactggacagcacatcattgttcacattatccctgtttcttctttttcttctttctttttctgttctttttatttatatttttcgttttttattttttgttaaattcatggacatcttagtagggaataccaaaggaaaaaaaaaactccgtgaacaatttttccaaaaggaaaaaaaggcccaattttttaaaaaaaattttaacggtttaagaattaatttcaatggttttaaaaggaatttaaaaattttccaaaggaaaagttcccggaattttgaaaaaatttgtaaaattgaaaaaatttcttggatttgaaaaaattcaacggtttcaaaaaaattcaacaatttcggtaaaaattttcacgcattagttaaa

SEQ ID NO: 59020 - DNA, 414 bp, Triticum aestivum
  unsure (1)..(414): unsure at all n locations
  Clone ID: PAT_TA_59020
acgacggatggtggtggcgccagagggatgcacggggtaaagctcatccgagctgtcacatcggtggagtaccatccgtgtacgggtgtgccaaagatcgacactagcggcgaaggcggcgggacgacgggtggtggtggcgccagagggatgcacggggtaaagctcatccgagctgtcacatcggtggagtaccatccgtgtacgggcgtccttcacagaaaagccgatatcgtcaaattcaacagtgataggattctcacgagcaaggcggcgaacagaaactagattagtgactaagtcaggagacacaagaacattagatatgttaacgggagtagaagtagaagggaatgacgtttgaccgacatgtgtaatgggtangaaggaaccgttaccaacggtgatgcgagt

SEQ ID NO: 59021 - DNA, 409 bp, Triticum aestivum
  Clone ID: PAT_TA_59021
gacgaccggatctgcctcgccacctttgtttctgccttgcctagcagcaccgcgcatatgccccacctccccagccagcgcagccgcccctccgtgtcgagtcctgtgctggccacgcccgccgtctgcccagcaccgctctcccgttgccttaaacaatccagctccaccactaatccatgcccctgccctccgactcaagaggatcagctgctagcatagcggtgtgcagggggaggccttgagcagacaggtgactgcgtcgctggggcggatatgaggcacatctgcaggcagcggactgtaggcaagaggcacatggcagtgtggcgagatggtcggtggcttgctgctgttgcgagtgggctacctagaagatggacacgaagaatatggtgccagaaatggc

SEQ ID NO: 59022 - DNA, 205 bp, Triticum aestivum
  Clone ID: PAT_TA_59022
ggagaggacgaggggatcggcgagagaagacgaggtgggaggcggcgctggatgaggacgagagggagagatgggatcgagaggaagagaagatgggctctctccctgcgctagggttagctggggagtgggccttgggaggccggcccaatggagaggaaaacggccaggggcctgctgggctgctctctctcctactctctac

SEQ ID NO: 59023 - DNA, 359 bp, Triticum aestivum
  Clone ID: PAT_TA_59023
aacactaaagaatcaaagagatcactggccagctttcatgaaattaacggaatcagaattagctaagtgaacggccgatgaataaacactatcactgccatgataaagaggattaccataggctggggccaagtggctacatggtggcccggcctacgcgggataaggctgagcaagagatgctggatgcacgggtcagtccagttacattgagctggctccccaggtgcaggacttggttctatgtgcatgggggagcgttggccccaacgacagccaaggttttgaacaacgcaagccttaaaggagcccacctaaaattacttgttgcaatagaataggctcaaacaagggttttc

SEQ ID NO: 59024 - DNA, 415 bp, Triticum aestivum
  Clone ID: PAT_TA_59024
ggggcgtaaaacgatagcgcttattgggaggcaacccaattttatttttagtttttttgcttctgtttaggaatcaataatccatctagcctctgtttagatgtggttttatcttttaattagtgtttttgccaagttaaacctattagatcttcttgggagatagtcatttgatcttgctgtaatttccagaatctttgcgctcagtgcccgaattgttaaaaatcaccagaatgtgataaatagtgattccaattgctgctgatcaataaagaaattttccaggtcgtctaattttggtagaattgtttgggttccagaagttggtgttagttacagattactacaaactgttctgtttttgatagattctgttttgcgtgtgttgtttgcttaatttgatgaatctatgact

SEQ ID NO: 59025 - DNA, 422 bp, Triticum aestivum
  Clone ID: PAT_TA_59025
ctaccattgactgaaatgaacgattactgccagaaacttaatcatagataacctgacatgatctggtctgatccgattggcttattcagagaaaccactttcaccgacctgtgcatgcatgtgaggatcgtcggaggagtgtgcagagacctagccgtgtgtatacacgtctgcataccctcaggtgcaccggcagtacagcgatgcttctcgaccgaccatgtcgtgcttgtcatcagcccagctggtgtgcattgttccttgcttgtacgacagcattggggaaacagaatctgatgcgtttggcatgggtggttcagttgagcgctgaaacaagatcaggacggagcagtggatcgcgcatgagcctgcttgtgatagccttttgttcacagccagctgtcccatgaaccgggaagggc

SEQ ID NO: 59026 - DNA, 437 bp, Triticum aestivum
  unsure (1)..(437): unsure at all n locations
  Clone ID: PAT_TA_59026
tccgcaataaggctcttcagcttgcatcttcgacacggacatcttatctccgtctcgttcttttgaagcatctcggccttcgcggaccttaaaaacctattcacgatgccttcggtcatcgtgcggaccatggtcgcctgcggggtagagcaaaacgatattttagaaccaaacaaaaatttggcatgaccttccctaaaaataggaccaaaaagaatgcttaatgccaaaattctcgccgaaacggaaatgaatcaacattccggcaaaatattggcaactatcgcatatcaaataccggtacacctccaaacacaaacacatatgcaacaccacaaacatatgcaacaccacanacatacatagatctagctaggccgtaaaaagtgcatgtgcacattgttgtaaggagaacaacctaaatatagctttccccc

SEQ ID NO: 59027 - DNA, 411 bp, Triticum aestivum
  unsure (1)..(411): unsure at all n locations
  Clone ID: PAT_TA_59027
tcggcggaggacgcctgcttgaccagatgggccatgtttgggactaggctccgtcgggctggtactgggaggcgctacctactgggggcgcatcttggtgaggagttagcctgtcattgacccgaaccttctttggtggcggttgcttgggccagtgacggtccagaggcttgagcaccccgcggaggtggtacgtcaccatgtcagcgaggaggacgtgcacgtccgtcgctacttggttacgttggagcataggttctccaatacctgngaggtttctcanggatctcactggagctatgatcctgtgatggttccttctctttgggtgtcaaacgcccttcgctanggttttagttgtattagtgatgttatatgtatgatactattcgggatgtattagtgataata

SEQ ID NO: 59028 - DNA, 287 bp, Triticum aestivum
  Clone ID: PAT_TA_59028
ctctacagtcaacgtgcaacgcatgatgggtgctatcgacaccgcaggtgaccgcttcatcaacttcagccaattcagtctccttctgcaactccagcccggcgctcataaatgacgtcgacatcgtcctctgagtcacttcatttcacctcagcagtccgatccatgagccgtctccatcaacttccggcttcatacatcaatttcatgcaactatctattccggtcacgatccagcctcaacttcacctggcgccaggcctaaatttgtttgatcaatttttttg

SEQ ID NO: 59029 - DNA, 399 bp, Triticum aestivum
  Clone ID: PAT_TA_59029
gagaattaaaatagtagctgctattaataatccgtggtacgatgaagaaaaaaataaaaaagaaaaatggatgatcaacgatcttagcacaaggaataaaaaatgatgatcaacgaccttagcggcattgaataaaagagaagagagaaaaaaaagacttacttcactggttagctagaccaatgaacgctttttttcctcggcagacctgataggccaagcttagctaggataagctggctcatttctgcgtcgtgggagtcgcctcagcaaactcgatcgaccagcgaccaactagcatggctggtccgcgaatgcctcctaagccgatacagagctcagtaacgggctaattaagctggccagattgcttgcacgggagcgatgtgggactacaca

SEQ ID NO: 59030 - DNA, 399 bp, Triticum aestivum
  Clone ID: PAT_TA_59030
catgccaagttgttttgggctttgctacaagtttgttttttttggtgttttctgagtcaaaaagggcgataaatggtcttgataggcgagggaggctccatctgagagcacgttgtttctcgatatccttgaagtggcccaattttttttccatggccttgtctgaccaattcaaggtaccatgccaagttgttttgatgttcaatgaattttgcattttctcgagttttctcagtcaaaaaggttgataaatggctggacatgtcacaacttgcgtatggtgacaaaaattgttcaaacctgacatggatgcctaccattggcatgcccacccacttgcataagttggggtcatttcaaggatgtacaatcatagaccatactgaatggatggtgttc

SEQ ID NO: 59031 - DNA, 143 bp, Triticum aestivum
  Clone ID: PAT_TA_59031
ctagctttcggcttcacctagtctgaggtacacatccggatgacccggcagtaacaatcgcagaggtgctccctttatgccctagccgaactaatgggaacgtagggcataagcacaggagccatgcaaccaactttggcaaa

SEQ ID NO: 59032 - DNA, 419 bp, Triticum aestivum
  Clone ID: PAT_TA_59032
cgtaccaaggagatgcagagccgtgccacggtcctcctttggcacgccggctccaccatcgcctatgtcgttgacgacctctcgtcatcttcgacggggagctatagcctgctgtggagcggcaggatgcagctggtcggcacgtgcaacggcctgctatgcctctgcgacgacggcggcagcatcaccctggtcaacgcagcaacaagggagacgctgcctgtcccacggcggccgccatgcgccggccaactattcggcgaggacaggaggtggcacagggagtacaacttcgcgtaccatccgacaacggggcgctacaaggtggtgcacgtcccctgcagcttcaaccgggtccgcgacgcggtacacgtgctcacgctaggggaggaggcgtggcgagaggtgccagcccccgg

SEQ ID NO: 59033 - DNA, 414 bp, Triticum aestivum
  Clone ID: PAT_TA_59033
agaacaggtgctggatcgaatcaagaatgatctcattgattggacgttggcaggcaagcataaggtggccctaatgatccacagacctagggaaccagattaatttttgtgctgttggtaggctagtaatggggttcagactgtaattcggtggctggatactagctttgtatcctgggtaacttgctagttgctatacccctgtaaaactcttttctaatttcaatgaaatgctgcatcatgcagtcttttcgtcaaaaaaaaaaacaaaataaaaaagaacaaaaaataaagaaaaaaaaaaaaaagacaaaattaaaatgaatacaccctaaaaaacaaataaatacaaaatcaaaaaactacaaaaaatgaccccaaactttaaattaaaaaaaaactgcggccccccca

SEQ ID NO: 59034 - DNA, 400 bp, Triticum aestivum
  Clone ID: PAT_TA_59034
tatgatgagaaattatctggtgtttgttaacccggcctggctttggacaataagtcgccagtatctatttggattgcgcccttggaatcatgcgcttataaatcattgggtatattgttcaaatctttaatagccaacatggctggatttttattatggttatcaataaccagtattatgattaaggttttcaaagtcgctttaacgcaatggatatcgtattatcaatggatatgatttattctacagttgaaggaatagtcccaagttgctgcaggcttacgacccggcacttgggggctacattatttcaagttgagattacatcaaatatgcaagtctcatgtcactgcaagcatgcaccatgacacttgggggctaatgcaaagtcattttttgc

SEQ ID NO: 59035 - DNA, 347 bp, Triticum aestivum
  unsure (1)..(347): unsure at all n locations
  Clone ID: PAT_TA_59035
tcagatgagattgtccgggtggaaagcccgcttgacatgaaaatagtagacctggtgattttgggcaaactagtgaattgagatagctgtgcaggcgagatcagttaacctggtaagcgtcctagcccgcataattagacaaaataggtgttttttggtcaacttagcaaaattagatctctgacangtcagatagattgttcttaatcccacttgtcangtattatgtgaactattggaccacgttgtagatattcgtaaatgctgtccggagatatactcgtccactcgggaaaaaaaannaaaaaaaaaaaaaaaaaaaaaaaaaaaaaaaaaagaacaaaaag

SEQ ID NO: 59036 - DNA, 341 bp, Triticum aestivum
  Clone ID: PAT_TA_59036
gaccactaagaacagcaactacacacatacagacacagcggagctctatttgattcaatcttaggtacgcctgcatgataggttcatcctctacgatactgacagctaaattcaattcagtggtcgtcgtttgagaaatttgtgactggaagatccctgtggttatgcaaattgggccccttgcagcaaatctgcctttcaccatctaggataatagccaagaggacagcatgtataggtcttcccaccagttgcacagccagaatgagtaatgggattcaccatgtagcggcacatttagcacggctcgtgttctagttaaccgcatcgtgactgcaaca

SEQ ID NO: 59037 - DNA, 433 bp, Triticum aestivum
  Clone ID: PAT_TA_59037
gcagcaaacagatgcgctacccacgattagcagacaggttcatatgcatgctccaacttgatcaaggaggagagctacacatgttttatgttattttacctaagatagagcagcagcagtgattagctagctagaaatgagtttgaggatgatgatgtgctacgctattactatgatgataaaatagcgagtgttggtagtaatgactatgatgattattattagctagtgttagtggtgattaaataaatattgttgatggtaatggctatgatgatgattaaatagcttgtgctggcgcattagattcaagtggaggtaacatgtggtgcacattgaaagtactactagtccaaactgatcacgtttggattagtagtatacttttgacatgcaccacatattgcctccacttgaacctaatccaccttca

SEQ ID NO: 59038 - DNA, 412 bp, Triticum aestivum
  Clone ID: PAT_TA_59038
cggttggagccaccaaccgggactaaagggcctcctgtctgtactcgcagcaccggccacgtggaggcccatctgtcccggttagtataagaaccgggacgaaaggcctaggcattggtaacgaccctttagtcccggttccccaaccgggacagatgggccttatgaaccgggacaaatgaccctttttctactagtgttacaaagccagtaggtcacactgaatttttgatgtgatatggccacagctatcatgttgtaatatcttctaacctgaacacgatttatacaacttgaatttaaaatgttacattaacggatacaaaaattagctgatattccctgtaattttctcttttctttccaaaaaggttgtatttttgcaagcacttctgcttattattaactggta

SEQ ID NO: 59039 - DNA, 299 bp, Triticum aestivum
  Clone ID: PAT_TA_59039
gaagacgaggacgaagaataagactaggaagaagaagacgacgaatatgactaggatgacgatgatgaagaatactatgactaagaagaagaagtagattatgaagaggaggaatatgaagaataagattgagattaagaagatgaatattaataattattcgaagattatgaagaagaataagaagaagaagatgatgatgaagtagatcgaatatcaagacgactgataataataataatgagaagatcgtgacttcgaagatgaagacgaagattaggattgataagaagacgaac

SEQ ID NO: 59040 - DNA, 446 bp, Triticum aestivum
  unsure (1)..(446): unsure at all n locations
  Clone ID: PAT_TA_59040
cgcggggtaaaaatggatctgggagccctgccatcctatttatagacagggtaaatacccaagcatcacggtcaaaccctaggtggcgtagtaactttttgctaagaaggcgcctcggttctctctttgacgtgatttggcctagattgggagtaccaaaagagaacgggcaaaaataaaagataagtatgaaagaagtattcatgaccagtgaaatggccgagaggtggaataagagacatcttagctcgaagcatgggccaaagctgactcttgctggtgagacccgtattttggtccttgatacttttaactgactctcattttcagggaaagcttagcaggaataaatccaatctaacttgagggataatgttggggatactccccacgggcgagacatanagatctatatattggaagcctatgtttggacatcagaatgg

SEQ ID NO: 59041 - DNA, 437 bp, Triticum aestivum
  Clone ID: PAT_TA_59041
tggactactcgtagctacccgaaccgcaactcaaagaattctgacaagacatccatcttccttgatacggacgctccaccactagggaacctggaggtaaagagaataataaagaaacagagctcgcatgaatgtattttttccttacttctacgtatatcctgtacgcatgaaggacaagcttgacgacgtgtcgccgttcgtgcctatgagccgcggtatggaacaactcctagacgaggtgatggaaaacatggaccaagatgagccgtccaccaaatccgcacctctggccaagtctagttcggtggcgatgcacacgcccccggcaatgagtgatccagctgcgaattcttcaactgtggcagggagcaatctcgtcgcaaaacccgcctccctggtgaccaagcccgctttctttaacacatcaacaggca

SEQ ID NO: 59042 - DNA, 439 bp, Triticum aestivum
  Clone ID: PAT_TA_59042
cgggtaactttagcaaagaacaccacaataagtgaagcgagaaaatagatgacgacttaccaagtttgggggattgtacacggagaatccgtcccgcggtttgatatggaggaagtctttctcttctcctttgtacaggtcggatagtatccttgccagagcggtgggggagtccggacccttacggccacagcgcgtggcatcgtctgtcccgttgtagtgccacatgggattgctccgatattgaagtggttgcactccccgcattatgcatattgccatcacctcgactatcgtcagtcaggatttggccagtaattttatcctgctcatcaggaaatgtacttccttgcaatcctcctcttgggggcctcgggggtgccagcttagacgtgccctcggcggggtgttacagaacttggggagtcctatccggact

SEQ ID NO: 59043 - DNA, 414 bp, Triticum aestivum
  unsure (1)..(414): unsure at all n locations
  Clone ID: PAT_TA_59043
agttggaggagaggacgacanagatgatggaggaggaaaggccacggaatgacatgcaagcaagggccatgtacgagctccttatggtaagtttcttctgcagattagccaaaacattcatgtagtgtttgtctcattactaagtagtatgactgagtcgtcaaaaccaaatgtgcagtctgtgtgcgagaagacaggtcagaccgctccgccgatgccagtgattgttcctgggaccacggtgagttttatttgaatggaaattacttgctagtcttaacatttgagtgtcatcatgctaacaagacattggaaatgatccttggtgcagcgtaactccagacaagcatcgcacgagccttctccagcttacgacatgagccaccccgctcctacacctcctggatcttggta

SEQ ID NO: 59044 - DNA, 381 bp, Triticum aestivum
  Clone ID: PAT_TA_59044
tagtaccattagctgagaaaactatggcggatcccttggtgtatcatcatcttgtactaccaccagccagcagtaataaagtggcgcctatgaagaataaaggttgtgccatctccaagaattgttatccttgtatcatgtttgctgctgcaatgcaatgcagatgtagtggtaacttgcctgcttctttttcatgctcccatccgtgcttcctcatacatggcctcttgaaagaaaataagccccggtcccattccctgaaaatcaggggatgattagattagaaaagaaaaagaaaaaagaacagccgtaagatgaagtgagagcacggatgcatacatggcttgatttgattggaagaaaataaagtccggcaacact

SEQ ID NO: 59045 - DNA, 220 bp, Triticum aestivum
  Clone ID: PAT_TA_59045
cagtccaccattcccggtcgacgggtacggctgcgagaagacgaggaagaataggaggaggaagaagacgatgaagaagaagacgaagaagaagaagaacgaagaagaagaagaggaagaggaagaatcagcagcagtatacgaacacgaagacgaccaagaggaagcagaggaacacgacgaagaagaccacgaagaacaagacgaagccctccacgaa

SEQ ID NO: 59046 - DNA, 403 bp, Triticum aestivum
  Clone ID: PAT_TA_59046
aaggcgagacataagggcgccccgctgaaggcgttgattcagagctcccccaactagaaacgaaaaatattttaaattagattgtttttttgagacaatctcgcgaaactttatttaaaccaaaccaatgttcagaggtacaaaagaaagatcaccagggtgtcctaatcaaacatggcggcccatccttaactttaaactatgcttcgctagattatgagccttgaaattcgaactcctaaactcataaacaaagctacatctactaaaagaagagttttgatctattatttcatgtaagatcccacatgctggcgtccaactgggctgacccattagcgtgaagttcacacgtagtgcacagtagctactcgggtcatgctgattggaaatatcactatag

SEQ ID NO: 59047 - DNA, 425 bp, Triticum aestivum
  Clone ID: PAT_TA_59047
gcgactaaagggctggttctgctcgatgtaggcatctcgatgacgagggcgtggctgctgcgttcgttctgggtcaacaggtaagtgctctagcccatttagtgatccataggtatataggcttatcagaaatcccagggtgggccgcggcccaccctggccaccctgtagctccgcccctgacgggatacatgggtagggacttcatggaaggcggactccatttaatcctttctagctgcttactgaacaccaagccctatttgatatgttgaatgattgttatataggtgaaggaatcgacgaagaagcttccgttcagcatgctatgtcaatggaagaatatctgaagcagacctctgctacttctctattctctttcattcgtcgtgggcagccgaattggttgaaataattatgggcag

SEQ ID NO: 59048 - DNA, 294 bp, Triticum aestivum
  Clone ID: PAT_TA_59048
agacagtatgtttgtcccaccgtgagaccacatagaaacagttgtgctagaactgatctagataacatagcatttggtctcaatcagagggagcagataaatgtgaaatatggggcttgacgcatcaatgcgatcaaaccctacgtagaatgacatgagactctcatagctcgtcatacaagctcaccacatcacagatcagaggacgtcattgaacgaactgacaactgtgatggaacgcgagttaccccatatgatcaccatgcataacttggctcattcaccacgtgacat

SEQ ID NO: 59049 - DNA, 399 bp, Triticum aestivum
  unsure (1)..(399): unsure at all n locations
  Clone ID: PAT_TA_59049
gacaggaattagaaaatgagatgtggagctccatttttaatccgctgctttattttgttttcatgaaattaagaggcaactttatatttatcctggctaggttggtttattcagttgctaaaacgagaatgtacaacttagttatttttctagatggctagaaaatagtggtatcaataaatcttattaggaatttccatcatacttaatagacgtacaaacaatttgatttttttttttgtgaagtacacattgtttccaatgtttggattaccgcccgtanatggggggcctacccgttggtcttggagaaaaaacgagacatttcttaactactctttttgtagaactaattttgtgcaatctttcatttttaaacggaatgcattacacattttg

SEQ ID NO: 59050 - DNA, 421 bp, Triticum aestivum
  unsure (1)..(421): unsure at all n locations
  Clone ID: PAT_TA_59050
ttaaacttggatgatgacggtgatgatgatgagtcggaggtagagcttgactctctcggttcattttttatacatctcattgacaatgattgttattaggaggaagccaaggccagccgtgcgggtgacgacgaggtaattgttctttcctccggctcagagtctgtgccaaaacagaaaactcgtcaggcaagccggaaagtaaggttttctcatcctttggcttatttggatcccaactttattttgaaaaagcagcaacatgaagcttgccgcacgacccggaatagggaaagcgggatcctttcctccggcttaccgaacaccccagcccctcacaaacgtcgtccagaggtctcaacaaactctgacttaacttatcccaaggccggtctnttacgacaacctcttaaccccttca

SEQ ID NO: 59051 - DNA, 407 bp, Triticum aestivum
  Clone ID: PAT_TA_59051
gacatacctctgcgccagcgtctctgtcctggccgccttcctctttggcctacccggcctcggtgcctcttgttggcgagttgctgcgggttcgacacggcgtcccgaatgtcttccctataaaacaccatatgtatatggtaggtgaagtgtctaaagggggatcctagtttttggagttgggattttggtttttcttacgtgcgatgcagggagcagtccgggatagtcgcccgtaatggccaccatggcgtcatcatagctcaattgatagaactgtctgtctatcagctccacgaatatgtccggatcttcttcgagtacgggaccaacggcccggtcagggtcctctggttgtggagatgggctgttttcctcccttacagcttttcacagtttctccataa

SEQ ID NO: 59052 - DNA, 425 bp, Triticum aestivum
  Clone ID: PAT_TA_59052
agctagcaggaatgcatagcttgttagcacggaacacaaatccatcattaacgacaaacttgttccaggttcttccttctttacaattctacaatacatctttaaaatcagcatcatgcacatattgatctttgatggtctccaaaccaaatattttgaagtcaagttgtgaaagcatagtatagcgacgagacaatgcatcagcaataacattttctttacccttcttgtgtttaatgacataagggaaagtttcaatgaattcaacccatttagcatgtctacgattcagtttagcttgacttttaatatgtttcaaagattcatgatcagaatgtataacaaattctttgggccataaataatgttgccatgtttctaaagtccgaacaagagcataaagttctttatcaaaagtagaataa

SEQ ID NO: 59053 - DNA, 426 bp, Triticum aestivum
  unsure (1)..(426): unsure at all n locations
  Clone ID: PAT_TA_59053
gaatcatagtcctgcacataccaaagtgattgttttttgacaaaaaacaatatgcgctaataaaataatcttagatggatatcacctgatttgttcggatgaccgatgatccattcaacgcaacagaaaacagctcaggtagaccggcaacccaaaatagcccggcggcttatcatagcagtggcggctcaatgcggccccggtgaattaatacagcagaggggctcaatgttgcgcattttttaacttcgtccgttttttttaaatctccagacacgtatttttgcaccatagtttcgtgtagccttctgatgtccatcttgagccggacagataaatagtagtaacaaagtattgccagtaatggcagcgcacactgacggagctgactgctgacgcgaccgcagtccagagtggncaacgttt

SEQ ID NO: 59054 - DNA, 391 bp, Triticum aestivum
  Clone ID: PAT_TA_59054
catattccaaattggctacacctaatgatgtggccgttgaaagatgaattacatatgccacgcacgtcattttgcgtggttctgtatttttagctgtgggcgttgctaaacattcaccatcatgttggtgccatctactgtaagctgtattggcagctcggatattctaaggttgcctgaatttatgtttagtatgacaacaaacaatttccagtatgcatgcctacccatataatgttaatgggctgtgggccgattaccggtaacatgcttggtcttgtgcgacctgagaatccctgcctcacacactcgacgaatttagcccatgcatctggtatctagatacaattactcctacaaatattgtttctatagttgtgatctaaatgct

SEQ ID NO: 59055 - DNA, 339 bp, Triticum aestivum
  Clone ID: PAT_TA_59055
ccgcacgacaagcgcaagagcaaggcctccatggaacagggggtgatggacaacctcaacaaggctacgccgcctactgcaagcgtgaaagcaaagccccgcagaagcttctgaacccgatgggccacgcagtcacagagttagtgatctcctttgactgatttcgctaggatgatactacatgagttagaagtttgtcgtgccggggacggaggcgagacggaggcttggcttgtgaagtgacgcttggatgcacgcgtaattttctttacattttttgttctcgttttgactttgaggatcgcgccataattcttttgaactgtcaactgcattcag

SEQ ID NO: 59056 - DNA, 412 bp, Triticum aestivum
  Clone ID: PAT_TA_59056
tacatgcacagtaaactgttttactgacctgaatttgttttttttgccgagagttgctcagttgtccaaatgatttgaaaattagagcggacctcatgcatcaaattgtctgccattggaaaaatttgtaactttttgaatgtttctagtatttgttttgatttgttttttatttaacacgggtgcagatgagctcgggctcacaaaagcatttctcaaagtctggtctctaaatctgggcagtgtttgcgttattgccgctctaggactttgcttccctatctctgtcttcctttcgttttcgtttcttcaaagtcagagaaagagactgggtaaacaaaccaaaaattttgcgcttttgactggaattgtgataggcacgtttcaacaagcagggcataaacaaaacgaa

SEQ ID NO: 59057 - DNA, 415 bp, Triticum aestivum
  Clone ID: PAT_TA_59057
tattattcacgtcatgggttttacaagtacaaaaacgacgtaacctagatgaggtcacaacctgaatatagtccgtgtggttatggagcactgctagaaaccaagaggtgctgggttcgataccatgttctgcaagttttttaccaacgagggaaaaacaagtcccgagcgggaatcacggataagttgcaaaaatcctgccggcaggatttgagcttttccgattaaaaaaatatgcatctagtgtaaaaaaaaacattgtgctacttttgaaaaatgtcaatagcatttggaaaatatttgtgaaattcaagaaaaatcacgtgtttcagaacaatgttcatttccataaaatgtttatgcaatgaaaataaatgtttgcataatttaaaaaaatccatcgaataaaaataaa

SEQ ID NO: 59058 - DNA, 99 bp, Triticum aestivum
  Clone ID: PAT_TA_59058
cgggatgttaaacttagaataatggatgaacttggaattgcccaaaattttacatgtctggtgcgagctgaatgctggtgtttgagctgtgtgttttcc

SEQ ID NO: 59059 - DNA, 423 bp, Triticum aestivum
  Clone ID: PAT_TA_59059
aacgagaagtgatggagcgctaaaccttgacaaatctcggggaaaatggagctcgaaagtcgagtttcgagaggagaaagattaactagtgtggctcggacatttcatcgaacacctcatgtgcataggaggtgagatagagcacccaaatgccctctcctcgccggccaaaaaaaacagagcactgtggagtgctctgccgcggtgatgggtatatataggcaatttatttgtcccggttcatgccacgaaccgggactaaagctcccccttctacaccggttcaaggcatgaaccggtaccaatggctgtgggccaggagcgaggaccattggtcccggttcgtgcctagaaccgggacaaatgggtccagacaaaccgggaccaatgctcacgaggccccggccgggcccctgggctcat

SEQ ID NO: 59060 - DNA, 395 bp, Triticum aestivum
  Clone ID: PAT_TA_59060
tacggctacgagaagacgacagaagttgacgggccaaagaagattgaggaggttcgaagggatgctgtgaaacagaaaatgagccaatcaactagggtaggttcttcccctaactataactcatctgctagctccattagctcatcagcaagaccagggcctccaccagattatggtgttcgaggatcttctgcttctcgtggatcctctcaggttcgtgtatatggatcccagaatgttaatctggatacaagataccagacttcaaacagagccatgtcagtcccacttcatcaaaggcgatctgataaatccattcgacttagtcctcaaggtgacttgggaagagaaatgtcaatttgtgggaagccaccagcttcaaatgacattttgcc

SEQ ID NO: 59061 - DNA, 405 bp, Triticum aestivum
  Clone ID: PAT_TA_59061
tatcataaataacaataggaaaacatgatgcaaaatgaacgtatcaactcccccaagcttagacctcgcttgtccgcaaacaaaaaccgaaatcgaaaaacatgtccacatgcttagagagagagaggtgtcgataaaaacaaaatacggacatagaagcatgatgtttattattatagcagcaacaaacttaaacaaaatacatatctttgtcataaataacagtaagtgattacatacggagcaaaataagtgaatctacactctaaaatgtctaaaaacaagtgagtctacatatatccgtatgttacagttcatttgaaatgtctaaaatgacttatatttaaaaacgaagggagtagatgggttggctatgacaatactaatgtgaccggaagtcctgag

SEQ ID NO: 59062 - DNA, 254 bp, Triticum aestivum
  Clone ID: PAT_TA_59062
ggtagtaagaccaaaggacctaagcagctgtaggttgagaggaggttcaacatggattggaagtgaagaagtggtcattactaggtgatgacttctctttggaagccttttcaaaatgaaattctaaggcagcagcgtcgtttacctatctgacacttgctttttctatttatggacttctagctattggggatgattcttatggatgcctggtttggtttgatttatatgcataaatgaaatgattcttttgc

SEQ ID NO: 59063 - DNA, 398 bp, Triticum aestivum
  Clone ID: PAT_TA_59063
ccgtttaagcatattcatattgtccctgggtgttcatatagggtgaatttttttggtttccaataagtttcccaacaagaataagcaatgaagtgtaagccaagtcctcaaaagattccaacctgaagaagccaagaaccaagtcctgtgtgggccaatccccaattaatggcgaatcctaaggtcaacccaagaatggcgggcgatgttgcgtgcaacccctaatccaagacaccaataataacccttaaactaatcctcaagtccaagacattgataacttccttaaggttgcctcaactcctgtggacatttttgcccctaattgcacatgccacttacacgtgggaccgacccagtataaagaaaaagaactctctgtcacacctcactctcac

SEQ ID NO: 59064 - DNA, 386 bp, Triticum aestivum
  Clone ID: PAT_TA_59064
gcattgcatgcgtatggttgcttctttaatgattctttttgaggataggactattaaatatgcagaggcatttagtatgaaatgttgaataataattttagtgattttctacagtagagtatgataaggtttttgcaatggtttatactaactcatctcacgagtccttgttgagttttgtgtggatgaagcttttgagatttagggagaccgtgatatgagaggaattaaggagacacaaaatctcaatcttggggatgcccaaggcatcccaagataatatttcaagaagtctctagcttctaagcttggggatgccccggctggcatcccacctttcttcttcaataaactatcggttaatattggttgatcctaagtttttg

SEQ ID NO: 59065 - DNA, 434 bp, Triticum aestivum
  Clone ID: PAT_TA_59065
gaaaatgaaaaaaaaaaaaaaatataaaaaatgaaaaagaaaaaaaaaaaaaaaaaaaaaaataaatactaacaaaagaatcaacacaataaaaacaaaaaacaaacaaaacaaatcctttttcgaagacttaaaaaaaaaaaaattaaataagaaaccaatccataacatcaaaatcgtaaaaaaaaaacaaaatcaaaaaacataaccgccccccccaaaatttccacctttactttcccgtgcaacccaattaaaacccccccacaagtggccccccaattttatttcagggcctcttttttaaaaaattcgacccgtgaaaaacccctgtttttcccaattttaccccttttaaaaaaaacccctttttccaaatttggataaacctaaaaggcccccccttttttccccttccccaaatttttcccccc

SEQ ID NO: 59066 - DNA, 395 bp, Triticum aestivum
  Clone ID: PAT_TA_59066
tataacaatccaccatgaacttctgcagggatttcattggcgaccaagcgattcataatattcacctggaggacgacagttctctggcgccatattaccttcacgacatattacatctcaaggggaacaatacaaggaggccacatcagttcatcgagtctatcgacgaatgataaaggatacagtttcaagcgaatatgagggtgtaacaaactgatgtatcttgggggcattctttgcctgagactgtttctgttggagcaaagtgtttgtaccataatgatctagattatctatgtggacctatatattattgtcagcacaacatggaatgaatttgaatgtcaagtacaaaccacggtattcgggcatgaccgatctaaaaaaaaaaataa

SEQ ID NO: 59067 - DNA, 252 bp, Triticum aestivum
  Clone ID: PAT_TA_59067
aggaggaattgcgcatgggcgaggtcgaggtagagaagagtctgtccgtcgaggaatcggcggtggagtaccaacgcgagcgctggtgcaaccactactacgagtactacaaccttgagggcggcgccgaggacgaggacgaggatgaggacgctgtcaacttcagcaggggggatgcggagtccaccaacggcggcatgtcgccaggacagtcatcgacgtctcatctcacaccggtgatgcataggcctc

SEQ ID NO: 59068 - DNA, 298 bp, Triticum aestivum
  Clone ID: PAT_TA_59068
taccggaacacgctcagcgcctacaacttcgaccgcttcaagcggctccataccaagatgatgaaggacgttgacgacatgctcgcctatgacattcccgacctgctcaagcagttcaggaacccctacgagtgagtcaactcaatgaccatggatggaaattccagaccccaattttatttctcgtggggttcagcggaaacttgaacttgaggtgtatgtatgttaactttgatcataacgctttgatgtactatataagtatcagtcaatcaatatttacatgacctcgttgatc

SEQ ID NO: 59069 - DNA, 443 bp, Triticum aestivum
  unsure (1)..(443): unsure at all n locations
  Clone ID: PAT_TA_59069
gctgacgcgtggatgcctattggtcccggttgatgccaccaaccgggaccaaagggtctcctgactgggctctgcacactgcccacgtggatgggctttagtcccggttctggattgaaccgggactaaaggtgggaggtattagtaccgacactttagtcccggttcaggaaccgggactaaaggcccttacgaatcgggactataggccctttttctaccagtgcagccacacatgacggccaccgtcgagagataaagcatgatttgctaagttgtgagcttcaaaattcaagctcctaaattcatggctagatttacagaaatcaaaagtggcatattatttcatgtatggtagctccataaacagatgagttttccttcttcaagtctaccancaccactttgcaatccgaaggcaacttggaaatcacacacataaa

SEQ ID NO: 59070 - DNA, 187 bp, Triticum aestivum
  Clone ID: PAT_TA_59070
atcaacgaagggatacgggaagaccataacatgtatgtacggtcgatctatttcagaacgcatactatcggtctcgtacactcactacagttgtcttcgacttatgacgtcatcagtggtagcacggtgaccttgcttaacatccgtgcactcaacattatgcacgtttcactcgcatgcttgttac

SEQ ID NO: 59071 - DNA, 375 bp, Triticum aestivum
  Clone ID: PAT_TA_59071
cggaggaagagaagaaaaagcagctatttcacctggtgtcgtaataaccactgttttcgggtttgaaggcataagcgcagcagagatcttctttcatttaagaagaagccaccgtaaagaagaggaaacaaggcgtttaagggacaccgactcccattattttctccaggcctgctttggctaaatcgacggaggcttagcttattatgtttcgggcgtttagctagcttagagaataaagaaatctatctctaaagggggagcggtacgactattttaggttagaggaaggttgaagagagaatagctaaaatagccagtcgggtaggcaagtgcgggtggctgtggtcaaagtgaatatgtcctgtttcggtt

SEQ ID NO: 59072 - DNA, 405 bp, Triticum aestivum
  Clone ID: PAT_TA_59072
tctgccaaggtgacatcaccaaggtactcaccaagatggtgcactggaaccccgaccttgacttcgacgcctcgctggacagcttgccggagggtgtggacctcgcggcgctcagggagcgtatcaagcccgtcatcagccatatcggcggaatccagtggatagagggccagcaccgagattaggcaccctgtctcgcactgccgctgcaggttcctgaccaagacatttttatctttagttagaaccgcagcaacaaatgatgtaatataactctgcagtacttttgagacaatgcatgttaatttcctgtccgatcttcgctttgtacgttcaccctacgctaatcgggtaggcttgccggcgcgtaaacccagggcggcaccttgaggatggatccccaat

SEQ ID NO: 59073 - DNA, 424 bp, Triticum aestivum
  Clone ID: PAT_TA_59073
cggcgacagtgccggccacggtggcgagctgggcgctctgaagcggtcgtcgtcgtacaatgccgacaggggcagagaatccacgatgaacgctgctagcaccacgggtggtggttgcaagctggagcttgcggcggaggaggtggacggcgtccgcgcccgctgcatcccggccgggaggaaacccagcggcagcagcagcaagaagtctccgaccacccacgtccacgttagcagccggcgcggcgaccaaccggaaactaccgacgacggacggactgactgatttcacccaagaaaactcatgaaaacatactagtactagcatcaaaatgttgatcgacgtgcgtccgctgcagactgaacgaatgtcttgctacggcacgcgctcttgcatcgactaactttcctttttaaaatttcc

SEQ ID NO: 59074 - DNA, 216 bp, Triticum aestivum
  Clone ID: PAT_TA_59074
agagtatatataggcaaaagaattaggtcaggggactctcgaggggcccacaaggtcgggggcgcaccccacccccctaggcacaccctccacccttatggccgcctcgaggctcctctgacttgaactccaagtctcctgggcgtcttctggtccaagaaaaatcatggcgaaagttttattccgtttggactccgtttggtattccttttctac

SEQ ID NO: 59075 - DNA, 363 bp, Triticum aestivum
  Clone ID: PAT_TA_59075
gatgaaagatgccggcgccgacatgccactaagatcccataggctcgttgtgcacgtccctgctcttcctgagggcaccgctcgggcctcaacatagcaggaacagcggtactgctggataggcgaaagagatggcattttcgatctgaccagactcatccttgacattctcatatataaagatctgcggttgactccagctccggcaccattgatggtgtgagctaattttcgttggtcaacgctgtaggttctacagtgctaatgcgaaaatctgagatctgaaaatgtcactgcttcccgtgtgataccctaatcatccatgcagttggtgacttaatcaatccgatggaatttgctgct

SEQ ID NO: 59076 - DNA, 370 bp, Triticum aestivum
  Clone ID: PAT_TA_59076
ggaaaatacattctgcatctcccattgcccatggtagcagacgctcatggaggagtgcgcaaaagactgcggatcagaaaccctcagagccagtcaatactcggcctcgccgtactccgagcagaagtcattatcacgcagcatcccggcggactatacggctgagctgtctgatgccatcaagctgcacatcgggttgtaatcacagatagcatatgcatctatatgatgctataagcaattgacgatatagagtaaatagtatatgcatgttgctgaaatgtggcgcggatattagatatgactagcgtgcatgcggtagtttgtaaaaaatgcatcttgatgttccgtgcagggcactcgaaacgat

SEQ ID NO: 59077 - DNA, 328 bp, Triticum aestivum
  Clone ID: PAT_TA_59077
tggaacaaaaaggtctcgcaccttccatttgcttggaacacaaagaattatgtattgctatgccatggttaattgtagggttattgtttggcattcatgttaagtttagttgaaactgtatcatcatgggttcagtttaaaagtagaaactgtctatcaactgacatgcttttgttgactgctatggagtaattttgatacgaacaaggctgctaattgatttggtccttggtatagcttgtttattccgagatgatgttaatttctaagtttaatctgttgaattagcatggttatgctacccttcaagttgtaattcaacggatat

SEQ ID NO: 59078 - DNA, 368 bp, Triticum aestivum
  Clone ID: PAT_TA_59078
gaccgcaaaatggaatgcctccaagagccccgcgtactacaagcgcggggactatgtgcccggattgaacgttgatggtatggattttcttgcagtgaagcacgcttgtaaatttgccaaagaacatgttctggaaattggaccgattattcttgagatggacacatatagataccatggacactctatgtcagatccaggcagcacttaccgcactagagatgagattgcaggaataagacaggagcgtgatccgattgagcgagtcagaaagctattattgacccatgacttggcaacagcccaggagctcaaggacatggagaaggaaatcaggaatgaagttgacactgcaattgccaaaacaa

SEQ ID NO: 59079 - DNA, 368 bp, Triticum aestivum
  Clone ID: PAT_TA_59079
agcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggtcatccagggtggacctggcgctgtcatccgtggcaagaaggcctgtagggagcaggaggcatcaccatcaagaagaccgggcaggcgctggtggttggcgcctacgaggagcccatgacccctgggcagtgcaacatggtggtggagaggctcggcgactacctcgttgaac

SEQ ID NO: 59080 - DNA, 268 bp, Triticum aestivum
  Clone ID: PAT_TA_59080
aaccgcgagagcccgtgccccagcactgctgccccttagtctccggatcatcgtcatctccgcctgtgcgccgtcgccgcgggtctctgccgctgtccacaagattcctcttcgccattgtcgcaccatgatatgctactgttgatactcgaacctcagagcgaaactgtgctgtgaatcctgtgaaaaaacttacataaagaccagtatagttatgtgttgtgaagttttcaagttatgggtagtccttttaaggactatggaataa

SEQ ID NO: 59081 - DNA, 314 bp, Triticum aestivum
  Clone ID: PAT_TA_59081
agaaaattgtattggattgaaataatagatcgcaaataaaataaaatgcagcaaggtatttttgtatttttggtttaatagatctgaataaaaatgcaaaggagaagtagatcgcaaagcaaatatatgagaaagaagacccgggggccgtatgtttcactagtggcttctctcgagaaaaatagcaaacagtgggtagacaaattactgttgggaaatagatagaacttcaaataatcatgacgatatccaggcaatgatcattacataggcatcacgtccaagattagtagaccgattcctgcctgcatata

SEQ ID NO: 59082 - DNA, 328 bp, Triticum aestivum
  Clone ID: PAT_TA_59082
gacgagactctgatcgaacaactggagggaagtagtttggatggggatgagcccgtgatagaactggaggaaagtaaggaacctgagacagaagtctcagcaaatgtttgatttagctgtaaaggccaagggcgccatctctgattgtagaaggtaccaatactgttcatgtaaatacaaggatggtgctattgtacttgtactcgccgtcctttgcctgatgaagcagaagagctgtccaacaccgccgttccctggggagtcagacaaaacaaaacctgtgaaaacaaaaacttgggggtaacaacctgacaatttgggtttgggg

SEQ ID NO: 59083 - DNA, 186 bp, Triticum aestivum
  Clone ID: PAT_TA_59083
caaggaagcagtcccgacggttgttctcactgatgaggcggaggaagaaggaagtgaggggcaatatctaaccgacggagagttctcctttccttctctctttgtacttttcgctctgtctagtaggcagtgctgataatgtgtttgagatcaaaatgaaatctctatcattgatagattgagagc

SEQ ID NO: 59084 - DNA, 357 bp, Triticum aestivum
  Clone ID: PAT_TA_59084
gggtgaactactccctctttgtcatggagaccgccgggatgatgaagatggcctccgatgatggtttcctcctccggcagggtgtcgaaatgggctctcggttggtttttcgtggctacagaggcttgcggcattttgggatttatcagaatttttggcgtcggattcacatcagggggttctcgagggacccacaagccagggtggcgcacccaggggtagggcgcgcctcccactctagtggttccctccggactcttctggcccaacttcgatgctcctgggcttgttgtggtccataaaaaatcaccgtaaattttcagctcgtttggactccgtttgatattccttttctgt

SEQ ID NO: 59085 - DNA, 385 bp, Triticum aestivum
  Clone ID: PAT_TA_59085
aacatgtaccagtttgtgattgcttgtaaagtaaagcccataaacacccaaaacgggtaatataatagcatggaacaatcaaaaaaaaaaaaaaaaaaaaaaaaaaaaaaaaaaaaaaaaaaaaaaaaataaacaaaaaaaaaaaaacaatcaaaaaaaaaaaaaaaaaaaaaaatcaacaaaaaaaaaaaaaaaaaaataaaaaaaataaaaaaaaaaaataagggctacccaaattgactcaactttaaattcctctgattaatacatcctgcgctccttacataatactccaaatctattaacaacactgtcattgaaaaaatgtatcataggaaaacacctgcatttcgaaaacttaaacccattttaaaaaccacccttt

SEQ ID NO: 59086 - DNA, 399 bp, Triticum aestivum
  unsure (1)..(399): unsure at all n locations
  Clone ID: PAT_TA_59086
gaatacaacttggaactcctgcaatagagaagacaacactaaaggtaattgtgtgaggtgttagttttaggtgcctcgtccttgcacaagaggaaatagtgcataacacttgatgggttctcacacacttctctcatctcatttttggtggcaaatagtactaagtttttcttgtcgctcatcatggaggcactcaattttggcttgtggcactcactctatttgtggtggctcgctttctcacttttctctccacgatgggtggcttgcttgtcggcgatcacttgacttggtgacatangtcgtagcacgtactcctttcccttcatcttgaagctatagtgattggttcgcccattgtagatgacgcattggtcaaatttccatgatcgtccaaga

SEQ ID NO: 59087 - DNA, 401 bp, Triticum aestivum
  Clone ID: PAT_TA_59087
cgaagtgacaggaaaatagctcaacagcatagccaaaaatatataatactcctatacatgcatatattcatagtgtgatataactacatgcataggaaacaataggtaaaggatgatcaacatgtaacttgccttggttctggttcataaagtcacactcctgacaatagctcgcgtcgtactccggaaaatctacacgtttcacacaattcaacaaatcaatcaccgaaacacgaatagaaccaaaacaaaaccaacagcaagaaaaccattttttaaactcaacaacagaatcttaacagcacctaaattgctctatggtcacaatgcaaaaggaatcactaaatttcgttaaacggttgggaagttacggcctcggaagatttgattaaaatccgaac

SEQ ID NO: 59088 - DNA, 407 bp, Triticum aestivum
  unsure (1)..(407): unsure at all n locations
  Clone ID: PAT_TA_59088
cttgaactttatgttcatgcccatggacacgatgtcgatcctatcatgaaacttcttgtaataataactattttcttgatataatatccattggtatcggtgaattgatcctttgcaattgtggttccgaccatatgttcttctttgattccatatggaacactgctacgatagcataggtatgactatcttgattctgtcataaaatcgtcatcgatgtacatgcatgatagaaaacgtgacctactgtgacaaacacgtatcatcacggaagtgtatttttttgtagtggaagaggtagcacacgtctccggggtgtgggccccctcatagacggtgccgccgcaggcacctagaggggggaaatagccgcatcaggtctacgcggagggatcntgctatgggtt

SEQ ID NO: 59089 - DNA, 273 bp, Triticum aestivum
  Clone ID: PAT_TA_59089
ttgagctataatgtcatatgctcggaggttgtcaaatgtcaccctcaagtcgtctactagagtttcgacgtgcttggtcttgacgaccacatcgtctatgtatgcctctactgttttgcctatctgggtagctagacatgtctgaatcatgcgctgatatgttgtgccggcgtttttgagtccgaagggcattgtgttgaagcagaatggcccatatggagtaatgaatgccgttgtggcctggtctttttctgccatcttgatttgatggcg

SEQ ID NO: 59090 - DNA, 403 bp, Triticum aestivum
  Clone ID: PAT_TA_59090
ctacttgaaatctcatttatggtagtgtgcattaatttgtaagatttaacttgcaaatcatgacattgctcgcaaccttttggaatgtatttggatatcactgaatatcaattatttcttcataaattaattatttaaattcaagacttgcttgcgctataggatcccttcaacatggtacaagttgcatgatacctcgtgatctcattgtttatcagttcatttcctgttaattagttaaatatcttagttatcgctctaccttaacagtacgctgctacagcctacaaattgtgataatctgtttgttccacataatacacttacacttctgaatcatcgcttgttacaaatattttaaggcatgcgatctaattcttgattgttttgcagcttactaaaa

SEQ ID NO: 59091 - DNA, 282 bp, Triticum aestivum
  Clone ID: PAT_TA_59091
cgggggtggcggcgccgaagacatgaacgacgatgattgatcgtagcagcctcatagcactcttcacttgaaacaagggcgtccttttgacccccgcaacaatagctctcttgtacataggcactctccggtccaggatagttgagtggtgatagtggtgttggtgtaaatgtttgctgtgggtaaaatgcgttcatctgatactatggtttacacatccctgttcttggccaaagaaagaaagaagacgacgatgaaatcgagcggtttcgcgtgtttttg

SEQ ID NO: 59092 - DNA, 414 bp, Triticum aestivum
  Clone ID: PAT_TA_59092
gaaccttggaagcagcccctcccaaaggacgatgacactattgtcattgagatctcacaccaaggccaggtgaccatgctagcaaacgaaccctgcaagtcaatgagcctcagtgacccgttgtcgtcacacggccacaacgaccacagtgacgaacacaagaacgacgtggatgacgaggagtgggaggatggcaggaggaagtttggggctgcggagaccttcaagctccctgatgagatcgacattgctcatctcagctgagctgcatatccattcttatgacaaagatcatatcttgccggttcacaatatttgtccagtaaagtgatatcactatatgcaaatagcttcatgcaaaaccctgtatagctggagtttagtgaaccaagcgcggaacaactaattttaatt

SEQ ID NO: 59093 - DNA, 414 bp, Triticum aestivum
  Clone ID: PAT_TA_59093
ccaggccaaccccacacccgagcccggtgagtatgtcgtctttgtatcccacctccgtcggggtttaggcttcccgacggatccttttgtgagagggatcatgttttactatgggttggaattccacgacttggctccggagtccatcctccatattttcgcgtttattgttgtctgcgaagccttcctccgtgtcaccccccacttcggcctgtggctgaagaccttcaatgtggagccgaagatgatcggggggtgtcaagcagagtgcggcggggcggccgtaagcaagagggctgatgcctcgtggcccgagggctccttccaagaggagctcggcttgtggttctatatcaccgctccgaagagcagcaggtagaagccgctgcctccattccgctcgggaactccacg

SEQ ID NO: 59094 - DNA, 224 bp, Triticum aestivum
  Clone ID: PAT_TA_59094
gtacacaaagttcttcatggtttatggagcggaagtggttcttcctagtgacatctgtcatgactcaccccgtgtagcggcatatgtcgaagctgacaatgagaaggcacagcaggaagctcttgacctgttagatgaagagcgtgaaatggcagcagcccgttcggcgatttatcaacaagatctgcacagacaacagagaaaagtggaactaaacacaaaaa

SEQ ID NO: 59095 - DNA, 441 bp, Triticum aestivum
  Clone ID: PAT_TA_59095
aataacgggtcgacgggtacggctgcgagaagacgacagaagcgacggggcctccgtcttcctcctctccgcctaccaagagttcagtgagtttggaacggatggaggaccagcagcaaagtctctgaagcccaagttcaacctgtttgtcaagcaggtgtccgccggcattgggatggcggtgccacacattgacatcaagtctgtcattgccttcaccatgtttcttaaagcctttggtggtctccttttcatcatcagcagctcgttcggagcgctcgtactgcttgtttacctggcattcataacccctgtcgtgtacgacttctacaactacgagatggaatcccagcaattcgccaagctcttcaccatgttttcacagaacctggccctcttcggcgcgctgctcctcttcctgggaatgaagaactccaaccc

SEQ ID NO: 59096 - DNA, 396 bp, Triticum aestivum
  Clone ID: PAT_TA_59096
cgcattgggaccttaaaagagcaattgatgtggacattggagccaatccctctgctgatggtggaggtgatgatgagggtgtccattaccaggccgtgacggtggttgacattgttgacacgttccatcttcatgatcacactgcttttgacaagaagcagtttatctctcacatgatgcgctagatcaagaagctctctgccatgcttgaaagggatgacctagatgttttcaagaagaatgttgagtctgccacatagtatcttcctatcaagctcaatgaccttcaattcattgttggcgatagcatgcatgatgatggcagcgtggtgttcgcctactacaaggagggagctgctgatccaacttacctgtactttgcacatgggctgaaag

SEQ ID NO: 59097 - DNA, 400 bp, Triticum aestivum
  unsure (1)..(400): unsure at all n locations
  Clone ID: PAT_TA_59097
agtgtccctgtgctatggagttcatctacgtcgttcttccggtgccgtgtagttcgtgcgatcgaggccccgtcatgttcattaaatactgtacatactgtctagtagcaccgtgtgtgcggcttggcctcgaatctcgatgtaatataagacctatgtaattcgctagcatcaataaagcggttgtttctataccatgttgttgtgtattgccagaagacttgatctccgggctggcaatgcaaggtaaaccggttgctctgagccggggtgccacatccccataaagctaaatgtggtcgcactgagaataactcgattcagtggcaccatgactcgattaacattatattcaagtgggattattatcaggtttaacttgaaaataaaatcanccaag

SEQ ID NO: 59098 - DNA, 401 bp, Triticum aestivum
  Clone ID: PAT_TA_59098
tcggaatcggtttgactccccttgtagttttttcttttcttgattgcttcttcagatccgacttgtgctagtagcacttgatatcttcttttcacgtacatagcaagcggggatcaaactctgtagcttaccatgatgagtactagtacttcttgataatttggtatgggctagctgactagctcagtcttcacgcggccggttcagacggcgcaacagacacgggtggcttagcttggagcaggcgaccgcgacccaacatgcaacaagagtcacccgagtccgtgctcacgcccggtcccttctccaagtcgcggccggtttgaccaatccattccagtcgtggttgatctctgattttgtgcttgactgtacgcgcgtggattcgatcgacagcgtgt

SEQ ID NO: 59099 - DNA, 385 bp, Triticum aestivum
  Clone ID: PAT_TA_59099
acggtttatactatacatctattttgctgatccgacatgccacaggtcccgaggcatcgattcgtggatgtttgtgatattcccatcgtgtgaaaaccaaaggcatgttcatctactagtactactgacgtggaggcagtacctactaaagtactatatttcatatttataaatccttcaatggctgttgagcactacatctactgatccatcaagccatcacgtcaaggcgtgtgccgatctcaacacagagatcaaggaatactacagatacaagatcagatcaacatgggtctccagaccagcgatgacccggacacggattaattaaaccaaccatgatgtggaggaagactcggattggactcggattctgacatctctg

SEQ ID NO: 59100 - DNA, 382 bp, Triticum aestivum
  Clone ID: PAT_TA_59100
gacgcgaggatagttagttcatcggaagtagtagtagttttcttcattggtacgttaaataaagagtttagtttcgtatttacacaatttaaaatgattgttatggagagaataagaaaaccactccactatatattagtcgtatacacgagtactatatggacgcagcttcattgactttagtgcacttgcctttgggtttatgataggtgggcccaaaatgtggctggcccacctgtcatacagccaaaagcaggtgcagttaagacactggagctcagtccgtactacagtatatatataagctggagcctcagcacttgttctctagggtttgcactctccacactctcgctgcactacatatatatatacacgctgg

SEQ ID NO: 59101 - DNA, 404 bp, Triticum aestivum
  Clone ID: PAT_TA_59101
ggtgcccataaggcaggcttgccggagcaaagggcagtgaactagaggcggatcgttggtcaggctggccgcgccgctgctgctgctgctaattgctctgtaagagtgtacaatatggaaagcgtccttgagttatacagaacgtgccagcttccttttgtgatcggggaaagaggggaatggggatggataacacggaagagcaacgcaatgcatgcatcctatcttcaatagtctgtaaaagtttttggtatgggcactgccggtaagcatgaaatatgttggcacttggcagtcttgtattgttttgatttcgttgtggtttgaggcgagtacttggattaccaacacgaagcaacgggcttgagggagtgcagatacttcgttgatgctcgacgaatgga

SEQ ID NO: 59102 - DNA, 192 bp, Triticum aestivum
  Clone ID: PAT_TA_59102
cgaagacgaaagcacaaaggaagtcgccgggttctgggggtacctgctgcagattatctatcagacaaatgcaagagctgtgaagcctacagactgcatcatctgggtcaacaatttcccattcctcaccgtaaaagaatacagtatggattttctactgataagaatggactcggtcaaagctgttttcct

SEQ ID NO: 59103 - DNA, 355 bp, Triticum aestivum
  Clone ID: PAT_TA_59103
gatccaaagaggatggctgggaactgtgctgaactgaagatggctgaagatcgtcagggtttgcctgagtttgctccatataaataaataaaaatggcggtaataatcatttagaacgtctctattttgtgcgagcaaaattagtgaacttacgggacttgtcatggaattgctttgccttttgggaggcgactgaatatcagtatttgagataaggtaaaatggtgctgacatgatatgtatatatcgagattctagcttaatctatagtataaataaatgattagtgccatgtcaaaaaaaaaaaaaaaaaaaaaaaggtaaaaaaaaaattgaaaaataaaatttcaatagt

SEQ ID NO: 59104 - DNA, 385 bp, Triticum aestivum
  Clone ID: PAT_TA_59104
aatagcattcgtgatcttcttgctcgcgtggtcgtggaggaaccaccagaaattccgcagaaagaatctctgatagtttggtgggaagagtgatttctactgaatcacttcaaagttactttttctatacataggctgtacatatatgatgtaactgaaaaacctcaggggagccaattccatgtggctcctgacagtgacacgaacctggtctgtcacagtagcccattgttgccagcttcataagattgacaattatagatcaatcaacaataatgcatcaaggcatgatgtattgttgccagcttcataagattgacaattatagatcaatcaacaataatgcatcaaggcatgatgtaacgagctaataaatcgagaattc

SEQ ID NO: 59105 - DNA, 408 bp, Triticum aestivum
  Clone ID: PAT_TA_59105
gatggcaagagggcgtccggattcaatagcttgtctcagcctgagagaaggaacagcagcaagaagctccagcgccagctttccttgcactattaattttagttgcctaattcgtccatcatccatccatcattttgctgctgaagtgtattaattcttggttctgcttactagattccaccttatgcgctagctgttggcgcaagtacctcaaccacctcaaaatttagtagatttgtaatatcgttttcattagccattagtctctatgttgaaagagtctctgttgaagaaatagctagctaggcctacaacttttcctatgtctttttttggaagtatttgatgtcttgatgttttcttttggaagtatttgatgtcttgatgttggaaaaaaaaagaagaaaa

SEQ ID NO: 59106 - DNA, 376 bp, Triticum aestivum
  unsure (1)..(376): unsure at all n locations
  Clone ID: PAT_TA_59106
acgggaacacagaacgtggatcattgatcatctctgcgcgctcccaagacactaacgggtttggatatgtgaactgagtaggcctctggccttttcgcactaaccaccatgcgggaataagtatggacactcaaggtcgtacgattctccgaaagctcttttgacggcagtggttgagcggcgcgcgcccagttggacgggaactagctgctcttgtattagggggtgggtctgctccaggttgcgtacataatgtgcaggtgtgccaagggcgatgggcccaagacccctgagcgcttaggatgtagatcaacatgctggcctctctgttgagcctaggtangactacggcgtgttgatcagccgaggtcgggca

SEQ ID NO: 59107 - DNA, 412 bp, Triticum aestivum
  unsure (1)..(412): unsure at all n locations
  Clone ID: PAT_TA_59107
tacgttgatcgataaatacagtatactcattaaagaaatttaaaggatgacccggatgcagtacacttttgtgtatgagcgtcgcgaataggcccatcttgccgtcccggcacagagcaggctcgagcttgcttagaggagcaaattaccaacttcttctaccagcctgtcagaagtggtcgtcgcttagttcctatggcagctagtcatgagacgaacaggaagatacaacacgtaggaaatgagcaaacttttgctgggatgttcgtggccccatgtttggcagtcggtagctcagttcagacttcgctcggcccgaaatcatgcaccgacaggaactagttatgcggatagtattgctgaacatgaagctgacggcacctgcanagaatacaaatctatttaaaaacac

SEQ ID NO: 59108 - DNA, 415 bp, Triticum aestivum
  Clone ID: PAT_TA_59108
gatggtgaagatgcgactgagtatgctcataagaaaaattctaacgctatgacggatccaatgcattgcagtgtgccatatgtggaagactcgtggagcttacgttcacgatacaaagacatctaggcacttacaaatttgggaaagattacatcatggtcgacacatcagatcaaaagtcacagacccatatgtctcagagcacatctgctacatatggtggtccagatggggcatgttagatgtcttcaaacattaggaggaatggtggagatggagttacaatagtcggtagtaacagttcagacatcgcacgtggcaaagtcactcacaggatcgcacgtggtattgggataataggtcatgcactgactataacagtgaactgcgatggtaaagttctcatcatgcaaac

SEQ ID NO: 59109 - DNA, 371 bp, Triticum aestivum
  unsure (1)..(371): unsure at all n locations
  Clone ID: PAT_TA_59109
cacggcaggctgtagcagtggggatcgctagtagggatgccacgctgcaagggcaggatcctgggcgtcccctggcgtcgctgccctgacgaccttgctggaagttctgtggcgtcgctgccctgacgacctcggggaaggaagcgacactgctcgcggacggtctccatgttggtcggcaacaatggcgatgacgttggcgaaccgtgattgtacggggtggatggggggtgctggaagcggaacacggtcagtcaagggaaaagggccttgtgtgatggaggcgtgcgggctgtgcgttcccctggtgaacgaatctgtatcgacnccatcgtactgaacgactcatgtggtacaaatataatactggg

SEQ ID NO: 59110 - DNA, 402 bp, Triticum aestivum
  Clone ID: PAT_TA_59110
gtgtggtattactggcacgtctcatcaaagcagagatcatgtccctttatttacaggattttcattaatgcaggcgtagggaacctaaccgtcccctgggtacaactccttggtgataggtaagtttagagacccagggggaaacgcccggtattctgggcctttatatagagatcctagtctcgtcttcttcccttgcgctcgctccttcctcaaccccggccaccccaagttccaaccctcgggtcacaattgccaccagccttagtcatgtccggatccagccgtcagggccggtgggtggcttcttctgtcatggatgaggatattgcgaagctccgcatagcgaggtatctcaccccaaaaatctttcatcagcttccggcacaagggaaagtcata

SEQ ID NO: 59111 - DNA, 364 bp, Triticum aestivum
  Clone ID: PAT_TA_59111
aacacggagctagctccactctgaattacgaaaccatgtgacgtgtgctatggcgctcttgggcctcacatgaatgtgtcttgcagtgcatatgtaatgaatgtgactccaaatttgtacagcaaacggtgctgactactgcacaatgacgtctgatcgtctatgtacaccatgtctgtacaatttacaccgtgattaacagcggtacactctcttttgcacatatccagcagagatcaacgaaacgaaggccggcactgttcaaaatttgtacccacttcgaaaagtatagattgattgtatcacatgaaactgtgaaatctgatatatccattcaccactcagtgtgaagtaaagtatgtcc

SEQ ID NO: 59112 - DNA, 155 bp, Triticum aestivum
  Clone ID: PAT_TA_59112
tcatgagagcgatcggcgtcatgcaggaccttttcctaaccaagacgtggtaacatcgtacggagtaccgcgcgtaatttttagtttgtttcttcttcaggtggtggatgtccatcatgtctatgagcacaggcttctgggttttgacagagtct

SEQ ID NO: 59113 - DNA, 402 bp, Triticum aestivum
  Clone ID: PAT_TA_59113
atggtaatacttcacacattattaatttcttgataataaagtatattaatgtaatgataatttgcataaaaattattcacgcatacttctattttaaaaatattcatgtaattaaaaaatagttcacttttttttaatgaaaaatgatcgtgcaattcaaaataatattcacatattttaaaaaaatcttcttgtaatttacaaagttgatcgtgtatttttttcaaattttcatgtcattttaaaatgtttacttataattccaaaatgttgacgtattttcaaaagtgctaatcattttttacaaaattatactatgttttgaacaattttcacacatcattttaaggtttatgtaactgaggaaacatgaaaattggttatttaatttaatacaacaat

SEQ ID NO: 59114 - DNA, 420 bp, Triticum aestivum
  unsure (1)..(420): unsure at all n locations
  Clone ID: PAT_TA_59114
tacggctgcgagaagacgacagaagtcacgggtgaatcaatgccttgaaatgtatctccggtgtgcagtccatgaaacacccaaacaatggcgcaagtggcttccaacagctaaattttggtatgacaccactcatcactcctccttgaatacttctccattcaaagctctctatggtcaagaaccaaacctcggtggcctgcccaccttatctctgaacctgccagacaacaaggatgcagacttggactgggcaacacacaatgacaggctacgtgctcaacttgcccaggcacaaaacagatgcaaacagaaggctgatcggaacaggacagagcattctttcaatgtcggtgatcaagttntgctcanattacagccctatgctcagtccatcgtggccaatcgcccctgccaaaa

SEQ ID NO: 59115 - DNA, 379 bp, Triticum aestivum
  Clone ID: PAT_TA_59115
gcatctctacaaatcttaactccagaaatattaccattctcctcggcattagctagaagagccgccagcccctctgtacatagcaagaataaatatggagagagaggatctccctgcctcaaacctctagtaggtttaaaactctcagtctcttcagtattaaagcgaacccggtactccaccgaagatacacattgcataattaaatttacccagttctcttggaatcccaatttcaacataatatccttcagaaaagaccactctacccggtcgtacgctttgtgcatatccaatttgatggcacacataccctctttaccattccttttttctttattgtatggaaacactcgtacgccactaaaatgttatctgt

SEQ ID NO: 59116 - DNA, 406 bp, Triticum aestivum
  Clone ID: PAT_TA_59116
ctatgcatatgcatcatgaaaagaatgctttatgtgatggttatatttttgaattccttcatgatgttactgaaaattattatgagagatgaacatatgcttctacatattgcaatattatcaagtttcctctctatgtattgaaaatcttgaagttttgcttattttaccttcctatgctagttgattcttgctctcataaattgtttgttcacaaaatccctatgcataggaagtgggttagacttaaatgtgctagccatatgcttaatgatgctcctgttatgtttcaattcttatcttttatgtgagcatcatcgaaatcatcatgactagctaaaaaggcattaaagaaaagctcttgttgggagacaacccaatatttacccctacttttttaaggttt

SEQ ID NO: 59117 - DNA, 355 bp, Triticum aestivum
  unsure (1)..(355): unsure at all n locations
  Clone ID: PAT_TA_59117
aggtggcacagacatgagtaagcttgagagagtgagaggaattgtgcggtgccactgtgctgtgaggataaggatgtatattaggtggaaaagaaaacaccttcgaattgtagcaagctcgagcttagcccatcttcttgacgtacccataactgtaggtgcttaaagagttttcagcgtgggtggacgcctcaggttgtctacaaaaactaattaggagtactcagtgttttttcgaataaaaacatctgtgttattctcacttttattttaatatattttatatgtttatataaaananaaaaaaaaaggtgagagtttaaaaaaaggaaaaagaaagataggaaaaacaaag

SEQ ID NO: 59118 - DNA, 338 bp, Triticum aestivum
  Clone ID: PAT_TA_59118
gtaacgaaccaccacatgtccattaacgaagtgtgggtcagtgaactcatcatcatggtcgttccttactctgcattcgttaagcatcactccacatgtataacagcagatacactcttcatggtaagacatagagttactgcaggcattcagatcgagatggggtagatcttaagaaagcacttacagaatgtaacacctgacgggagacttagcgaactcgcacatattaatgagctggtacacttcactcagttcaatttgtgcatattcatgcctgatctgatgctcatgtccaacttccacataaatacattctttggcgtcattagctttta

SEQ ID NO: 59119 - DNA, 393 bp, Triticum aestivum
  Clone ID: PAT_TA_59119
cactataatggagaagtttgtgcttattaaggattatattgatgggttgccttttatcattgcacatgataattttgatagatataatatgcatgtgcttgctgctcctacttgcaattattatgagagaggaactacatctccgcctctttatgtttccaacacgataaaattgcaagaatctgcttatactatgcattggcctttactatgtgtgcatgaattgttcttttatgacatgccgatgcataggaatagagttggacttcgttgttgcatgatatatgtcactttgtgctcactactaaattacaaatcattgttaattaaaattggctttgatataccttgggatctcggtggattcgttacgtgagcactaaatgcctagct

SEQ ID NO: 59120 - DNA, 308 bp, Triticum aestivum
  Clone ID: PAT_TA_59120
aggatggatgatgtgcgtactgtcgctcatcggaactatgtgcacgtatagtttatcattcatgatttagattgaaatcctacatgtcccattactcgagtgatgcctttccttaggacgaatggtgcacatggagacatgaaatttcgtgtatatgagattcaaatttctgtttcggacaggcatgggcagctttcctgaaacgattattacagtgcctgaagagtcagttatgagatcaacttatggattgcatacaacagatgacattatttacatgtattcttgcttttatgactagcaacggg

SEQ ID NO: 59121 - DNA, 368 bp, Triticum aestivum
  Clone ID: PAT_TA_59121
gcttcacaggcttggaatataccggttgcgttcatcagtgttattttacttccaattgtggggaatgctgcagaacatgctagtgcggtcatgttcgcaatgaaagataaattagatctttccctgggagttgcaatagggtcatcaacacaaatgtccatgtttgggataccattttgtgtagtgatagggtggatgatgggccagcccatggacttgaactttcatctcttcgagaccgcaagcctcttaatgacggtactggttgtcgcatttttgttgcaggatgggacttcaaattgcttaaaagggttgatgctgtttctatgctatctgatagtcgctgctagtttctatgtacattccga

SEQ ID NO: 59122 - DNA, 405 bp, Triticum aestivum
  Clone ID: PAT_TA_59122
gagcatttgattttgctgatgaacagtaaaatcaaaagaaatagaaataataaacatttcgaaattttttggcacaaaagttgcacaggctttctaggtgtatgcaaaaactggtggcgatatgacatcataggagctcaggaaaaaaaaatagagtattgagaaaggttcatttttttgatttggagcactaattttgttttttctgtcccgagctcctcccatgtcacattgccatgaaactttgcacgcacacagaaaacttgttcatgtttgatgtatagaatttttagattttttgctgttttattttatttttagatatgatcgtgtctagctatggattttcactacaaaaccctagtggataagatttccctattgtatactctaggggcaatgccc

SEQ ID NO: 59123 - DNA, 356 bp, Triticum aestivum
  Clone ID: PAT_TA_59123
caagaggtaatgacaaaaaaaaaaaaaaaaaaaaaaaaaaaaaaaaaaaaaaaaaaaaaaaaaaaaaaaaaaaaaaaaaaaaaaaaaaaattaaaaaaaaaaattaaaaaattaaaaaaaaaaataaaaaaaaaaaaaaaaacgggccgctcaaaaggttcaaagctaacttaaccttgaatgcaacttaaaatctcttcaaaagtgtcaccaaatttaatttaaggggccttcttttaaaaacttcataacgggaaaaaccctgggtttaccaaatttaacccctttaaaaaaaatccccttttcccaatttggcttaaaaccaaaaaggccctaacaatttgcctttccaaaaa

SEQ ID NO: 59124 - DNA, 366 bp, Triticum aestivum
  Clone ID: PAT_TA_59124
atctcctacagtcagggtatcaaagttatttactcaaatggccagctgggcatggtaagacaacagttatgtaatctctgttgccaactggtcaggtatgtgctggtttatgccctgatgcagtatatcactttcccgttcgtggtcagggtacgatgaaattaggcagaatggcaaaatcagcagcatctactgtgaacacaaggcgaagagaaaagggattgcttcctcgtccggtaactcaattgatttgttttgcttcctgtcttttttttctctatacatgcaaattatttgttctgaaacttttccataagaagaggtacactgtgcaacttggttacgatgtcatagaagtaatgtttg

SEQ ID NO: 59125 - DNA, 378 bp, Triticum aestivum
  Clone ID: PAT_TA_59125
gacgctgatctcaatctgcccgtccctccacgggcctgcgccgcctccctcactccccgccgcatcgccggcggcctcagctttgcacgctccgatggtgccgagattggtcacttgctagtgctggcggctcaacctgcggaatcgcggcaccgccatggagactccgctgacggtgcagattgtcgagttcaacaccaaggtgtgcctttctgggctccatttccccccggttcattttgggttttcgtgcagtgctgtgaggctgttgctctacatgctggtgttggtggacctgctttgcaggtgatgcaggaggagctgaagaagctggggctcaaggtcaaccaccatgaggccaacatcacgttcctcaag

SEQ ID NO: 59126 - DNA, 394 bp, Triticum aestivum
  Clone ID: PAT_TA_59126
gactctcaatgttactatgtgtcgtttcctaatgatcagtagggatgcctattcggggttcgattcagggtctagtcgcttgttgggggtcttttccattttggcaccgtagtcgggccatgagtgattgtatgatgaatgttatttatgtactttgatgtgacgtggcgagtgtaagccaactatgctattattcccctttatattatatatgtacttgggttgtgttatgattcccgacttgcgacattgctttcaatgcgcctatgtctctaagtcgtgcctcaacacgtgggagacatagccgcatcgagggcgttacaaccggtgaccccgaaactttcccgttggccaaaacaacacttcctatatattattcttcacctccggacca

SEQ ID NO: 59127 - DNA, 381 bp, Triticum aestivum
  Clone ID: PAT_TA_59127
gagcgggtggtgatcgagcagcaggcgcagttcggcaacaagtgggcgaggatcgccacctacctgccgggcaggacggacaacgacgtcaagaacttctggagcacccgccagaagcggctcgccaggctgctgcgcgcgcctctccgcgcccggcccagcaagaccaggagcagcaacaccaaagcgcccgcatcctctctcgagtccgccatgggttcttgccatgatcatgttccgtccgtgggcaactcctccggcggccaaagcttcccggctgcaccgcccatggagcaccaggacaccgcgcgaatctcgcatgatcagatgtgctctggattcctcagtttcgagccattgccgctgcaggcagcagcaccg

SEQ ID NO: 59128 - DNA, 210 bp, Triticum aestivum
  Clone ID: PAT_TA_59128
attcagcaacacatatacacactgtatggtctctcgggatgatatgtcgccaggtctccacaaagcaaaatattgtaacatgtaccctcacgtatacgagggcacttattcaaacagctactcctatgtaagcacagtataacttgggctctgctcaagtgttgtgatatactattcataaataaataaatatactatacagttgttcag

SEQ ID NO: 59129 - DNA, 257 bp, Triticum aestivum
  Clone ID: PAT_TA_59129
ttgggttcggtcgatgaatactccaccggttcgctctggcatgacaccctcacacatggcaccttgttacatgctcgatacttcaatctctggtgggtgctcaatctgggactgatactcctatcatcgctctcgtcacgataggattcgtgatgaatgtgttcgctccatgtttccagtggatcagtctctatgtactccggcgttactccctcgatctgtattgacgcctctttcactctgtttgcacatatttc

SEQ ID NO: 59130 - DNA, 415 bp, Triticum aestivum
  Clone ID: PAT_TA_59130
ttgtctcctcgagtgttggttggtcacagctttggtggaaaaggtttttcctgttcctttttcatcttcttatctgacatgctatgcacttccataactgtccagctacctaattgtgcttgcagtggctttgagtatggtagatcaagctgcaaaaccacttgcccgtcctgtcagggtaagcttaactaccttttccgtgttatatgagtgtggcaataatggaatgccaactattattaattatattttgagctaaatttcttatgtgtattctgttccttgaaggtatgggttcttgatgctactcctggcaaagttcgttctgggctagatggcgaagatcatcccgttgaacttattgatttcctcagaagaatgcctgtgcaggttggccttttagaactatctatgc

SEQ ID NO: 59131 - DNA, 387 bp, Triticum aestivum
  Clone ID: PAT_TA_59131
cggaaagctgaatgcgtgaggaatcatggatacacagtcgctcatccttggggatgccaacggcatcccattcacagattgtacggatgtcacaatcgtcgaatgctttgggatgccccggttggaaccctaatcgttcttcatcaacatcctatctgtcactatcggttgatcctaagttatgcttcctcagatgatgtttgctattcgtagctctcattttatggtgctttgcatgctgtttgtataggataccaaaactctgaaattattaaatgttagcgaatcttcacatatatgcatagctatgcgataactcattgatcttcacctatctccttctgagtactctgtcatttgctcgattgccccatttagatcttttac

SEQ ID NO: 59132 - DNA, 390 bp, Triticum aestivum
  Clone ID: PAT_TA_59132
aacgcaatattaccacaaattctccggttgtggtaacataccgcacatattgcaataacttagtttcgttgcaataaatactaactttgttgcaatacaggcctcatattgcaacaagctgtatcggcatagcaatatggtaccagtattgcgacaaacaaattccgttgtgcgagggccgtcatttcgttgtaatagagactaggtatttcaacagaataactattcgtggcaatattcagaaagatattgcaacatcgatgtgatgttgcattagttacaaatattgttgcaaaaaagtggctaactatagcaacaaaatgcataggcgttgcaatatgatagcgatattgcaaccaacaaattccattgcgcgaagcatccgttttg

SEQ ID NO: 59133 - DNA, 273 bp, Triticum aestivum
  Clone ID: PAT_TA_59133
tacggctgcgagaagacgacagactacggcagcgacgccgccgttctttggggcagctcagccaccctccatcagagcggcatcttagacgaagaaccaacctcgctaccagtaaacagactgcatctggaactctggaaagtatgagcgacatcctggcctccgagggaagccgccgccgtcaccggcccggtcgcggtagaccgtaatatactgaataaaccaagtccggctacctgtacaaaagtcaaataaattcaattcaatgaaaat

SEQ ID NO: 59134 - DNA, 422 bp, Triticum aestivum
  unsure (1)..(422): unsure at all n locations
  Clone ID: PAT_TA_59134
gagtctcaagtcgatacctatgtgcgtgtttttccacggaaattttcaaaactcaaagtagtacatttttgtttgccaagttttagaaagtgggtagaccgaaatcagggatcactctactacttcctctgttcacttttataaggccttgtagacatttcagacagcatgcaaagcaggtcagttgtttgaaacgaattataaaagtgaacgtagggagcggtgactgtacatctctcagtggttggaaacatggaagagcggtacgggcaagctttaaccataagtagcccacactgaggcctgatttcccagcacaaaagttgctcgcaacagagaactgggcggtatccanagacggagcacatgatgaagagtgaacaaaactggcagcggagagtgggaggagaggagaggagagg

SEQ ID NO: 59135 - DNA, 387 bp, Triticum aestivum
  Clone ID: PAT_TA_59135
tcaaccaactgatgttgtaaaagcaaaagagggatgtttttgatatttgaaggatagaatctggaaacatatacagggctggatggaaaagtgtctatcggctggtgggagggaagttttgattaaatcagtcgcacagtctattccaacttattccatggcatgttttaagttgccccgtggactatgtgagcacatcaatgggctactacggaaattttggtggggtagcaagggaggtcagaggaagccggcgtgggtatcatggagaactatgtgcaaacctaaacatatgggaggcatggggttccgagatattgaactttttaaccttgctttactggcaaggcaagtatggagattgctccaagagccggataccctatg

SEQ ID NO: 59136 - DNA, 271 bp, Triticum aestivum
  Clone ID: PAT_TA_59136
ggattaatcaaataatatcatttctaacagttggtctgaaagttactcttcatagcaagtgccagaatttttttccttttctgttcccaccgggtgtgaaactatcttgtagctgtagatatattgattatggaaggctgaagttcgcaattgatgcaagaaaaaaacaaaaaaaaaaaaaaaaaaaaaaaaaaaaaaaaaaaaaaaaaaaaaaaaaaaaagaaacacaaaaagaataagctaaaagattaactctaaggtaatcaaaaat

SEQ ID NO: 59137 - DNA, 429 bp, Triticum aestivum
  Clone ID: PAT_TA_59137
cggggctcctaaggtcggggaaggctctgattaccaacttgtaacgccctcgatgcggctatagctcccatgtgtcgaggcacgacttagaggcataaccgcattgaaagcaatgtcgcaagttaggcaatcttcacaacatcccatgtaatatagataataaaaggggagatacatagttggcttacactcgccacgtcaatcaaagtacataaatagcattacaacattcaaacactcatggcccgactatggcgccaaaatgaaagataaacccaacatgcgacacggtcccgatcaccccaactgggcaccactactgatcatcagggaaagacacatagtaacggcgtgagtcctcctcgaacttccacttgagctcaagggcgtcatctggaacggaatcatcaggccctgcatctggtttgg

SEQ ID NO: 59138 - DNA, 407 bp, Triticum aestivum
  Clone ID: PAT_TA_59138
tgcgaccaatagtgatggtattgaactacggtcacatctatttaggaatgatgtaagatatttactatttgtcctcagtgcatattttgcatacataatttttttgctaaactttcattgctaagtgtattaattaagtactatacggtgttcttcaacaggactgccgatgacagttgtgcctcaggggatcgagactaaaggtcagatgtcaattgttagcttacggccaagatatcctgcattgcacatgaatgcattcaggatttctagaagcgatgaatgcttaatagtgaaagattggaggaaaattgttaatgatcgcagagaagtactacggggcagcaatgagaagcgcaacccacgattaggagacaggttcatctgcatgccccagtatgatcaat

SEQ ID NO: 59139 - DNA, 357 bp, Triticum aestivum
  Clone ID: PAT_TA_59139
ggtcagaagacaactaaagagggacaactcaaaggaacatacggttttctgagttgtggatgcataagttagtatgtcgaacaagttcaacatatttcttccagataacccatgctaaagaggaaggactggcagattcacaatatagaatggagaactcatcgagagcacttttgttgtgatctttcggctcaaaagaacttctgccaagaatggttcatggtatttggcagaatgaaataccacggacctcgaggactatcgcaacagttactaataacctaaaggaactagcagatactaccatcaagaagtacgtagagtgaatctcgggttcaaaaaccaatgagtagaata

SEQ ID NO: 59140 - DNA, 387 bp, Triticum aestivum
  Clone ID: PAT_TA_59140
atatactgtatagctttggatccaaagagagccagaaactggatgcctcctagctgctacagtgatgttacctacatgctatctggagtgtaattcacagatatactgtatagctttgtccgactagaagctgaagtgtaatgttaagtatcgaatgactgaattagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaagggggcccccaaagggtttaaaccttaatttcccttgaagggaaatttaaaccccctcaaaagggcccccaaaattcaattcaagg

SEQ ID NO: 59141 - DNA, 390 bp, Triticum aestivum
  Clone ID: PAT_TA_59141
gcataatattgatcatataatctaatcatagcatgaatattaagacacgagtgattcaaagaaatagtctataatttgacataaagacattaatactcaggcatcccaacaaacaatcctgcctttcaaaatatcaatgctaaagatcgttatccatacaaaatcgtatagttgtaacacccggataattaagctactgtaatcccctgttaatgatgccaggtcatcgcttttactgttgctagaaatcacgttcattcaatatcagttcaaattcaaatttaaaaacaaagtaaaaatttatagttttcaaaatgtcgaaactaaaaaatgcaaaccatgacaaataatccagaggtaataatggtgaagaaaccagattttttaata

SEQ ID NO: 59142 - DNA, 396 bp, Triticum aestivum
  Clone ID: PAT_TA_59142
ttagactaaatgtttgaatgcaatagcaatgcaaagatgagctatttgttgaaatatggctgccagccggctaggccgacatatatgaatcgacgcgttgggcgccctgccgattcaaatctaaaacatgagccggatcgctcgagtgatttttcgaagaggaaaagcgccggatcgctcgccacggtgagcaaaggatggacgcgaaatgaatagagctggcttcaggcacacggcgtttctgcatggatgcatgttccccatgccgggccggctccccaccatgcgggcatgggctggtgcaagtctgatacgtgcccaggcagtctgccagcgcgtgtgagttgtgaccatcctcacttatcgaattaagatttttctgaccctaaaaaaaga

SEQ ID NO: 59143 - DNA, 400 bp, Triticum aestivum
  Clone ID: PAT_TA_59143
ggtctgagacatggtgacagagtcacacacacaatttatgtgataacttgggcacataagtccaggaaaatttccactgatgagtgcaaagaaagaaccgctaggatgcgtgctaaaaaagattgctttgtgaaagcgtgttcttctagttttcatgataataatgatgaagatctaaaagtgattgatgtggctcctattaaacctttgttttccaatatgaatcttgataaatatgggactggcgattagtcaactttagttaaaaggcgtccaatgattcggagtttttagatcttgatgcaaaaattaataaaagtgggattgaagaggtcaaaactttacatagcaatgaacccactattttggatttcaaggaatttaattatgataattgctc

SEQ ID NO: 59144 - DNA, 418 bp, Triticum aestivum
  Clone ID: PAT_TA_59144
accgattacaaatctcggtaagaccaaaattattgcaacaggaaccagagagtttgcaagcccatctccgtgagactgagatcccattggtgagatcaaactgattagggtttctggtagtggctatgtcaagtgaactcggtggctccggatagatcaaattggtagggctgagtttgacatttggtttgggacatatgtggatatgagaaagtggtttagggctttggagcatatcactaagcactttgagcaagcaagccattaagaaacacctcatccctttttaatagtattgactttcctaaggactcaatgtgatcttgaatcactaaaatgaaaacgtagagtcttgagcttttgagcttttgccaatcctttgttcttagcatcttgtaagggttccacatcctcttgt

SEQ ID NO: 59145 - DNA, 405 bp, Triticum aestivum
  Clone ID: PAT_TA_59145
ttgctcaagcactctgacaaggagagccttgcgagaaagaacaaatcaggattcaatgccctgcacatcactgcaaaggaaggccacggagaccctacttgtgccattgtgtgttcctccacttctggcctcctccattaccagtgactaacactacaataaatatgcaaataattagttttgctacactatagtagcaacaatccttgcgtgacaattattgtaccgattacatcatagcaaatcatagcaaagggacaatatgaggggccttcaaactgcagtttgagagacaatctgtttgtcctatggaggtgctcaatggacttaacatcagaatagcctggctttcagaagaaaagatgacagctttattttgttgttgtagtgtgcctattcggaaac

SEQ ID NO: 59146 - DNA, 359 bp, Triticum aestivum
  Clone ID: PAT_TA_59146
ctaaaaaaaaaagagaaaaaataaaaaaaaaaaaataaaaaaaaaaaaaaaaaaaaataaattcagaaaaaaataaaaatacagaagaagaaaaaatttaaaaaaagaaataaatgagaaaaaataaaaaaatataaataaaaaaaataggggccccccagaggtttaaattttattttgtctttcttgcaactttaagacccttaatcgttttccctaaaatataatccttggggtgtttttttaaaacttctaaaggggaaaacccctggttttacccaatttaaccccttttgaaaaaaccccgttttcactaatgtggttttgtctgaatgggcccacattttacccccttccaa

SEQ ID NO: 59147 - DNA, 408 bp, Triticum aestivum
  Clone ID: PAT_TA_59147
aaggcctatgttggatgatattatctcacctgaacaaagtgcctttgtttctggaagaatgataacgaacaatgcactaattgcttttgagtgcattcattatatcaagcaagaaaaagatccaacaaaaagcttatgtgcatacaaactagacctgtcaaaagcatatgatcgggtagactagaacttcttgaggcaagtgatgcaaaagctggggttttgatcatcgatggattgactggattatgacttgtgtcacatcggtgagatgttcggtaagatttaatggaaccctcttggattcatttgcaccgtcgtgtggcctacggcaaggtgatccactctcccctttcgtgtttctgtttgttgctgacgggctttctcaatcctacgacaacgtgtggatgt

SEQ ID NO: 59148 - DNA, 335 bp, Triticum aestivum
  Clone ID: PAT_TA_59148
tgacggagattaccccatcatcatgctcgctacacgtggcattgaccgtctcgacacagcactcctcctgcgcacgcggattgccgtctcgatccacatgcgacagtgttgctccgaggcattcaccatgttggccgcctcttctcagcacgtgaccaaccatacactcttcttacacatgcacggagtgcttgcccatgtacacgtcatcgtcatcccaggttacgtgtccaaaatcctgctgatcatcaagaaggactgcattgcacttcagctgctgaccgttttcctccatggcacaaggatcgcggtaacacaacagggatagacgtcaa

SEQ ID NO: 59149 - DNA, 381 bp, Triticum aestivum
  Clone ID: PAT_TA_59149
gcttcgtaaacggtgccctgttttgtagcgactgactacaatggtaggttgcgtacgtccttaatacatcactactaggtgcttatgttacttcgttctgtccggttattagcactcatgtttactttcgcactgagaactgaaaaactgaatgtaaatttagtatggatgccgtgtatgtggaccttgtgttgtaattccgtttaaagcaaaaaaaaaaaaaaaaaaaaaaaaaaaaaaaaaaaaaaaaaaaaaaaaaaaaaaaaaaaaaaaaaggaaaaaaagaaaaaaaaataaccaacacataaaggggtctcccaataggttcaaagctttagtccacggacgggcaacttcataccgctgctaggatgtaaccaa

SEQ ID NO: 59150 - DNA, 416 bp, Triticum aestivum
  Clone ID: PAT_TA_59150
ccatgccaagtttcatgattttctggtgagttttggatttgcggatatttccaaatcgagattgcaatgtttcgagccaggacgccgagacggttgaattcatcctcattccttccgtgggacctaaacatgcatcccaaggacacatgtacatttttctagccattttggtgcactaaagcatgtatttgtagtttgtatttgaattatggacattcctataaaactcggctaatgaaacaataaggtcaaatgaaccctgaataatttcaaagttcagcgtgaatctcctgttgctccatgttacgtgtagaagaaaatacaaggctaaaagagggagcgattatcctttcacccacaaggggacacgtttccctatcgaaaccacgacggttcttgtgacaaggctccggttt

SEQ ID NO: 59151 - DNA, 415 bp, Triticum aestivum
  Clone ID: PAT_TA_59151
ttctgttatgtgcttttataaagtttagaaataaaagtaatgtgccaaggtttgcctttaggatgtttacgatgcttgttggtttgtgtggtgcaggacagaaactttggctgtagtgcgcgattttacatgttttactggaatgtcaaacggttctgattctttttgcactgtctttccatacaaattgtttatttttccaaattttggcagaattttcaagtaacataagtatggttaatgttcagattgttacagactgttctgttttagacagattctgttattgatgcatagtttgcttgttttgatgaaactatcaatttatatcagtgtattaagccatgaaaaatttatactacagtagacatgatgcaaaaacaaaatatgaattggtttgcaacagtacttagag

SEQ ID NO: 59152 - DNA, 424 bp, Triticum aestivum
  unsure (1)..(424): unsure at all n locations
  Clone ID: PAT_TA_59152
gagcacaagaaggcggaggagcacaagaagaaggacggggagcacaagaaggacggcgagcacaaggagggcatgatggagaagatcaaggacaagatcagcggcgacggccacggcgacggcaagaaggacggcgaccacaaggagaagaaggacaagaagaagaagaaggacaagaagcacggcgagggccacaaggacgacgacggccacggcagcagcagcagcgacagcgacagcgactgagccagctccggccgcgctccggcagcagcgtgcagtgtaggcgagatcgatgaacgcttgggagaagtgtggcatacatatatgttgcagggtttggagcgtgtggtagcatatgtatgtaatgcgtgacatgtctcatggatcntgtgatgtataataattagccggctgcactgca

SEQ ID NO: 59153 - DNA, 408 bp, Triticum aestivum
  Clone ID: PAT_TA_59153
gtataagccatggaaaagttataatacagtagctacagtgcaaaaacagaatatgaatgggtttgcaacaatacttagagtagtgatttgcattattatactaacggatcttaccgtgctttctgttgagttttgtgtggatgaagtgatcaaggatcgaggaggtctcgatatgaggagaaggaggagaggcaagagctcaagcttggggatgcccaaggcaccccaagtaaatattcaaggagactcaagcgtctaagcttggggatgccgcggaaggcatcccatctttcgtcaagaagtatcgatatgttttcgtcttcgtttcgttcatgtgatatgtgtaaatcttggagcatcttttgtgcttaattttcatttttcctttatgcaacatgatggtatgag

SEQ ID NO: 59154 - DNA, 409 bp, Triticum aestivum
  Clone ID: PAT_TA_59154
ggggaggtcatatgtacaataattgtgcccaaggaggacgcgaaggaaagggctgaacagttttcgaagccagcactaaccttagaagaattgacaagttggtcaaaagataaacttgctccatacaagattccgacgagattgcacgtatgggactctcttcctcggaatgccatgggaaaggttaacaagaaggagcttaagaaattattagaggtgtagccatatttacattgatgtacctatttttcaatcgcacccttctgcgaggcagacatatagtggtgtcagctaataattttgttctgttcgacaataatgataatttagagcaactatagtaaatgtgcaagtaaataatgcacactatcctatgatatcttaaaagcgagaatgtgaaataactaga

SEQ ID NO: 59155 - DNA, 381 bp, Triticum aestivum
  unsure (1)..(381): unsure at all n locations
  Clone ID: PAT_TA_59155
tgggcacacaaatgaggggtcatgtttaaagctatataatttagttgctaaccccttcatatctttccaggatttacggtcttttgatctttcctccatagccgctataatctctggcctgtgcttttctcttagctcttgcaatcccatttctttgactgactgaaaacccatacaagctgtcaatacaagttggctgctgtcaaaggtagagccagcaagagactgcagtaacgtaattgcatctccagcatcctttgtggtcaccaaggcangccctaaaagttaacataaaagatatagtgttgggtagacatcaaagtttagtcaaatgaacaaacaataggacatagtaacattttcagattaatccaaaaacag

SEQ ID NO: 59156 - DNA, 412 bp, Triticum aestivum
  Clone ID: PAT_TA_59156
ctcttattaaggattatgttgatgggttgcattttaccgttgcacatgatgattttgatgaatgtaatatgcatgttcttgctgctcctacttgcaattattatgagagaggaactacatctccacctctctatgtttccaacacgatgaaattgcaagaaactgcttatgctatgtactggccattacttgatgcgcacgaattgttcttgtatgacatgctgatgcataggaagagagttagacttcgtcattgcttgatatatgttgctttgtgctcactactaaatgccaaatcattgttaattaaaattggctttgatataccttgggatccgggtggatccattacttgagcattttatgcctagcttaatggctttaaagaagtgctgccaagggagacaacccg

SEQ ID NO: 59157 - DNA, 424 bp, Triticum aestivum
  Clone ID: PAT_TA_59157
ggcaaggacgccgaggaggttctccagccggacgagggcaagggcccgatctccctcatgttcccaatcttcagcgcggcaaccatcgaccagatcttcaccacctcagatacactgtctcttccccatgggcccgctcatgcatggtgaagaccccctgctccgaggtggtgccgtggtcaagaggagaagcacagaatatggatggaggatggggaatacatgcagaaggcggaagctccatgctcagctcagctctcaactacactgctctaagactacttggtgagaatgtcgatgatgagcaagatatgtccgtgccaaaaacaaggaaatggatacatgaccatggtggtgcaatgatgataaaactggaagcaagatgcttggattttttgacaggtcaggtgtaaaccctaccccc

SEQ ID NO: 59158 - DNA, 377 bp, Triticum aestivum
  Clone ID: PAT_TA_59158
actgttcagtttttgacagattctgttttcattgtgttgattgcttattttgatgaatctatggctactgaaatagtttatgatccatagataagttggaatacaataggtttaataccaatacaaataaataatgagttcattacagtaccttgaagtggtcttttcttttcttccgctaatggagcttacgagttttctgttgagttttgtgttgtggagttttcaagttttgggtaaagattctatggactatggaatgaggagtggaaaagagcctaatcttggggatacccaatgcaccccaaggtaatattcaaggacaaccaagagcctaatcttggggatgccccggaaggcatcccctccttcgtcct

SEQ ID NO: 59159 - DNA, 400 bp, Triticum aestivum
  Clone ID: PAT_TA_59159
gcaataagcacataacacaagcgaagaaaaagtgaagactttctatcaacaactattataatgatgcctttgatgtagaatatcactgcagttacatttgaacaaatgaaatccctttttaacagatgagttttcgtccgaaaccctgatacttccaaagagattgtctgttttgtatccagtttttgtcataaccctttcaactttttagcacatgctatatgggttaaatgatgataccatgccaactttcaaccttttcagagttcatttgtattgcttttcaattaaagggtcattgagctcaaataatgaactaataccaaaaagaatgaactaatagcaaaaagaatgaagtgaaagccaaaagaatgaactaatagcaaaaacaaagaactaa

SEQ ID NO: 59160 - DNA, 416 bp, Triticum aestivum
  Clone ID: PAT_TA_59160
cgttgccaacttgattgagctcttgttgatcatctcattgtcattggcctctatcatcaccaaagctcttacttcttcttgtttttgcttttccctcttcctcttctttggtgcctcatgtgcagccctacatcgagccttttgttctggtgtggcttgcatacaactttttattgcccctttgataccagctatgtgttgcttcatcctagtcaccccacctgacatctcctttccacaaagaatgcacttgaatctttgcagatcatctggatcaatcagcacaacaaattcccaagccatgtcatctgattttctcttaagtttggaacttgcaacctctgaagtaccagaatcaggcatctacaaaaatcacaagggcaatagcatgtattatagtattagtattagacgtt

SEQ ID NO: 59161 - DNA, 369 bp, Triticum aestivum
  Clone ID: PAT_TA_59161
gctgcggcggcggcgacgatgacgacgacaagatcgacatcgtcacggggctgcggcggcgacgacgacgacggcatcctcacggtgatgcggcggcggcgatgatgacgacatcaacaccatcaaacacgggcttgtggaggcgccggcgatgatgacctatacgtgtggtgtatattgtatatatatatataaatatgtatgtattaattatctatagtagatgtgtatgattgactgtatgcataaaatgtgcgtattataaaatgcatgtatgtgagtactatgaaatgtatgtctacactggaataggtagatttttatattttttaaatctgaacaatcgggatactaagggctaagcacaaa

SEQ ID NO: 59162 - DNA, 386 bp, Triticum aestivum
  Clone ID: PAT_TA_59162
tatgtgaacaataaggtcgtccaggctctacatgttttgcatctgtagtcctcgtagacgcgggcgacatctaacttgatcttggattttgcgtattgcttcaatacagttccggtacacaaaaatacgtgatcaataaagccctcctggctctacatgttacatatgtatggcgaatctcccgtatgacacattagcacaggcccacgtcagcctgagacccatatgtcagtgggagcgagaaataagataatgataagcaaaaatgggtgacgcaaagtttcgaacccacaatccccagccaaaatttgcgtgagcaagccaccacactatgggccaaattcgggtaaaatcaggatgaacattcctgtatataaataacgctg

SEQ ID NO: 59163 - DNA, 378 bp, Triticum aestivum
  Clone ID: PAT_TA_59163
gtgtgtaaggggctgagaaatcatgtgtggaccccaaagtatcaagatatgtatcaaggccagtgttcctgaaatcagtgccattgtcacttctaaggtgctttatcttggcgccatagttgttcattgctcgattggcgaagcgtctgaagacatcctacacttcagtcttgtagaggattatgtgcactcaagtatatctagaataatcatcaacaataacaaagccatagaggcaagcagtagtagtaagagttgagtaatgagtgggaccgaaaagatccatgtggagcagttcgaagggtcgagtggttgtcatgattgtcttcgagggatgtttggccctcgtcatcttccctgcttcacaggcaccgcata

SEQ ID NO: 59164 - DNA, 218 bp, Triticum aestivum
  Clone ID: PAT_TA_59164
ggctggcagactcacggcgcctgcccaggttgcgctgtgaacactgacaaggggctaatcagacagaatgtcgtggccatgattatttctcaccaccattgttgcggtggcagccacaatgcaagctgagaccgctctgactacggaggagagctcattgaagactgcgaccccatcaggatacgtgttgacgccaccgtagcagctacacgtgttgt

SEQ ID NO: 59165 - DNA, 415 bp, Triticum aestivum
  Clone ID: PAT_TA_59165
gaacagcagcttgacgtgcgcggcggtggggtccatcccggaggcgcagctgaactacccggcgatactggtgccactctccaagaagccgttcaaggcaaagcggacggtgacaaacgtagggccggcgaagtcgatgtacactgctcacctggacgtgcccaattggctcaaggtgaaggtgcagccagaggcgctggagttcacgtcggcgatggagaagaagacattcacggtgaccgtgagcagcaggggaggtgacgccgacgccaacgccgggcagctggtcgaggggagcctacgctgggtgtctgaagatcacgtggtgcggagcccgatcatcgccgacgccagggttgtcccgacatgattctgtcaggcgctccctggacatgcttctctcgcaagccgcatc

SEQ ID NO: 59166 - DNA, 376 bp, Triticum aestivum
  Clone ID: PAT_TA_59166
aacgctaaactccgaaaaggtgcactgccggagtgtgtgtccgaggtaacactggtcttcttcttcttcttccctcacacggtcccagcggcaggagcaagtgccctatcggtggcagctgctgcacctgcttgcaggtacaattggtcctcgcaaatcatcggatctttcttatcggacgggatggtgatgatcatcacaggtcgtggcatcttcagggtagttgtaagcgtagtgtgacgccgccatgaacttgaccaacgctacgcagcgatcgatgtcgttgtagggcaaagcgatcctggaaacatcgtacacgattctcttcgtcctgtagtttagatcgctttcaaaagtcatgggtagcgtaaccttt

SEQ ID NO: 59167 - DNA, 427 bp, Triticum aestivum
  Clone ID: PAT_TA_59167
ggggaagatgggagctctccaatatctgaacttggctgacaataagcttgaagcgaacgacaacaaggggtgggaattcatcacttctttggccaactgcagccaactgcagaaattgatactcagcaacaattcttttggaggacaactaccaggttcaattgtaaacctctcgacaactctccaacagttatacttagatgacactaggatctctgggagtatacccgcagatattggcaatctggttggtctcaacgtggtgttaatagcaaatacttccatatcaggagtgattccggatagcattggtaagctagagaacttgattgagctgggcttgtacaataatacgttgtctggcctcgtaccgtcatctctgggaaaatcttcacaattgaataagttttatgcatacaacaacaac

SEQ ID NO: 59168 - DNA, 423 bp, Triticum aestivum
  unsure (1)..(423): unsure at all n locations
  Clone ID: PAT_TA_59168
ccatcattcgctttgaagcatccgccgccgaccatgagagctcctctcttcctcatgttcgcttgggggatcgtaggccacaaagttgggcatctagcttgtgggagagagacgcatccatgacagcttctacaaaggtgggagaagcgaggattctagaggagggatctaatgaagaagagagataggagcagagaccactgcaccttatagcactggtgacggcgatagcttgcaacatcaatggccacaactttgcgagttgtgggggagcaaccgagaggggttcgatgttcgatttggacagtcgcagtcggatcagagagcggcggaaggaaggggagcgagcgagcagaagcaaaagaggcnganggggagatggggttcatggcgccggttaaggctggcctccttcttcgcggg

SEQ ID NO: 59169 - DNA, 387 bp, Triticum aestivum
  Clone ID: PAT_TA_59169
gataggcactcctggcacacacgctcggcaaaatgaggtcgtgtgcgacgggcgagcgatcaaatatggttagacatacaattgtgctaaaaaatacaattatacatgccaaatcgtttctggtcgtaagtacatcccacatactcagtcccggctaaacgtttcttttagtatgtacattccacacagtcagtccaaggaatacgttttcgttagtatgtacatcccttacagttaatccaagaagtacgtttctgttcgtatatacatcccacacagtcactccaaggaaaacgttcgttcgcaagtacatcacacacaattttccccattaaattgtttgtgatagcattgccattgcacatgatattaacaattttatccttt

SEQ ID NO: 59170 - DNA, 357 bp, Triticum aestivum
  Clone ID: PAT_TA_59170
gaggttgacacgctgaatggccggacactgacctggctaaatcctcgcgggcacatcttcaccagggagtcctgcttccacctgtctggggatcccacgaggaaattgaacccgacgcactaccggcatccaacgttttacaccaaggtgtttaacgaatgccactcctatgaccaagatgggaattcctttgagctctccctggtaacatccaagtgcattggaccctatcttacaagcacgaagatccctaactagatattttcgctataggagaacgtcacgtgcacataacacaaatgccttcacacattcctgtacaatgtccactacaagtccactggaatcctaccttat

SEQ ID NO: 59171 - DNA, 388 bp, Triticum aestivum
  Clone ID: PAT_TA_59171
gggttggcaccggcctcccgtggcccactgttgatgatggcgtccgctgttggaggatgtaggtaggatcccccttagcatcagcttttgtttcctgcgaagaatcatgaatcaccccgtgggggcatgtaaggatctgcaatgcctttgtaccaattttccttgttgtgaaaatttgatgaacgcgcgtcacgctaaggcgcagcctcccctttctttcctcacgatagctttttgctctacgatgacgggtcccgatcccaaggcggctacagccgtcgcgggtatgccaggtcgcgatatcatggtcaaggccaggaggtgcgcggcccgaggtccaataagagaccctgaagcacgatgctcaagagggtccccttagcgccca

SEQ ID NO: 59172 - DNA, 397 bp, Triticum aestivum
  Clone ID: PAT_TA_59172
gctaaccagagagttggtcaggtaaactcagtgggaccgattcgctcatctcagtgagaccgaagtgttacaaaagggaaacagagagtttacattgcaatctcgatgggaccgatcgctcatctcggtaagaccgaaacgttatgaagggaaacagagagattacaatcccatctcggcgagaccgagatccctatcggtgagaccgatttgcctaaggtttgtggcagtggctatgacatttgaaacttggtggcgccggatagaaagaatcggtggggccaagtttgagttttggtttaagtcatatgtgggtgtggaaaggtagttgagggttttggagcatatcactaagcattttgagcaagcaagccattaagcagcaactcatccctcc

SEQ ID NO: 59173 - DNA, 326 bp, Triticum aestivum
  Clone ID: PAT_TA_59173
ctaccgtcatgctaagcacatgagatgtaaaacatgataaacatcacatgcaatcaaatagtgacatgatatggccaatatcattttgctcctttgatctccatcttcggggcgctatgatcatcctcgtcaccggcatgacaccatgatgtccatcatcgtgtcttcatgaagttgtcacaccaatgaatacctctacgtacatggctaacgtgtttagcaataaagtatagtaatttacatggcgttattcgatgacacgcaggtcatacacgaattaacacaattcctatggctcctgcctgttgtcatactcatcgacatgc

SEQ ID NO: 59174 - DNA, 419 bp, Triticum aestivum
  Clone ID: PAT_TA_59174
acacctagccggaaggtctatcattgtagtatcttgactgagcaatttgaccatcttctccatgaggattttgagtgacttattctagaagttgttccttatggatcccttgtattccgaagcccgacctttacttgatggctatgttgacgcttttaagcatgatcgcggtatctagtacatcaaggagaacattagaagtggagtgctaagtgtctctcggtcgatcatccagatttttttccttggcctcgctaaggtgaaatctgagaaagtgttgtcttcctttgcggctgcatcctccatcgttattcatcattgtagtatctatttgtatcaacattcttggcttagatgttggcaaaccttgatgaatatggagttcctcaagttcttgagagcacacgcatgcactaagt

SEQ ID NO: 59175 - DNA, 370 bp, Triticum aestivum
  unsure (1)..(370): unsure at all n locations
  Clone ID: PAT_TA_59175
ttatcaaaaccatccgaagcagttgagtggtgggcagtaccacgtatttaccactagtttatgtaaacgtgaccagaaggttcataagagagctgtcaattctgttgagtcggcgattcctcattatttgaggtggtcagaacagcccatcatatggagcaaagaggatcaccctccacgggtcgataatgcgggtcagttagccttggtggtagcaccccaggttggtggatataaatccactaaggtgctcatggacggcggtagcagcatcaacatcctctactatcaaacttttcagcgtatggggttaactgataaaaatctgaggacatccaacacagttttcaatggagtggtcnctggtaag

SEQ ID NO: 59176 - DNA, 283 bp, Triticum aestivum
  Clone ID: PAT_TA_59176
aggattggttgccactaattttggagcggatgtggctgtttcactgtgttttttttttcttttcttttagttggcgttggctgaaggacgacagagtttcgtccgcccacctaaattgcttagcgtacaacgtgaggggtacttttatgtattcacggttagatcccattgagtaggcttatcttgaccctccaaaaaaaaaaaaaaaaaaaaaaaaaaaaaaaaaaaaaaaaaaaaaaaaaaaaaaaaaaaaaaaaaaaaaaaacaaaaaaaaaaaagcaaa

SEQ ID NO: 59177 - DNA, 417 bp, Triticum aestivum
  Clone ID: PAT_TA_59177
atcgcttagcaagtgggccaaacatatgatgaatataatacctaaaatgcacaactttgatgtgccacacatgcctcaaacaccgtaaacccatgtactcacatagagcaaggttacatatgatggtccccttccccctcctcgacgcatactatatgctcctaccataatacaacccaaaaagaatcttcatcgatggtgaaattaattaacctctcctgatgtaggtcaaagtgatgcacatgcatcaacgatggcctcttgggcccacagatggaagtgtcacacgtgaatgtcctagctaggataaccaccgcctgcatgcaagtggcgcaaagaggtgttgtgtgatgtttgaatagccattttcacaattttgatgtggcacgtgcctcggaaaccgaaaagtcccgacac

SEQ ID NO: 59178 - DNA, 391 bp, Triticum aestivum
  Clone ID: PAT_TA_59178
aggcaattaatgtaatatcttgtgagggaatggagaggatggagaggccagagacctacaagcagtggcaggtgcggaatcagagagctgggttcaagcagctcccgctggaccaggaaatcatgaagcgtgcacgggagaaagtgaagtgctaccacaagaatttcatcatcgacgaggacaacgggtggttactacaaggatggaaggggcgtatcctgtacgcgctctcaacatggaaggcgaacccccaattctagcttctgtaaatggtgacctgttcatatttttggactctagagctgattggtcctggccaacaacccattagtagatgatgaacctgattactctcctgtagcatctgcctgttgtatgtgctgcccatgca

SEQ ID NO: 59179 - DNA, 411 bp, Triticum aestivum
  unsure (1)..(411): unsure at all n locations
  Clone ID: PAT_TA_59179
aacatctactcccactgaaagcgcatcgccggaaattctgaaataaatccaggcataatgcgagcgccaggatttgaatcctggtgggttggggataccactgtccacctaaccaactcaaccacaggttgattcgccaaaactttttcttttgcggggtatagcttcatagcttaggttccgtatattggattgcgtgtcgcacgtggcgtacgtatggtacggacgtatttaaccaggatctaatcgacctttactttccctataaaaaatggcctttactgtaagggaaggagaacatacaccatgcatcaggcatgaacattgcaaagcaaaacgttcaagtgccatgcgcgcagaagctttgttctanggcatgacatatcacgcctatttcctcttctccgcatg

SEQ ID NO: 59180 - DNA, 387 bp, Triticum aestivum
  Clone ID: PAT_TA_59180
agctagcagtggcgctagggtggtggtggcggagaggtgtcaccgtcggggggatctcgggtctcctggagtgaacaacgaacaaatagtcgtgttctggactgaattaggacttccaaggctgttttttccctgcagaacaaggaacagaagttaacatctgacgattttatattggctttgccaagtgaacaatcaatcaggcgacagactctacaaatattccgtgggttcatcaggcaaagttcagaaatttcagagaaacgacttcagattcagactcagagttgaatgtaggctggagattcaggatcatagccagatagcctccacagcaatcaatcccggcatcgcaagcttcggcaaagatagtatggcatttcagac

SEQ ID NO: 59181 - DNA, 388 bp, Triticum aestivum
  Clone ID: PAT_TA_59181
agtgtccgacgtacaaccggacacattgatgggtcttctagagcaagcggctatctcagaggcacatcgtaccttaatgggtacggtggttgagaggatttcatccgcaaaaagcgggttgaatgaagcttttacgagcctgctaagaggctttgaggtacgcaaagtaatatatatatatatatatttgactgtaccgcatacgcaaggtgtgctctgtatagatagtatcccctgagactctggttgccgtccaaacatggcgaacaaaggatcatagtctcacgtaatgataccgttgttttcgtgcgcaggcagctgcaaatccggcgactgaccgaactgccgaatttgctgaattgaggcggcaacttgacatggcggacgc

SEQ ID NO: 59182 - DNA, 402 bp, Triticum aestivum
  Clone ID: PAT_TA_59182
gcatgtcagacgtttatttcaactagataatacaccgcacgttgttgcgggaattggttgctatatacgtagagatgatacttttggttcaaattattttagtgggcattttttgtatgaaacattagtatttagactaacaatatgtgaattgaaactaacatatagtattatattcgcttattctgtagtatgcatggtgcattttaatgtgggtcttttctcatgaatgcatagtggcacgatgtggcatatttgcatgttaagagaattaaagatagtggggatcaattacttaggtcatgcttggtggcatgatgagctgacatagttgcatgttgagggaattagagttagtgaggatcaactatttaggtttataaaatgggtgtttcctgaaaa

SEQ ID NO: 59183 - DNA, 377 bp, Triticum aestivum
  Clone ID: PAT_TA_59183
agatgcgccatgctttcaggaatggagggagtaagtttcattactgttgaattggattgtatcgagtgaaattcagagatccatgccaaaagtaaggaacctatgagaaagaagtcatccaaaggtttaccagtcagcaccatggatgttgggctagccagcctgggtttgatcatcagctctatcttaatttgattgatacctaggtcctccaacgcatcactctttttttcattgtaaacgtatgagtgatgaataatagtgcctatttgttcatcgcttactatgcctgtgttaaataagtggcgggttggctactgcattttatgattattgtagttatccacatgaaagtgtctgtgcttttaattataatt

SEQ ID NO: 59184 - DNA, 392 bp, Triticum aestivum
  Clone ID: PAT_TA_59184
gatggacatagagcttatcacacccgatcatcacttggtgtctgggcacgacgaactttggcaacggtgcatactcggggagaacaattttatcttgaaatttagtgagagatcatcttataatgctaccgtcaatcaaaagcaaaataagatgcacgtacgctactgtgaggtgttgtccttctcttcccgccctcctctttggtgtcctgcttaattcccctacacgtatgctactctaccccaacacgttggacgacaagggcatctccaccatatgatccatccatcctccgtgcatgttgcctgcgccatgcatgcgttgagctacgacgaactacccttctctacgtacccttctgtatgtgtatgtgtgtaacagtatggttgtg

SEQ ID NO: 59185 - DNA, 408 bp, Triticum aestivum
  Clone ID: PAT_TA_59185
ggagctatatttttattcaccaacatgatatgtgttttgcttggagcgtcttgtattatttgtgtctttgtgtttttgtgtgccacaatcatccttattgtacacaccttttgagagagccatacatgaattaaaatttgatagaatactctatgtgcttcacttatatcttttgagctatgtaattttgctctatgtgcttcacttatatcttttgagctacgtagtttttctctatgtgcttcacttatatcttttgagcgttataattttgctctatgtgcttcacttagatattttagagcacggtggtggatttgttttaaataaactattgatctctcatgcttcacttaaattattttgagagtctcttaatagcatggtaatttgcttaataataatatg

SEQ ID NO: 59186 - DNA, 359 bp, Triticum aestivum
  Clone ID: PAT_TA_59186
tctgttcaacaccattgttccgataacaacgtgctcccgttggtgttggcaggcttcttactttaacaattccctataatcggaaaaacaggatcatcatgcaacacatgagttagtcttaaaggtgagatcaggaacctattttgtgtttatcattccacacatgcaatatgggtttccctctgaatctcattgatatctcactaatatgtagactaaagaaccattgcaattgtaggacagaaaataaatattaatcacaacatggaaataaataataacatttaccattgctgttagggcatatttaaaatataataaatcaacaatgttgatgagatgggagagcttaaatacag

SEQ ID NO: 59187 - DNA, 393 bp, Triticum aestivum
  Clone ID: PAT_TA_59187
gcgactcatgacaagctcgagtggctgctcgctctcgcctccatgaggaaggaggcaggagcgctggataatcaaatttgatgcggcgctgcatgattttaccagcatcaattgtttttcagttccagaacgctgttgacttaaacatggtttccctcttttgcgaatgagtatgagcatgatttctaagtggccgtaacatcgctagcctagatatccctgctctggatttgtatgaataccccagtgtcagtgtggttgtaatttgggggtttgtagctggtcggttattctgtctgttggtatattggaattagactttaaacctgtgatgatactgaagaactgcaacgatgtgtggaagtcatgttgttcgattgttcattaaatata

SEQ ID NO: 59188 - DNA, 332 bp, Triticum aestivum
  Clone ID: PAT_TA_59188
cggctggaggctgcggcggacggcgagggagttgcgtatgagtttgggctctcaattggagcggaggaaggcggccggcgagggagctgcgggcggatgccggagctgcagcagtggggtggagcctggcggaggggaggagcgatggaggaagacgaagatccccggcgacaagaatttcaaattgagggtagtttggtactttttcctgttttcacctggtcggagaagttccccaacgacaactattttggaacagagggagtatatgtttctatagagtacttcgtttttgtactatacgcttgacaaaatgatttccttataagctg

SEQ ID NO: 59189 - DNA, 302 bp, Triticum aestivum
  Clone ID: PAT_TA_59189
agctgcagcaaggataacgactgcgatgtcatggcttaggaggtgagtgttggcataagtcatgccatgtgcgatggcgaccggcgtcgggtgtgccagatcgtgttcatgtatgcgtgggagaggcagcccgagtcgtgtgtgctgtacgtccgggtataaaaagccctcccatgtaccgatcgaagtgatgcgatatgtgttgagccagagagagatgtagccttttggagtgtaaaaaaaaaaaaaaaaaaaaaaaaaaaaaaaagaacaaaagcacgaaaggataaaaacaaaaagcg

SEQ ID NO: 59190 - DNA, 330 bp, Triticum aestivum
  Clone ID: PAT_TA_59190
gcaaaagacaaatagaagcagacgttggtgtctgtatgtcggatgcgccatcaactgctggatttgtactgcgtacctcaaacctcatatccgggttgttgcttggatgtggatgtttggtggaatttgtgacccttaacagccgtttgcggtccggcttgctaacaccaatttcaggtacctgactggtcaaactaacaggttggccaaggtaaaaattctttgcatttgtgtggtgccccagagagtgtcatatatcagtacaatagtgtacatttgcaaaatctctctgttttcgtgctaactcggaaaaatttctctctttgaaaa

SEQ ID NO: 59191 - DNA, 215 bp, Triticum aestivum
  Clone ID: PAT_TA_59191
cgagcaagtcaattgccacataagagatatccgcatgctgggcgggaagggccagttccgtcggcaatgtattcaaggtgacgcatctctcctgcatcaccaacgtcgactccgttcactcgatctcagtaattgtcattacgttgtcaaatctgttaatatgcaatgtccgcaccatgtgattgcacacgatctgcaacacaacacctccttgt

SEQ ID NO: 59192 - DNA, 413 bp, Triticum aestivum
  Clone ID: PAT_TA_59192
ggtgttactggagcatggccatctttgaaggtcggatatgccctgctttgctgctctgcttttcctcatatgatcctagtgtggagtgctcggcctttgcaagctgtaatcttaatttcctttgcattagctgcttgtggaggttgtagttagcgtttcagtccagtgtttccattgtatccttctgcccgctgtaatttggttgtttgctgtaactcctggccggttgatggctttgttaattcaaagccgggctcctcgtgagccttcgttctaaaaaaaagaaataagtattcttagtctgtcatactattttatagaaacccccccgatgtttcttatattaaaacccgcagtacataataaatgttttttttaaatactcgttacctctaaaccgtaactataaattt

SEQ ID NO: 59193 - DNA, 410 bp, Triticum aestivum
  Clone ID: PAT_TA_59193
gcatgtagttcaaaatgggtactgatatttagatacaaatggttgaaaaaaaattgcatggagaaggttaccttaaatttacgtcggcaaaaaattcaacctcttctgctttgggcactcaatgcttgttttattgcaaaagaattctttctttcttgcatcaatctgtgttgaagtgaaacactcgctaaagtagaagcctagtctagtcataaagataaggaactactttaaaatgaatcagattgtccacattcaataacaagaatgaatatcttcatttacagtcatattcaacatacccttaagatgactaaaatagacttgttgtaatttacagaaaagaaatacatgagataagtcacctacctcatctatcatttaggagagggttagtatatgaagaaaga

SEQ ID NO: 59194 - DNA, 357 bp, Triticum aestivum
  Clone ID: PAT_TA_59194
ttgggtcatatattcctcaaatatgcccaaatatttccttaaccagttcaaaaataattccccaatattacttcttcacttctctccagaagggcactttgtgaaggaagtatcatttatattattctgtttgctccaaactttttgggaattctcttatgtccaaatgattgccacatgccaaaacgcaacttcattttcctactgaatcttccttagtgatttttcaaagtttcggttcaaatagaagctttgtgaaggaagtactagctaggagtatccaaataagtttaaatttgcatgcctcttcatgtgctccatcccttgatctatgtgagcacatgaccaaatctttga

SEQ ID NO: 59195 - DNA, 335 bp, Triticum aestivum
  Clone ID: PAT_TA_59195
tgtaataaaacgcatgccagcggaagtcgtccgtacatgcgttaatttacgccccttactgtagatgcaaaatccagggtaggtgcgagcataaaatgaagagggtcacatgcgttaatttacgtttagtcctttcagtgtcacgaggcagacaccctcgtcggttcgatctttttcagctccaatcaggccgccacataggaggcgtaggcacgcaccatccgcagcgaccgtcgagcacgagcacatggatgtattattggcagaaccagctgccttggtcgtctcttgacacaactaaccctccgtccacaatatgttttcaagcaactttt

SEQ ID NO: 59196 - DNA, 266 bp, Triticum aestivum
  Clone ID: PAT_TA_59196
tacttcaagccgtggcgtctcagcttgctaaggtggttgtggacttcttccatgggagcaggtgatgtgctcctatagtcctatggtttgcagcgggattggagtggggcgatgctacaagagatatgtttgatacattgtcgttgcctttatctggttcattaccctttatatggatgagggggacatggattgattaccctctaattgtggtttgtgttggactctggttatctcggcgtcgcgtgatgggcgcttgcctgggt

SEQ ID NO: 59197 - DNA, 381 bp, Triticum aestivum
  Clone ID: PAT_TA_59197
aggcacaccacgttgagcgcgttgagctcgatcttgacgtcgtagcagaagcgcgccgccagctcgaaggccttggcgccgcccgggatgtcgtccagctgcagcgtgcacatgccgccgccgtccgacggcggccggtactcgctgatcagacgctgcagcacgccgctccggctcaacagcgggaactgcatgctcataatgacgatcgatgcaccgttagttagtcacattaacgcgcgcaatcgatcggtttgtgcagttcagttggtgaatgcgaaatgtgacggcgacacactcgatcgtgctaaccttgtggagataaaaggacatgtctcctacttccacgacgacatcgctctcgagctcggtcatgcatct

SEQ ID NO: 59198 - DNA, 421 bp, Triticum aestivum
  unsure (1)..(421): unsure at all n locations
  Clone ID: PAT_TA_59198
ccatcagcgtgtgacataaattgctaggtagccgcatagctcgttcgccttgcgtcaatggttgacggatcaaggttccatcagttgaccagccaatcattgacttctagaaataaaatactaaaatctgaaaaacaaaaaatcacgaaaaatggataaatgattttgatttcaaataatttcatggatttgaaaaggaattcaaaaaaaaaaatcatcaatacgaaaaaagctcatggttttggaaaaaagttcatcaaattgaaaaaacacaaaattgaaaaggttcatgtgtttgaaagaagttcatgactttgaaaaatgttcattgatttggcaaaatttcatgagttcaaaanaagttcacttaattttganaataagtttacggatttgaaaaaagttcatcgatttgataaaa

SEQ ID NO: 59199 - DNA, 322 bp, Triticum aestivum
  unsure (1)..(322): unsure at all n locations
  Clone ID: PAT_TA_59199
tatgttgacaatgaaagtatgccgctcanaatattatttatctctgctttaaaaccgagctttggcacctctacaaatccctgcttcnctctgcgaagggcctatctatttactttcatgttgagtcatcaccctcttattaaaagcactagctggagagcgctgctgtcatttgcatccattactattaatttatattgggtatgactatgactggatctcttttaccatgaattacaatgtctagtcagtccttgatctttaaaggtgctctgcatttatgttttgcggtctcagaaagggctancgagataccactttg

SEQ ID NO: 59200 - DNA, 420 bp, Triticum aestivum
  Clone ID: PAT_TA_59200
ccctttgatgtacccgcaataaattagtcgtcgaacgagtgattccgtcccgtgtggctgatgtgatctacaaaatgtgtggcttcttgcagctctggagaccgcttagtaagcggagcgatcaaggcatcatcgacaacatcatgcgggtcttcgtgcctcggctgcgtcttttgctcctcccccgccccctcctgagccagattagcgtctcctagtagtcttatttggggcttgtcttgctgtgccccagcatgattctatgacttattgtacttgtaacttgatgttggatgcttggtgttggatgcttggtggtatgctttataatattaaaccgggggaaacccttttccgtcattttttggggtcaatgtcgagagagtgaagtcatcaccatcgccagagctaaagtcgtgg

SEQ ID NO: 59201 - DNA, 375 bp, Triticum aestivum
  Clone ID: PAT_TA_59201
cgccgtttaggaatcgcgcgcataggcgtacggaattcgagtagatgcacgcagctaacgatccgatctggcccgacccatttaaacagccagtcgctctcggttttaggtttgggacttttctaaaatttcctgaacaagtttttctgctttacttctttattgttttttatttccttttttcctttttcttttccgtttcattttttcttttttctttttctgtttcttttctgctttattttttattatttatttatttattaacatttcgtcttccttttcttttttatttctcaagtccatttattttcaaacttgaacaaaaatttcaatttttctttggaattccaaatatgttctcgtcctcaaaat

SEQ ID NO: 59202 - DNA, 413 bp, Triticum aestivum
  Clone ID: PAT_TA_59202
gaatagatcatcacttgaacataagtaatcatatgacaaaatctatatatgctgctgctatgagaataatcatgatgccttcatgtccgtattttatttttatcgacgcctctacctctaaacatgaagacatattttttgttatcggcttttcgcttgaggacaagcgaggtctaagcttgggggagttgatacgtccattttgcatcatgcttttatatcgacatttattgcattatgggctgttatttcacggtatgtcacaatacttatggctattctctcttattttacaagatttacataaggagggagaatgccggcagctggagttctaggctggaaaaggagcaaatattagagacctattctgcgcaactccaaaagtcctgaaactccacggaatatcaaaa

SEQ ID NO: 59203 - DNA, 455 bp, Triticum aestivum
  Clone ID: PAT_TA_59203
gttgtgactgactttccgtcccctggatggatagtatgttcttatatccaatcattgcatgaaagttgcatgatctttgatttcagaattatttatttcatcttctttatagaatgttcagttctgaacttgtgaactttccttacgtaagcgtgcgtgtgcaactcaattgtaatcttaggaattttcttgttcattctagttagcaatcatatatgaacgaagttatgaataagatgtgcacacaacttgaacatgcggcttttcgttattacaattgtgatcgacccctctgtctattattgagatggcccgataagatcaccaactgtagatgtcaagacttaatacccacaataagcgctgctagtgaaaaagatgcccataccagtacaacatagatcgaagctcttcaacaaacataactcgataatttcattaacattggcttacat

SEQ ID NO: 59204 - DNA, 327 bp, Triticum aestivum
  Clone ID: PAT_TA_59204
gacaccccggaggtgcaggggctaggccggctcctccttcatgcggtgactgatctagacgccgcggttgtgccgggtgaggccggctcctcaatcacaagacggattgaaaacttcaattgtgctttccaaaatgaatttaccccaaatttaccccaaaaattaccttaaataattttccacaatttttttccgtcacaaaagttaactcaacctttgtgcctaagttaatgaattggtggtgggtataataccattatatttacacaaaatatgtccccatatatagtataaaaccttctcttatatatctcaaacttatcacga

SEQ ID NO: 59205 - DNA, 440 bp, Triticum aestivum
  Clone ID: PAT_TA_59205
agcggcatactgtgacttcaggtacactgtgacggtcccctcgggagaattctgaaatgtgcgcacgggatccacactgcctgcatcacacctcgtatgcgcgtggagcccccaggccaggtgtgcaaaacgccagccgcctagggtaggacatgagccagccatgcctatgttcgtccacattgatccaaccatggaatggatttacacgggctctcactcaaatcccaggtgcatgacagctagcgaaatagctagctacgatcaattgatccatgcgttagatacacgcgtgatcacacagttgcgcagtgccatgatcatgtccggccacaatcaggccacatattatgcaacctgctagatacctacggcattgacctcacatacagctcgaggagcactctgtatcacatataccagatacactcatacatgca

SEQ ID NO: 59206 - DNA, 453 bp, Triticum aestivum
  Clone ID: PAT_TA_59206
gtgaaaggagaagttcctcgacctggaatatgatgttcaaggctcggtcaagtttggtgatggttcaaatgtggaaatttgcgggcaaggttctgtcctcttcgagggtctcataggagaacatcgcatactcaccggagtatactacatcccaaggcttcgcaacaacatcatctctgtcgggaaacctgacgagaatggatgcaaggtggatattgagaacggagtgatgacgatcttcgacaacctctcaaacgtgctagcccgtgtaaatcgcacacggaacaagctctatatcctcaaccttgatcaatcccaaccggagtgcgagctcgccaagagtgatgatgattcgtggttatggcaatgctagatttggacacgtcaacttctacaccttgaataagatgtcgaagatggagatggtatctgggatgccgtttattcaccatg

SEQ ID NO: 59207 - DNA, 460 bp, Triticum aestivum
  Clone ID: PAT_TA_59207
gaattttgctgtgttctcatccaacattatttttatttacatgatggcaagcaagcaataattttgttgtataagtcaatcatatgatacttcacaattgctaatacaaaaggttaggatggacatacagcacaagatagcctttcttgctcgtttctcaaaagacatgtttccgttggccaagagtttaacctgggtttgccgtttcatgctcaagaataaggataccacaaaggaatccggtcatataaaagcatatagtaaaaagaagtgtacaagtataatagcgatagcagagaggaatgtgttcctttatttataaacaataaggcgaattatagctatgactgaacttggcgtaagatctgttttagcttgatggctctatgcaaagctccctagtgagcaaccgcggcctttaaccaatcaagaagttcgccattgtcaactctactttttt

SEQ ID NO: 59208 - DNA, 455 bp, Triticum aestivum
  Clone ID: PAT_TA_59208
agaattgttgatcatgagatgacactcaaggataagaagagctccacaacaattcaagtggttcttacaaagcttcatgtgatgctcctacagcatcaagtgagaattaagtctcgaatgaagaattgagcttaatgtgaagaacttcaacaagttctacaagaatagaagcaaagagagaagttgcaagtcaaggtcctaaaatgacaaaagatcttctagtcgtgatcgtaattgctacaattgtggaagacccggacactactccaatgagtgtacgactccctacaagaaaatataagattcaccaaaaaggaggagtagaagagatgaatcacctccaagagagaggagtagagatgatggttatgagcgaataccctctcatagaagcaaggattcagaaaggaaggacaagtcatcaaagagctacacaaggcgaagactgcaagctc

SEQ ID NO: 59209 - DNA, 450 bp, Triticum aestivum
  Clone ID: PAT_TA_59209
atatatttaaaaataataatttagtactccctctgtcctaaaataagtgactcaactttatattaattttatgagaaaaaatcaccatatattagaaaaggttgagtatgtattatgaaaatgttcatcacataataaaagagctcaccgtatataaaacgatcagtaaatataaagaatatgtatattaataatatattcggccggtgttcggaaaatattgatcgcatatttaaaattgtacttaataaactatatgaatgaaaaagtgcaaagtaaaaaccaaaaagacaaacaatgtgaaacccagacatgaaagaaagagaaaaacccactaacactgtgtattaaaaaaggcaaaagaaaaaataaaagggaaaataaagaaataaaataagacataaatagaaatctacacataaacataaaaccggaactaaattggaacag

SEQ ID NO: 59210 - DNA, 409 bp, Triticum aestivum
  Clone ID: PAT_TA_59210
aggaagaaacggcgccgtccgttcccctgccatgcctgcacccagcggggccctcaccaggcctccacttcgccggaccaccgtatcctgccgggcaaagggtagcccggccgtggcgtactgcacgctaccggttctgcagctactctattatgtcagaacacttgagagggatgaaagtgaaacagcagcaccagcagcagcgaagatactgctgctccctcctcactcgtaccctgctcccgctggtcctactcctcaccggagccaaccgcaaacagggcagattgtgatcatttctgaactagcaagatacagcacagcgcagcattctgtctatatatccctccctgcttccctgtctgaacttttgtttgaaacagagttcctgaacttcctaattaacatg

SEQ ID NO: 59211 - DNA, 378 bp, Triticum aestivum
  Clone ID: PAT_TA_59211
ggcggcaaaactccgaggctggagactcgaggagaacgaataagaagaaatcacgggaacaaaaaggagacgacccttcagtcttatttataaggcaacagagttatatcaaacgcacggatgcaagagctgcagttaaaagaaggtgtgatatatgaaaaatgtcataaggacgtcatgcaggttctacaacaaccacaagtgatgacatcatgacagttgaccaagtaccagcacatgtcgatgatacaagattttgtgacagattgacatgaaccatttcagatcacactggggcctaaagttggggatactaccactatgtgtaagccggcatacttgggccgggttaacttcattagtaggacaagcagatga

SEQ ID NO: 59212 - DNA, 370 bp, Triticum aestivum
  Clone ID: PAT_TA_59212
cagcccatccatcatgctacgtgcacctagacaaaggcacaagggccacaaaagttggtttttacttcatggagcaagagaagcaatgtgatgggcctaaggatttttttgatacgctagtagtacaactatgggctgatccatatgtttggcctctgtacgccaaggcgttcgagagatcaacagataaggcagcgtccatacttaataaatagttatttagattagagtttagactcgggttttattgtactccctccgtccggaaatacttgtcatcaaaatggataccaggagatgtatctagacctactttagttttagatacatccctttttagcaaggtttgatgacaggtacttccggacgg

SEQ ID NO: 59213 - DNA, 384 bp, Triticum aestivum
  Clone ID: PAT_TA_59213
tacatgtaaactattgactcacataccttcaaatggtgtgtcttatcttcatatagatgaattaatttagcccatatataatatccacctaataatcagatatttggataataataataaacagctggttaccagcagctcttgccatgatacttaaggcacaaacagtttctacaacttccaatgttatcactatgcataatattttgttgacagaaaattcactcccctgcagattggctgcaaacaacaaaaatatgctgacaagttggccaacttaccaatgcatcagttttcgtacttgtcttgaaatctgctaggctttgtagtctggctagtattcctgaacgtttgccagtcttcaaatttgcacggacctttcat

SEQ ID NO: 59214 - DNA, 397 bp, Triticum aestivum
  Clone ID: PAT_TA_59214
acgacacagtcataatttcagtttccctagttttccatgtcaagctggcgcgctaagccattatgcattgaattccgatgaccatcgcgctaccttccccctataagtactgtttcccagccttctccagtgccaccgtgacccaactcgccatatcctcataagcccccaccggctcgatgtcgctcgccacgtacgccatgcccccgcccgtccacagtaggcgacgccaaaggcggtcactgccggaactagtgtttggtttttcactggaaggcagacggagggaggaggcattctatctgtctttagatggcaatgcgtagaccgaggagttgttggagcgcgaccgcatggcggaggagcaggagttgttggagcgcgaccgcctggcgga

SEQ ID NO: 59215 - DNA, 334 bp, Triticum aestivum
  Clone ID: PAT_TA_59215
gaaatcgacgacttcgactccggcgccactgtctatggcgacaaacgacagagcattaagtctgccctcatcagatgttccagcgtagtacacacatctgccgttcaggacgatgtcggtgacactactaaagtggacagtggtacatcatatcatgaatacacaatgggaaaacaagcacgatacctgcgtaatgactaatgttgtctacgtgtcgcacacttcatgcataccagatcggaggatttctggactgatgtatgctgtcatgtctgttttgctgatgcatctacttccttagcacatctgtgaaatcttgtcttgctcgatggca

SEQ ID NO: 59216 - DNA, 455 bp, Triticum aestivum
  Clone ID: PAT_TA_59216
gaataaggagaggcaagatcctaagcttggggattcccaaggcaccacaatgtaaatccaaggacaaccaaaagcctaagcttgggtatgcccgggaaggcatcccctctttcgtcttcgtctatcggtaactttacttgaggctatatttttattcaccacatgatatgtgttttgcttggagcgtcttgtatgatttgagtatttgctttttagtttaccacgatcatccttgctgtacacacattttgggggagacacgcatgagtcggaatttatttgaatactctatgtgcttcacttatatcttttgagctagacaatattgctctagtgcttcacttatatctttttagagcatggtggtggttttattttataaaaattatttatctctcatgcttcacttatattactttgagagtcttttagaacatcatggtaatttgctttgg

SEQ ID NO: 59217 - DNA, 470 bp, Triticum aestivum
  Clone ID: PAT_TA_59217
tactttggatagattaacacatacgagtatctcacatggttacatatatgcatatactccctgcgtccgaaaaaggaaaaatctacgtaggattattgattactgatataagccagcctcttctaaaaatgtaatacatatttaattgggcgtggctatatgtcaatcacgtgaaaataaatttagggtcagtcactttttcttttagggcaagcaggcacgaaggaacgctagccatatgtaagtagtattagcgtaaagtggcagtgctagctaattcacgtgtgcacgtctattttccctttgtgtgcgcgcgagtgtgtctgcgcgtgcacgctgccacatgtgcatgtgctcgcatgcgtgttactccatctatttctaaatatttgttttcctagagatttcaacaagtgactacatacagaacaaaatgagtgaatcatactttaaaatatgtctatatatat

SEQ ID NO: 59218 - DNA, 431 bp, Triticum aestivum
  Clone ID: PAT_TA_59218
taagaaaatagttcagagccacatgcaaactttcaaaattattgggcttatatctattttatagtaaatataaacccaattcaaatagctagtgaattaattcaaaggcccaagaataattatttctgtgattccaaaaatattggtttgagttttagctcttgccaatattttcagagattagcaggaacattttgttggggtcatttgaaaatattttaatgttgatcatttttaaaagatttctgaggcttgagaattccctcaattcaatttccttgaatttaagatgatgcatggatgcatatgcaatgacaagcaaaggccaaagctagggctgtgacagccatgctggagtccggaccgcttccggagcctgctctcaacgccctggcctctctagacgccagctgcccgcggcatgcatgcat

SEQ ID NO: 59219 - DNA, 325 bp, Triticum aestivum
  Clone ID: PAT_TA_59219
cacaggcacgagccttcaccatggaaaagactgagacgggagacgtgtaggtgcccatacacttctcaatgtcccatcaccaggctcggaactgggactgctgtccattcaagaaatcagtgcgtccagctcctaacagtctggcatcttcgtgatgctacattacatgtagcaatgtcaatttatatagttatgcagacgattcgttatgataaatcccccgcgagaccaaaatgcgatacggacacgcgagatgatacgcgcttacatgatcgatcatacaacatgcagtctctgcaatacatgtcattctggtgtccgttac

SEQ ID NO: 59220 - DNA, 421 bp, Triticum aestivum
  Clone ID: PAT_TA_59220
agcagcggtcaggaccacgggcatggctgggtagtgacatgtgcgtaagcaatgtcgagcgtggcggatgacgccaagatgagattctccatatcgttatttcctctctctctctctctaccaatccttcttgcttcccctctgtctctctcaatgccactatatgcaggttctgacatgtgcttttgtttgatcccggcttgattttttctttggtaagattcaatgatggttgatgcaagcccatgcttctcacaagttggattgaagtttgtcgttcctctatttgtactattgtttccttaccaagtactatcagtactggggtagaaaacacttacctattacatagttctttgctgacagccgaatgtgatgtttgaacggtttcccctatatgcaggaagtacaatttgcatgt

SEQ ID NO: 59221 - DNA, 189 bp, Triticum aestivum
  Clone ID: PAT_TA_59221
cgggtcgacgggtaccgctaaaataagtcgaccgatgtcgactggtacggctgctataatacgacagaagtcgacaggggagttcatggccggctgattccatcctactactgtacctactatacctgtagttcaccagcactgctgctacttcagtagtcatccttgaacactattggtctcaatatt

SEQ ID NO: 59222 - DNA, 423 bp, Triticum aestivum
  Clone ID: PAT_TA_59222
agaaagtatgcaatagattgaataaatagatagcaaataaaataaagtgcagcaaagtatttttggtttaatagatctgaaaataaatacaagaaaaagtagatcgcaaaggcaaatatatgagaaagagacccgggcgccataggtttcactagtggcttctctcgagaaaaatagcaaacggtgggtgaacatcaaatactcatgacgatatccaggcaatgatcatataggcatcacgtccaagattagtagaccgactccttcctgcatctactactattactccacacatcgactgctatccagcatgcatctaatgcaataagttcaaggaaaaattggagtattgcattaggaacgatgacatgatgtaaacaagatctatctatgtagagatggaccccatcgttttatccttag

SEQ ID NO: 59223 - DNA, 433 bp, Triticum aestivum
  unsure (1)..(433): unsure at all n locations
  Clone ID: PAT_TA_59223
tacagctacgacaagacgacagaagttgacgggtccaacgctaaactttaaaacagacactatttgcttgtgcaccggtccggaacagtccgcggacaatgatacagaaatcggcaatccaaccctgtctttaaacgtttgtccttattttctcttaaatacacaacattcaacataatcatagaaaatggcataattcatacataaataacatgcaaatatccataagggcatctccaacgtaggcctcaaaacgaacaatatacttgcccgtggactggtctggattgattcatggacattggtacgggagccgtccatccgaccatgtcccctagatgtctgcttctgtttctttttttaagttttcgagctcaaaataatagcatagcaaatctgcgatcagagagnatattcagatgggacaattttt

SEQ ID NO: 59224 - DNA, 345 bp, Triticum aestivum
  Clone ID: PAT_TA_59224
taaaacaattccttcacataccggacacgttctctctcgatagccatatactacctcggagatggtgtagtttacaagcgacctctagtcagtcttctgcgacacatgcgcaacatttcaccacaccctacaaggaccatacgactatactgtgccaggtcccgagtatttccagcatcatgtgatttttgtttgattttaacggctggatccggcatgccgccaaggtacattcacctccctggggtggggcatgcccctccttgggttgcactaggcctactcatagctcaaatacatcatatatgatttgacaaacgacctctggacatcatttcaggtggc

SEQ ID NO: 59225 - DNA, 416 bp, Triticum aestivum
  Clone ID: PAT_TA_59225
ctagactacggtgttgaggaaggtggtgcctgtcttgtcgaagatgagagagggtgcatgtgtcataaccttttggtttggataatttatcatttttcttataaaattccctctcattattgaactacaattagttacatcatctatctagtaagagacgaatgagttcaacaggaagttagtacaatatgggcccttggacattaatttgcgctagctcatgggcaacctcatttgattctctaaagtaatgcacacaattagtactaggaaagtcacaagctagatggtagcaatcagccacaaccgcagttgcaggttccattgatctccctctttctttttttttgcgggaccattgatctccctccatcattcattgagtttactagttcaaattatccgaatttaccaaa

SEQ ID NO: 59226 - DNA, 363 bp, Triticum aestivum
  unsure (1)..(363): unsure at all n locations
  Clone ID: PAT_TA_59226
gcggactcctcccccgaagacgaggaggaggaagaagactctctcccggaggagggagagaggaagaggaaggcttccccaatangggaggctgaagggtccaagagggggagaactattcccccggacagctctgccaacaccaatgttggcgaggaggagtgcccttcaagggccaggcctcctgcgagatcgtaagtatccggatccctgtatattctaaaatttctttcgtgccacatagtgcctttctaatgccgcatagtatccgcagtccggccgatgatgatctccccgctttttcgagcgggtcgttggccccgtcggatgtggattcacttccgacggcctctactccccgcg

SEQ ID NO: 59227 - DNA, 383 bp, Triticum aestivum
  Clone ID: PAT_TA_59227
ggaaagcgacgagcatagtgcgccgtgcactgtatcgctggccagaccatgcccgtgctctctacggcgagctccggcgtcggtgagcgccagggggaagttaagggggtggagacgacgatggtggcgaagcatggcatgcttgggccggttgggtaaccagcacgcgctcaacagagcactacgcggcacacagagcgcgtgttttgcatgccagcacaccgggacgaacgtggtcaccgcgtgaaccgtgacatcaggccaccctaagcgctaacctttatgtctggcgtgtagtccttagtagtttgaagtgttaccatggtttggcttggatccaggtgcagttgaaatagatttgtactgctggcaagtttctgggc

SEQ ID NO: 59228 - DNA, 418 bp, Triticum aestivum
  Clone ID: PAT_TA_59228
cacgggtggcaagtaacgaaaccagatagcgtatgtgaaattaattgaagcgggaccaaacaaagcggacgaaaccaagaacatcacctccctttaatagtaggtatagatataggtttagagagatgacaggaattgctcatccacatggttagtcgtaaaatcctacataaaacttgtagatcactgaatatgatatgtttgattccttgcaatagatttgcgatataaaggtggtgatattagagtcatgctagtgagtgactatggattagtagaaatacttgtgttgaggtttgtgattcccgaaccatgcacgtatggtgaaccgttatgtgatgaagtcggagcatgacttattttttgattttcatcctttgtgtggaggtcgggattgtgcgatggttaactcctacca

SEQ ID NO: 59229 - DNA, 427 bp, Triticum aestivum
  Clone ID: PAT_TA_59229
gacttcctttctcaccacagaattactgacaagtgacagcagatggcacgataaaagactggtgattattatccatttcgtagggctagtacgagggaatgggagatcccgtcgtgtttagctctcactgtgctgccctcgacatatcttgtttttggagatctcccttgtcatttataccttagatcaattttgtttggtgaattgagatgttgcttgttcgagtaaatacgatgacacacttctgacacttccatcttacaatgggaattgagctgttgcttgtacaactttgttccatggaacaaatgtaactgtgttccatgttacaatgggagttgagctgttgcttgcaaaaaacattaactccacaatgagaacaacactcttaattaacaaaaaaagctacaaaatattccccaatacc

SEQ ID NO: 59230 - DNA, 224 bp, Triticum aestivum
  Clone ID: PAT_TA_59230
aggaggaagacgaccgaaggaggagaatgaaaaagacctaagttgtacctatttataagggagtgcatgaacaagcgggcgcgagaatcaaggagacccgaacaatgattatccaaataaatggatgccttgattctcggaaggcattaaaaaatgaaagatccattggaagatgatgtcatgaaagttttttgtgttttcagaagatgatgtcacggcgggcc

SEQ ID NO: 59231 - DNA, 422 bp, Triticum aestivum
  unsure (1)..(422): unsure at all n locations
  Clone ID: PAT_TA_59231
gctggtgatcaccgggtgggcgccgcagctggagatcctagcgcacagcgccacggcggcgttcatgagccactgtggctggaactcgaccatggagagcatgagccacggcaagccgattctggcatggcccatgcactgcgaccagccgtgggacgcggagcttgtctgcaactacctcaaggccggcgtcctcgtgcggccatgggagaagcacggcgaggtggtcacggcgaaggccatacaggaagtcatcgaggaggccatgctctccgacaaaggaatggccatgcggcaacgggcaagtgcgctcggggaggccgtccgcgcctccgtggttgacggcggttcgtcgcgcaaggacctagatgatttcactgcttacatcacaaggtgatcgacanaatgccatcctggacgat

SEQ ID NO: 59232 - DNA, 422 bp, Triticum aestivum
  Clone ID: PAT_TA_59232
ttcgagtctcttatgatactcccacatattctgatatgaagaagacattttgcgttaatatgtgagcagttagtggactttttcaatgccaggaagttcaggatacgaatggcttaagggctggttaaaatgatgagttcactcaggacgctactgaagattactatgaaggaggaacatatgcttgtaagaattgcactaatgtcaagtttccgctctatgtgcttaacgttttgacgttatgcatgtgttcccttcctatgctacttgatttttgttcccctaagttgtttgctcacaaaatcactattcatatgaagtgggttaggcttaaatgtgctactaatatgcttcatgatgctctcattctgtctcaattcgtatcgtttatgcgagcatcattgaaatcatcatgccttagc

SEQ ID NO: 59233 - DNA, 422 bp, Triticum aestivum
  Clone ID: PAT_TA_59233
tgccaacacaaatggctcaatggtcattgccactcacaggcgtcacctgcttgatggtcgaagacgagggaagggcgacaacatctaaaactccgcgttccacgacgccgagaggtaggctctctgacgcatgacaaggctccacgggggcttggtgatgccaggtccacctccgaatcctgaagagaccccaacttgagctgctccatcgatagaggtgaaacagataccacaatacatgcacacacccaaggcagaatacatgagctgaagattagcaacaacgcccgatacaagtccaagcaaagcacctcgctcgtcaccttctatatacataaatattatagaggttgtaatacagagaatctgaaatagctcttcacaccaaaaccttttaaaatagttttgttacctttttttgc

SEQ ID NO: 59234 - DNA, 388 bp, Triticum aestivum
  Clone ID: PAT_TA_59234
ggtatgagatagtccttggttgatttatataatgctctttgcacttcactttatcttgtgagtatggctttatagaatgcttcatgtacttcacttatatcatttgaagtttggaattgcctgtttctcttcacttacacaaccgccatttgtagaatgctctttttattcgcttatatttgttacagcatggacatatcttttgtagagagaattatactctcttgcttcacttatatctatttagagagacgacaggaactagccattcatatggttagtcatataatcctacatacaacttgtagatcattgaatatgatatgtctgattccttgcaatagttttgcgatataaagatggtgctactagagtcatgctactcggt

SEQ ID NO: 59235 - DNA, 399 bp, Triticum aestivum
  unsure (1)..(399): unsure at all n locations
  Clone ID: PAT_TA_59235
catatgcatgaggcaacagctgatgccgccgcgtcctgtatctgccagcccttcgtaggtcctgggcggtataagtacatttatatagcacctaggtagtaaaacagatggtctagccgatgtctacttctagtcctatctcaaatattttcttttctctcctctccatctgtttctcttttctgagatgagaaaataaaaaccttcagcagtgctaggccggcccaactctccttgtctctctctctctctccctagtttttcctccagcccagctgggcctaccagggcctgccggcccatcccctaaccaaggcccgcctaaacccttctaaacctagctgcacaggagccatcgctccatcncctcacagccactcgatcccaactctttgccgc

SEQ ID NO: 59236 - DNA, 294 bp, Triticum aestivum
  Clone ID: PAT_TA_59236
acgtcagtaattagcacaaggcgagtgatgggcgccggtgcgccggcggaaactttgggccggtcctttttaaaccattagattaatgcgctgatgagcgttagataaccacgccaaagtcatcgtctccacgcacaaattctccctacgcggaaaaagtggatcgtgaacgaagtgcggcccacacgcaccagctgttgtgccaccgggcgtgcgtcgccagctccaacaccatcagcccccatcgtcgccgtcacagacctccggcatcacgggttcgcatcacctcatcgc

SEQ ID NO: 59237 - DNA, 419 bp, Triticum aestivum
  Clone ID: PAT_TA_59237
gtcagttatgtagtgggcatgggcagtgtactgtaggcctgtaggtcttccttggcagtagcactttgcaaaaaggatccttagtcagttgcaacccttaattaagtactccaacttagcataagctctgttcccagtccttaggttagaatcatcaccgagtgttggccaaggacatgtttctttgcttttctttctctttacaagtcattgtcctctgatttactccaactattttcaccaacgcctgctggagatgttggatgatgtagctgacactgctgtgtgttggtgctctattctttgggtagagatgtgttgcctgcctggaggatgcttgaagcagagtatcccggagactagcagatatgatgatcgaaacttttatcttagctttctgtctctactacttcctgatg

SEQ ID NO: 59238 - DNA, 407 bp, Triticum aestivum
  Clone ID: PAT_TA_59238
cacagaggtatcattgatacccgtgaaagatgttcgtacctttacgtcagtaggtgaaacaatatctagccaatattttgatgacttgtactggccattctccatcccaactccttcacctacattatcaaattcatcattgtcgtccctcttattgggtttgtacagcacaccttccatgttcaacctttccattaccatctacaaacacaaatgaaacacgataagtagttgaacaattaaaccatgttcaatacaacttctaaattacctgtgcacatctttggggtatattgagaacctctttgtgaagcagctttatgtatgtcatcacacggtccatactacaagtcatgttcgatgaaaccgtggacgtgcttggctttctactcctgacaccacctttc

SEQ ID NO: 59239 - DNA, 419 bp, Triticum aestivum
  Clone ID: PAT_TA_59239
atgttggaacgttaaatttggagggtttaattgccaatgatgtggtgtctccccaaccatggttgaattggccggttcccatatggatcactccaagttttaataagatccacaaataactaggtttccagtataaggacgttactgggaagggaatgctcttgcttctcatcaataatttactacagaactattctgactggacatatccgttgagctgttgtttttgttagggcaagcaagcagaaagaattaatttatctggtggtcagcctggcgaaggatttgggaaaatgttccctaggggaaggagaaaataatgtttatggtggctgaaatcgaagttgctctgcgaagaagaccagatatcagtgggaatagaatgctcttgcttctcatcaataatttactccagaact

SEQ ID NO: 59240 - DNA, 341 bp, Triticum aestivum
  Clone ID: PAT_TA_59240
gtccacatacatgacatactatgttaccatgatatcataccgtgcacataggtggaaactgacacagcactgaatgttgcctcaggaaattttcaattgcgttgaaacagacaggacagttctcatttttcacgaccacaaaatgaagttttatgtaaatgacctatcaaatacatgttgtaacatagcatcagatcattttcacacactatgaagacatatctaacgcatatatgacaacatggttgggtgttatcgaatatgatccaacgctagatgtaaacagaagattgagtcagttcattaggaatagagacacattttaactacatccgcctcac

SEQ ID NO: 59241 - DNA, 432 bp, Triticum aestivum
  Clone ID: PAT_TA_59241
ggattctcaggtgtttcagcaataggttcactagaagcatgcaaagtcctatcatttttctttttcttctttttagaaggactaggtgcctcaatattatttctctgagaatcttgctcaattctattagggtggccttcaggatacaaatgttcctgagtcattctaccagttctagtagccactctaacagcataatcattattcttactattcaattcattgagcaaatcattctgagctttaagtacttgtcctacttgagtggtaaccatagaagcatgtttagtaatgagtttaagttcacctttaactctagacatataatcacccaagtgttcaatcatataagcattttgttttaattgtctaccaatataagcattgaaatcttcttgcctaaccataaagttatcaaactcatccaaacat

SEQ ID NO: 59242 - DNA, 418 bp, Triticum aestivum
  Clone ID: PAT_TA_59242
atcgacttcgacttcttcgtcggtgctcgaagctcgccgccaacgattcaccgcctcctgcagctactaaactccaccggcatttcttgcgcctcacggtgagctcccggtcggaaaccctctcctctagacttggttcgttgtttcctgctgatactaccatcgccaccgaagctctgtcgtcgtcgtcgagctcgtcaccgtcagtatcgtgtactctagggccaggcaagcacgtcaacgtgctcgtggcgtccctgtggtaccgcctgagccgtttgtttgatcattctccccgcgtatccccgtatccgttgagctcttgctccggccgccgcttgccgtcattgcttcggccaactccggccatctctgctcgtgtcgttgatttcgttcaacgcgcgacgtcccgcccgat

SEQ ID NO: 59243 - DNA, 355 bp, Triticum aestivum
  Clone ID: PAT_TA_59243
tacccaaaaacttgaaaacttcacagaacaaaacttaacagaaaatctcatgagctccgttagtataagaaaacaaaccaccactttaaggtactttaatgaaatcattctttatttgtattggtgttaaacctactgtattccaacttctctatggttcgtaccccccgatactactcatagattcattaaaataagcaaacaacacacgaaaaacagaatctgtcaaaacagaacagtctgtagcaatctgattcatacaaatacttctgtaactccaaaaattctgaaaaacataggacgacctatataatttttttaatgatttactgcagttggaatcagtattttatct

SEQ ID NO: 59244 - DNA, 426 bp, Triticum aestivum
  Clone ID: PAT_TA_59244
acgaggcgcatacggtgactttgtaaatcttaagatgatgtgccagctcagtctctcgaaagtgcttataaaaatagggtgtgtgtgcattcataggggtgaatgtatgtgcgtatgtatgagcgcttgcatctgataaaaacaactactctcacgacaactcatcataatggtcaagggcgagacggtacacgctccgcactaagaaaatcctgcgcggatcggtacgacgtgatgtattacaccactcaccggctaacccggtcagtgataactatcaacatggaataacaattgaagttatcactgaccgtccgctagctgaaggcatgtgcaacaaagaataaacaacaacacacaattacagaggcaacacagaagacatgaagacatgcacatataaacattggtgaacattcgattatc

SEQ ID NO: 59245 - DNA, 349 bp, Triticum aestivum
  Clone ID: PAT_TA_59245
gagcacaagaaggacggcgagcacaagaaggacggggagcacaaggagggcatgatggagaagatcaaggacaagatcagcggcgacggccacggcgacggcaagaaggacggcgacagcgactgagccagctccggccgcgtgcagtgcaggggagatgaacgcgtgggttaatttggagcgtgtggtagcatatgtatgtaatgcttgacatgtctcatggatcttgtaatgtaataaccggctgcactgcatggtgcttgtaataataacgttaaggaatttccattggtaatttggtaaaaaaaaacactcaacaaaaaacccaacaccaaccaaactaccactc

SEQ ID NO: 59246 - DNA, 421 bp, Triticum aestivum
  Clone ID: PAT_TA_59246
acgacgggcggctgctgctgccgccacttcccgagaacaaccgaccggtgcagtcccctgaagaggttggccggctggattgcgtgccagccatcttcgatgagctcccagtccgggacaagatgtgtgttttctccgtatcagcagcaagagcttctctagatgaactgaatgaatcagcagtgcttttgtgcctcgaatggtctccgtgtccgtggcgaccggagctcgagtttcttctggcaaatgcctccacggcaccggtgaatctatcccggatctcttgtcctactgaaagtctttctgttctctcaacagatggcccaactccagccaatcttccactcggttgtcgaacaagcttgttactggaactcatatgaggatacttgagtgcggtccagtcaaatacataatcaaa

SEQ ID NO: 59247 - DNA, 391 bp, Triticum aestivum
  Clone ID: PAT_TA_59247
ggagaaagcctgccgccgtgtcgtccggagaggacgcgggtgccgatccgttttttttgggagagcagtttccgtgattctgcttgtgcgaaaaaatagaaatgaatgtatttaaaactaaaatacgtctagatacatctatttctccgatggctaacactccacttcatgatacatggactcgtgtttttaagaaaataaaaaagagtagcaaataatccggcgtgacgagacggagggcgagcgtatggccgacaacttggctgctcttttgaggaagggacgatggtgtccagacagcggttgcttgggagcttgcaaggctcgtgtttggctcctacgccgagttcagtgccctgcaggttcaaggtaactctgacatccttgcacg

SEQ ID NO: 59248 - DNA, 308 bp, Triticum aestivum
  Clone ID: PAT_TA_59248
gcctctgattgcgccgacggtgcagtgccactgccatggcttggtctcggctagccaattttgttcgatcttattggtgatgctttgtgttgtgtcagggcatgtcttccctctttgttctcccttgtttatatgttgtggtgtgtgtggttttttgttttatctgttctcctcctgtggccccggtaattctggttcacttgaacacatcctgcaaaaggctgcgaagccttataggcaaatgaatacaattcaggtggggggtttctctccctccccaaaataaaaaaaaaaaaaaagaataaaaa

SEQ ID NO: 59249 - DNA, 430 bp, Triticum aestivum
  Clone ID: PAT_TA_59249
gggtgttcaatctttcgaagatgctcatagggatagggtatgcgttcataggggtgagtgtatgcgtgtgtatatgagcactcgtatttgtaccgtgttaaaaaaagattccaaggtcccaaagataatgaacttgattaaaaatttgtgtatataaattcattctttttagataaaagtttgaatttaatttggttggtgtgcgccaaacctaggctatagtgcaacgcctagacgacacatgggagcctcagcagcaagccactgtgatggactctttccaacaaaaaataaatctaaaatctttgtgaacatataatccaaatatcagataataaacttgatataacagattaaaggtaattacacactggtgctagaacttgccatgaatgtgcactttagtgcctgaacttgcaaaatacattta

SEQ ID NO: 59250 - DNA, 438 bp, Triticum aestivum
  Clone ID: PAT_TA_59250
acggcctaaacgctgctcctcctcccctttaccgacggagggggatacgtccggatctgtaaccagcggtgaggatagaaagccagtgttttttgaagggagaaagacagtgttactacccttatcttgtttagatctggagaggatgagagtgtgtgaatagagcaatcctagcaagcaagcgcgaaggctccggcctatatatacgtagtggggtagttttcctttttcactccatcaaaacaatcgtttaaaattgtgtactactacatgccaggtcgcatttttttagttgttgattgttttttgagatagctacccgcttgttccaagtggtgttacggtgtgccaagtcgcactttgtatcgttcaagtctggtactacaagtccctccattaaatgaacaacaacccctcgtaaaattgtgagcaagccac

SEQ ID NO: 59251 - DNA, 442 bp, Triticum aestivum
  Clone ID: PAT_TA_59251
gagatctaagaggagaaccaccgcttcgagaggggtcgtctggagcggtagagggcgttcgaggtgagcatcgctgaaggtgcagcagcggcaggcaccgtattgcagtagtctagttcgtcagtagcctcctcctcctcttcctcttattgagcgcgcttggcagaggagaggctaccggaaatagtacaaagcccctccgtagtagtatttaggggctattttgttcagttcatctgactatagatgtggtggaactgtacaacatacttaaaagtagctagtatatatagttgaactagctatttcagtacgtggttggcaacaattggggaaaaattcggtcgattcagctataaagttgaacggtttttaaaaattaagcacgactacttaatctatgaatggaatctatgcttaattactgaattttagttgcaaa

SEQ ID NO: 59252 - DNA, 455 bp, Triticum aestivum
  Clone ID: PAT_TA_59252
aagatctccgggtccacgacgaaggccgggcactcgtcagcggcacagcgaaggacacagaatgccgagtgacatcaccaccttcttgaaccagtacctcgggcactgatgcagttcgagtggccttgccaaccggcgcctttctattattcctcgccctcagtggcacctcgtcttcatcatcagggagatcaatgacatgatgaggagctgcagcatgaatccagagttagaaacgaaaatccaatcgaccaaaaggaaaactacaagagagcgtaccagggttggaggtggcagcatcttccatttcttggtcgtctttcttggcggaggtctcggaggtagcagcactgcagatttcagaaaccagtcggtaagtcgatgagtcaaccaagagtttgtccgtgctaaataagaaaacacaagctccgttgttacccggagatagtgggaat

SEQ ID NO: 59253 - DNA, 442 bp, Triticum aestivum
  Clone ID: PAT_TA_59253
atccatctcatcttggaaaagatctcttgattcagtgaagcaatgaaactgacaccataatattttgaattaaaatcagaaatcattttcctctcttggctaagtaaaaggaagcttgtatgtaaaacaattatttggtaactgatatcatcaagaaagctgtgtttctatcatgttttcacctgcatacgtgatgcatagcagtacaccattatgtaagaactagagctcgaatttacatgagtccattagtctccagatctagcaatggctcctataagtatgcaattcctataatgcagttatattctagacaaggtcctgataaagaacttgattactaccaggataacaaggtgctaatgaataaaaatagaaggtgccaatgaactaaaataatagaaggtgctaatgatttatgtttcttaactaaaatgcaaaa

SEQ ID NO: 59254 - DNA, 449 bp, Triticum aestivum
  unsure (1)..(449): unsure at all n locations
  Clone ID: PAT_TA_59254
tctttcttgtaaaacatcattattttgatttttcttgatttcatttcctttcttctttgagggcaccaatgctgctaatacattccttcatcgaaaacttcctttttgtgaaacttgtactattatgtgcttattattgtatattataataagcttattgtatattataataagcacaatttccgtcttaattgagtgcaaacgttgtccttgtgtttttttcatgttctttcttcttaaatggtaataccaatgccattaattcattccttcttagaaaactttgttattttaatttgtttcagcatttgttttattttctttctatgagggtaataacactcccactacttcattcccttgtgagaaactttctttgcgaaaatttcattattatatgcttatacttgcatattatanaggtcacattttttgtgtaaactgtgtgc

SEQ ID NO: 59255 - DNA, 449 bp, Triticum aestivum
  Clone ID: PAT_TA_59255
aaaggttagaattttcaccccacccaccacccatctcgtcgccaatgtggagaacctaaccaaagtcctcgcaagcggatccgacgacaccgatgacatggacgaggaggtcagtgagtcctcggcccgcctgcaaacaaccaccacaccaacgaggaagtggatgacaacctccacctacgacatctacgtggtagatactccccacgacaacagtggcagaggcgataatgataacaatggccgggggaggcaacggtagcaataacggtgggaatgataacatggcaccaatgccaacaaccccaacaacaaccttggtcccgatcacaaggacaccttaaacaagtcacttggcagtcccaaccacgatgcattaaagctaaggctgctcgacaccgccaacaagataaccgatgaaaagcaacgacttcgtgacaaagagaaat

SEQ ID NO: 59256 - DNA, 303 bp, Triticum aestivum
  Clone ID: PAT_TA_59256
gtggccaagaacttcgattgccatggccaggttgttgcggaagcttgtgcgttgaagagtggaaggagctgttaaagctttttctttcggcagttggcttattatgctctggttccctgcaaaaaaaaagaaaaggcttattatgctctggagctgtcttgcatttttccttcttgcaatgctgcgttagcggtatgtaatcctgtaaccatattttgagtactctctggtgtttcaaaaaaaaaaaaaaaaaaaaaaaaaaaaaaaaaaaaaaaaaaaaaaaaaaaaacagacgaacaaaaa

SEQ ID NO: 59257 - DNA, 453 bp, Triticum aestivum
  unsure (1)..(453): unsure at all n locations
  Clone ID: PAT_TA_59257
acccaaggacttctattcttaaggattggagggaaaatattgtgacaactatttgatccaccggaagtttcatgaggttttactctgtgtgattaagatggcagcagattacctcaaacctaaggacccaaactttagtgtgcacccaaagattcgaaaggatagaagggcttatccccatcttaaggattgcagtggtgcactagatggtactcatgtcagagcttctattcctgttgacgaccaagttagatacattggaaggtcaggatcaacaactctgaatgttctggcaatatgtgattttgacatgaatttcatgtacacctcagttggtcaacctggttttatgcatgatacatgtgtcttgtatcatgcaattgaagctgatanagataccttccctcaccctccgaagggttagtagttcctataataattttgttactcaaa

SEQ ID NO: 59258 - DNA, 406 bp, Triticum aestivum
  Clone ID: PAT_TA_59258
gtggcgaccttgagcacgaccagttctgggcggcggcggtttaggcagcggctgcgacggcgattcccgcatgggcggtggtgattgaggctcgcggttgctggttgagcctggtggcggctgcgctgtgaactccagttcatcctttactgtcaacgttaccctcagcccggcaagttcccaagttggcggaaataaaagagcaaagaaagtgccagcaaagctaccagactagtgcttgtttgttgctgtctgttcttatgtcagaccatgtgagaattcatggttatcgttgattgtaagctatattcagtattatttccctttcccatttagtactttgtcagactatgttcaactaaattgggctcagaacatgttcaactaaactcaatacaatgccccc

SEQ ID NO: 59259 - DNA, 429 bp, Triticum aestivum
  Clone ID: PAT_TA_59259
aggcctgccagcccaatcagcatcagagaacgccgaaaggtcacaagatggtgcagactgaaggagcagaccatacgaagcagtagaggaaacataacgcaggatgcgcttaactgccgagagatgagtggtacgaggtgcatgcagatactggcacacacggttgactgcataagagacatcaggtctggtgatagtgagatattgcagaccaccaacaaggctgcgatactcagtggcatcatcagtggaaagaagatcccatcaagggcagacaaccggtcagtggcagacatcggagtgatagcatgtttgcattggagcatcccagcacggcccagcaaatccgttgagtactttttctgactcaaagtccaaccagtagaagaccgtgacacctccaatccaagaaaataatgcaaagcacca

SEQ ID NO: 59260 - DNA, 456 bp, Triticum aestivum
  unsure (1)..(456): unsure at all n locations
  Clone ID: PAT_TA_59260
agtacttagtgaaatacgtattgtcggctataaaggagaagtggcctgagagcaatagatggaataccatctacgtacagcaggacaatgctaagactcatataaaaccagatgatccactttttttgcaggaagctgctaggggtggttgggatattaggatgatataccaaccacctaattctcctaacacaaacatattagatcttggttggtttgcctcaattcaagcaatgttccatagaaagatgcccaagaccctagccgagattgtccaaaaggtattgcactgattagatcttggttggtattctttttatgttctatgtgatatatacctatttgtgtatgaactgttttgagtttttcatgtcatgtgtcatangttaattaatccctagctgagtaccccatcaaaggctcaataggatctggttgagtcatcaagcgtgcatg

SEQ ID NO: 59261 - DNA, 240 bp, Triticum aestivum
  unsure (1)..(240): unsure at all n locations
  Clone ID: PAT_TA_59261
tacggctgcgagaagacgacagatcgacgggggcaacccaattttattttgtgttctttgtttttgttcctgtttagtgttaaattttgtttctactttctgtatanatgtggntttgtgttttaattaatgtttgtgccaagtaaaacctataggataagctatgatgatagttaatttgattctgctgaaaaacagaaactctgcactcacgagaaaaaattaaattaatcacaggaa

SEQ ID NO: 59262 - DNA, 441 bp, Triticum aestivum
  Clone ID: PAT_TA_59262
aattttggacatggcaggctcagtcgtgttggcgaggcaggccccagactgcgaggtggttggttggtaagctcgaggatgaacagtggaaggcaggggaggagacgaagaggcaagtgtgaatcgaggctgaaaatttgggaacttgccctctgagagctgtctaaaagaggaaacccgaatcgctggttgggctggtcctatagctcaagcctcaattggtggaaaaggaaaagttggtaactaaaaaaatgggcacaggtctataagccgaggctcggggcaggcccaggccatgtgacccaagttgccacacccatagcaagtaattaacctgtttgaaaccctgggttggcgccctcaactccctaatcatagcgatcattaacctgtgtcgaagcacgagcattacctcctggtcacacagtcaaagcactttgc

SEQ ID NO: 59263 - DNA, 388 bp, Triticum aestivum
  Clone ID: PAT_TA_59263
tggccgagaataatcaacggcccagtactagtactactcgagatgatgagcgcatgcatgcatgcatgagacctttaggtaaagtttctttttttactattacgatacaaggtgtctccgtgaaacgcctacctaaacttatgcaccatgcgtaccaagtggtttatggagaatggatggaccagatgcatcacaaggtaagagcaactccagcagttggacccccgggttcttaaaatcgccacctgggtcatcccgatgctaattattttgaagagaagagagactaaaattaggcaaacatgacacagttttggcgaacagggcgttcaacattttcttacatagaaaaaggcagctccaaaggataaaaaaaagcggccgctct

SEQ ID NO: 59264 - DNA, 399 bp, Triticum aestivum
  Clone ID: PAT_TA_59264
ttgacgaggagggacggcgggacgagctggttcgccgacaatctcaacaggggccatcttgattacttctacctgctcctcgctgctctcagcgcgctggagcttcttgctttcctctacttctcggcgaattacatttacaagagaaagcttgtcaatgttcactgaccgagactaatacatccgtctatgtactatggatttgtggccaggtatacagtacaattgcagttagcatcagtaaagttatacgagtacgctgacgaccgaccctcagattttttttctttttttgaaaaaaaaaaaaaaaaagaagaaagaaaaaaaaaaaaaaaagaagaagaaaaaaaaaaggaaaaaaaggaaaaggaaaaaaaaaaaaaaaggggccgccctaaa

SEQ ID NO: 59265 - DNA, 439 bp, Triticum aestivum
  Clone ID: PAT_TA_59265
ttatcggaaaattcaaatgcggcacttcttttctactggaatgagatgaaccgacaggttagagtagaagggtcggttcagaaggtctcagaagaagaatctgagaagtatttccacagccgcccacgtggaagtcagcttggtgcaattgttagcaagcagagcactgtcatttctggaagagaagttctccaacaagcatacaaggaattggagcaaaaatattctgacggtagcttcatcccaaaacccgattactggggtggctacaggttgacatcaaatctttttgagttctggcaaggccagcagtctcgtctgcatgaccggctacagtattcacagcgagaattaggtgggagtacagaatggcacatccaaaggttgtccccttgatcagtaacctccttaaagctctcgcctcgtgggtaataaaagg

SEQ ID NO: 59266 - DNA, 104 bp, Triticum aestivum
  Clone ID: PAT_TA_59266
agataagagggggaagaaacaatgaatacaatgcaaacataaacacgacgatgcgtgacgtgacaatgagcggtgctaggtgtgccctaacgtggtatgaggcc

SEQ ID NO: 59267 - DNA, 312 bp, Triticum aestivum
  Clone ID: PAT_TA_59267
aggcgctggtggagcaggaggggctcttctggttcgggagcttctggggccggacggagcagggggaccccgtgtccgcggaggatcagatgtacgcaggcttgagcttgccggtagtcctagagagagtgcgcgattaggcaccgacgacgatgcagtttgatgcaagcggcttgcattgcagcttctagatgaggtttctacttttccatccgggcatcattcggtcattgcactgatgattccattccttactgtacatatgttatcatcatggtacgcctatcaatcaaagggacaatcctgaacaat

SEQ ID NO: 59268 - DNA, 302 bp, Triticum aestivum
  Clone ID: PAT_TA_59268
ggtactctgtctctaaggttcgttccaatctcaccattttatttgattgagatgagagaggggtcaggtggcacgcggtggctgttcgtggttgcgtgctgcttatgtactgtgcaattttattttttatttttttggagatagttgctgctctgtgctagaaggagggatgaacagaggagaaacaggacagggctgggtgttgtctgcacacagagatattgagataattggtactattgttgtaaaatgttttaatggaaaaaaaaatcctccattcccttgcaaataagtttggttta

SEQ ID NO: 59269 - DNA, 224 bp, Triticum aestivum
  Clone ID: PAT_TA_59269
gatagttgatgttatcgacacacgttcgatgatttctttgatgagactaggaaggatgggacatcaacatcttccatacactagttgcaatgcagatatcaccggtaacgtatatccgcgtctgcctcagtagtgaagcatcatcaatccgcatgtttactacacatcagtaaggtgttttagactatgacgacaacgacgatgattcatgtaaactgttgcgt

SEQ ID NO: 59270 - DNA, 434 bp, Triticum aestivum
  unsure (1)..(434): unsure at all n locations
  Clone ID: PAT_TA_59270
gggcaagtaaggaactattatctagctctgcacttgattcaccttatgttttgagtaagcttgcaacaccaccacatgctattaatcctgatatgtcgcaagtaattaatgatgctacttctgctatgaatgatgttgatgatgatgctagtacttttcttgataagattgtgccactgggtgaatctcttgatgaacaacttgctagatctaaagaaattgagaatgctgaaaccaatgaaagtacttaaactgatgaaattattgaaactggaaattttgattcacctattggaactagtgccactagatatgaatttcctgagatacctgagggtcatgttatggatggagaagtagctagagactttcttgcttgtaaggatanagatgatcttaaaaaattactacgcaggctgaaagaaaaatctttg

SEQ ID NO: 59271 - DNA, 440 bp, Triticum aestivum
  Clone ID: PAT_TA_59271
gtgatgagtaagctctttgagaaggacactgagcaactcgattcgtcggaagtgcagaaacaagatgatgttgttaacatcatggaaccgtctgatgctgagacagaactctctaatgctgagacggaaccctctgatacggagacagaaccctctgattccgacaatgatttgccaatggaagaaacaacagaaactcctgaagaagatttggatgacctccaaatggaagaaacagacgatccttctgaagaagaattcgatgatgaccttgtgatcaacattgctcctcgcaaggccaacaactcagctgcccagttaaatagggcaaaccaagcagtgaataaggacgagcggttcagaaaacgtcagcactttgatgagatttctccacaaatgaagagacagaaacctgaggatttatctgaacctagaaacca

SEQ ID NO: 59272 - DNA, 441 bp, Triticum aestivum
  Clone ID: PAT_TA_59272
atagcgcaagccaaggaagacctggcggcagagaacactaggatgactatggaacgggccgctttggatgctcaggcgcaacgaatccaagctgattccttccggctctcattggatcagaacgcttcaaacgaagtcctgaggagaaggcaccggagtcgtctgccgccggtttacaaggtgaggaacctcttcaacacacctagtgtagggaccagtgacccgccaggggtaaatcaggcagtagccgcgcttgggactggagcgccggctcaaccgtgcatgacaggcccgcccagtcagaataatatcctaccacaacacgtgccgacaccaccgggtcattactctaaccctttggataacatgatcgttgtgatgtcgtgactggcggatctcccagttgaaggcgagtctctagcggcggttgaaacgcggaag

SEQ ID NO: 59273 - DNA, 446 bp, Triticum aestivum
  Clone ID: PAT_TA_59273
atgcggctgcggctgcagccatagccgtgaaccatgtgtggatgaggtgagggagatggagtcgatagaatccctaaggaaagctttttgcaagcagatcaaacaaactggaggggtggcgctccatgctcggtagggtaggcagtcatgatgcttattagggatgggagttggtagttgggacccaggatcgtttatgggctgtgtgggctgactaggcccgtttcttgctttgcctattttccaatgcttctgtgtgcagaaccatgtgctactttagtgtttgtgcctaagatctattgttcacgaaccccaaccttcgatttgccgaaccctgatctctgatttgccgaacccgaccttcgattcgctgaaccccaatctctgatttgagatctgccaaacctgacctttgattcgccaaatcccgatctctgattcgccaa

SEQ ID NO: 59274 - DNA, 416 bp, Triticum aestivum
  unsure (1)..(416): unsure at all n locations
  Clone ID: PAT_TA_59274
gactagttgagattctagaacagaagaatgcccgctacgtgccctttgatggctgggagaagatcgactccaaagagaagacggccggcgagctgaagaacaagcctagggagaagatcacaagatggaatgagctcctggaagctgcaagggagggttagttgaagggccacacatatgcatctgacggagctgctggttcatgcgtaaactgaatcaaagaaacaaactacgagggacaatctgaatactgacacaacagaaagaaagtcaagtgctaatgtgtcttagcaatgaatcatgcgtaccaatactggttaaaatcccaaaaggctcgatcactgaagccacatgaaactactgtattcgtgagatgcanctcgtctaaatcatgggcattcctttggaaaaaaaaa

SEQ ID NO: 59275 - DNA, 436 bp, Triticum aestivum
  Clone ID: PAT_TA_59275
agaagtattgggccttattgggccatacgggaaagagagagggtctgcctagggcaggccgcgcgccccccaaggcctagtccgaattggactagggggaggggccgcaccccctccttccttcccttctctcttccctttccttctctcctactcctactacatggaaggtctcctagttggactaggaaaggagggagtcctactcgtcctactcccggtgggagtaggactcctccctggcgcgccctcccttggccggccgccccctcccccttactcctttatatacgggggcaggggggcaccccataacacacaagttgatctacggatcgttccttagccgtgtgcggtgcccccctccaccatattccacctcggtcatatcgtcgcagagtttaagcgaagccctgcgccggtggagcatcatcat

SEQ ID NO: 59276 - DNA, 430 bp, Triticum aestivum
  Clone ID: PAT_TA_59276
gaggtcgaagccctccggagagaagtagagatgctcttccaacagaagctcaagccgggtacggctaccgcggcgttatagacactcggatgaacgcaagggaaacaggcaggcgtttccgatccagtgaatcagtgctggctgccaaacttttgaaagagtagattgttttcagaagagtctggctgttgagctgagtcccttcttacttttgccggagggttatagtgttgtaggattcgatggaacataggttagagacacttgatatgatgatatgggttagttttcccatttgcacagcaagctatgacacccccctgtgtttcttggaagatttccttttttattggaagacacgatgatcctccattcctcctgttatagaagtgcaaagacgtcttaaaaaaaacagagaaaagtgaaaaca

SEQ ID NO: 59277 - DNA, 440 bp, Triticum aestivum
  Clone ID: PAT_TA_59277
ccttatcaacgcttgcctcgtcggtatgggcgcgaacgtgttctacggataacagccggccaccccgcgacggttgcccatcttgtgcgggagagacactcgcacttgggctccgctttccatgcgccgatacatacatagatggcatcgcgggttagggaaactccaacgaggcacaccaattctgcatccctaaatatccggaccgaatagtctggaagaccgtttggtcatcaatccaatgggagtcaccaaatatccacggaccagttcggatgtccggaatcccacataaaccgaataggattgatgggtgtgggggtctcgccaaaaaattgcttaacgggtcaacggtacaatcgcatactcatattaaccactcgattacaaaaaatgctatgggagtagcatcccattaggacatcgggctcaattcacga

SEQ ID NO: 59278 - DNA, 370 bp, Triticum aestivum
  Clone ID: PAT_TA_59278
aagactagtatgaatgattcaaaggagaaggatgagaaaaagaaagaagatggcgacagctcacaaaaggagaaggccaagacagggaaagataagaagagcgagagcaaagataaggataaaattagcgtcaaggagactggatctgatgcagatgacagtacccccaagaacaaaaagaatgataaggacaatgcaaagaagaatgatgaaagcgatgaaaaacaagagaaagacaaagagaaggaggaacatgataacaagaagaagcatgtagaagtgggtcacgcaagagaaatcaagctacaagataatgagtctgcgaacaaagaaactggtgcttctgaagagaagaatgatggcacggaca

SEQ ID NO: 59279 - DNA, 273 bp, Triticum aestivum
  Clone ID: PAT_TA_59279
ctggaagtctacaagtgcttcaggatgctcaagtacattgtcaggaataacgaactgcgccacatctccatcaacatgatgtccaacatcgacgatgtttctgttggtctcaaatgcttgcggcacggggcagcagtgtaactggtcaagccgcttcgcatgactcatctgttggaactctggacccatgtgtggccagtgagacagcagcttggataggtccataaagatttcgtcaatgtcaatcgtgacttggggctgtctgtaactaat

SEQ ID NO: 59280 - DNA, 382 bp, Triticum aestivum
  Clone ID: PAT_TA_59280
caattcatcagatcttgacaaacacaccgcaaatgaagattacatcgaatagatctccacaagagagggggagaactagtaaaatattttatgaacaatagggaagttggaatacagtaagtttaaaaccaatattaataaagagcgagttcagtacagtaccttgaagtggtgttttgttttctttcgctaacggagcttatgagattttctgttgagttttgtgttgtgaagttttcaagttttgggtagatatttgatggcttatggaacaaggagtggcaaaagcctaagcttgggaaagcccatggcaccccgagtaatctaaggacaccaaaaagcctaatcttggggatgccccggaatgcatcccctctttcgt

SEQ ID NO: 59281 - DNA, 373 bp, Triticum aestivum
  Clone ID: PAT_TA_59281
tagtcacattgcacgcacagtgcataccaagacacgccaacagcccgtcatgtagcaatcttcatgtgttttcactaatcatggtctctttggactcacggatgccataagggccaaatgcatcaatattgacacgttgcactcaaacgtgccacttgggccaacatggataatgggttttttactagcaaggatcacataagccattatatagtgttggtaccctagctaataacaacatatatcaacattggtcctagttgcagcttcacaggaccacttatgcatgtgtcgataccatcttgaccaacacgcaacaacattggtctcattagattgatacatgccataaggggtccaaatcattcaccaa

SEQ ID NO: 59282 - DNA, 373 bp, Triticum aestivum
  Clone ID: PAT_TA_59282
tacatcatcctgaggcgggaccacacggttcagtcttaagtacggatgcattggacgtcatagtgctgctacaatggcacgtatcttcagctgatgtggccatcgttatagaagatccagactgggatgtcgctgctctgatacaaattacgcgtcttgtatcaaattctcatttagacagatggattaacaccgaaaaggttggcaacgttcacacatagtacgagttgcacaccctgactggtgaagaggacgcgccctgttgcagaccagtacacacgagccgatgtggtggtctatgcgcagagtaaacgatacacttgccattcgggctaatgaccggtactttcgctttccacgcttcttttctcgg

SEQ ID NO: 59283 - DNA, 209 bp, Triticum aestivum
  Clone ID: PAT_TA_59283
gtaccgacagtgtgacggcaccctcctagattctcataagcacatcagcatcaagctggatgagaacttaaactgggtacaatatgtcataccgagtggttgcctacatcagtaaacatgaggaatgctgcacatgctagcacttaaaattaattgaatcttaccaatgttctaacgtaccccctgtcataccagagttattgtcttgg

SEQ ID NO: 59284 - DNA, 309 bp, Triticum aestivum
  Clone ID: PAT_TA_59284
acaatcacaggcagagaactgcgcagcgataatcagtctctgcaggatggacgtgctcaccgagggcagcggggaaataatgaaagtgtgcaacgcgtacgtagacgaatggagccggtcgttggtctacgtgagttcgtgcacgtgactccatcgatcgtcatgtggacggagtcacgacgggaggtgtgccagctagtcgcacagcacatggattactccatgggtggctacaaaattgagaacgtcacaccgacacgcggcgaatcctccggtgataatgaaatcagtcatatccttggtcatgac

SEQ ID NO: 59285 - DNA, 376 bp, Triticum aestivum
  Clone ID: PAT_TA_59285
aaggattccacctatgagctttggacgacggtgaacaatctcttcgcctcgcaatcacagtcccggatcaccaatctaaggatcgcgatcaccaacaccaagaagggcacaatgtcgagctcggcgtatatggcgaagatgaagagccttggggatgaactggctgccgctggtcgtcccatctctgatccggagatggtgaactacatactcgcaggacttgaccgcaactacgactccgtggtggcggtgatcggcgctgtcaagaacacaatcaccgccgatgacctcttcgctcagatctccgcctttgatcagaggatggagatgctgggagactcgtcttcaggcgggtttcattcatctgccaacgccg

SEQ ID NO: 59286 - DNA, 435 bp, Triticum aestivum
  Clone ID: PAT_TA_59286
aacttgcggcagaatgcggcgaatagggttttcccggacgcgtcgggcaaacgggccggcccataaccaggcaacaagcgatattaaaaatgactcgaaaaagaaatgcgcacacaacagtttcgaacacgcgacctcatgcttactagcggccacgccaacaatctgacctagctcctgaatatggccaattgaagtgcaaattttaaagtacaatgtacaacgacaaatcaatttttttccttcaaaatttccaataattcttgcaaacaaatgtaaacgattttccttaaatatatttgaaaatcgtgaataaatatcgaaattcgaacaaacacttaaaacccgaacaattattgaaaacgtgaccactattttgaaattccaatttattatatacgttattttttgtaaaatatatattaaacaattttt

SEQ ID NO: 59287 - DNA, 151 bp, Triticum aestivum
  Clone ID: PAT_TA_59287
gaaagttcactccagcgtgatgttagaagtggtggagccttgcagttggtgcttcggtgttgaagatgtagatgcctgattagcatttgttgcgcatgttgaaccatgccaaattgtattgtctaacgatcgacctttattcagtcagatc

SEQ ID NO: 59288 - DNA, 398 bp, Triticum aestivum
  Clone ID: PAT_TA_59288
ataggcgacgtcggctcttccccgcgtgagagcgataggacccctgggacattcgtactggcatgcgtctgttgcctgattgctcacaacggctgccgctccctggacctcaggcgggagacgttcgtcaccactgtcccgtgccacgagtccatcgagctcgtgtctatcccaatcagagccctgacgcatgacgcgcagccgagaatgaaaatgcttaggatgtttgccacgaaagggtttttactagctgggagctgtctgttgcactttgccttactataggctacaaccttgtgtccttgtgctgtgcaacttgtggcactcccagattgcagtcaaagttatggcatatggcgtaatgctacactctgttaactggaaaagatgcgacatta

SEQ ID NO: 59289 - DNA, 388 bp, Triticum aestivum
  Clone ID: PAT_TA_59289
gttgatgcaagccctagatttagtctgatgacatgcttgctaatcatcattatcctgtttgaagactttacttcgtacattacattgaaagattaaatgaacaagtgcaataccacactgtgatcaaattctgccttgggctatggaatcccgggaacaattgtactcagctttctgtaataatccctatctgctgctagcatggcaacattgaaaaaaacatcagaaattctacttgagtgccttcaagtaatttagattgtccaattatttctgtcactggatactctttgtttttcactgatcacggatttgggttcagaagatttgctaatttaggttacgataatgttggactgaagttatgatggcgtgttgtagataaaaa

SEQ ID NO: 59290 - DNA, 378 bp, Triticum aestivum
  Clone ID: PAT_TA_59290
gcactgcatgtttctaatcaccacggttgatggcgtgttctcatttgtcgagtgtttttaggcaatatttggaaagcgttaatccgttagtacggttcacctatgcccaagtgtcaaccagatcgcactagctaaatgtttttggttgtttattaatgaattataaactttgtcgagtgcccattggaaaatacttgacaaagataagacacttgacaaacaatttgaaaggacatcgacccctaattagggttttggtgttaatggcaatagtgagtagacgactaactatgtttcgagtatgctttgagtatatacatcattggaaatggaacataaagttcgtctgcgattccctaagctaaaaggataaaagaa

SEQ ID NO: 59291 - DNA, 379 bp, Triticum aestivum
  Clone ID: PAT_TA_59291
tagcctctagagggacgagcagagtagcaggaggatgtaacctaagcacttccttgatgatcatctgtaagtaatggagttcaccaagattagcatttgtgatgacaacacgtcctcgaggtagcactttctgaacttctatttgagccttcgccatctcctcagggtttttcatgagctccgacatagcccacaccaaagtgggtcgatgaagattcactacgagctccaggtatgtcctagaaataagagtgcatgcatatgtggacatagataaaacagatagtaattatgacaaggtaaatagatgaaacatttacatcagaggtgataaaatacctaaccaaggttctaccgacaatcgtagacttacgagagg

SEQ ID NO: 59292 - DNA, 388 bp, Triticum aestivum
  Clone ID: PAT_TA_59292
ctgaagtacatgggagagggggggtcctcgtcgaagtgcgagaacgccatggccacgtacgttggctaccagcacccagagccatgcgcctagtcggccaatttgattctggtggatgctggtgcgaccttaatttaattctccttttcttcttctactaatctaattaatcaatgtttcctggacgaatttgttgtttcctgttgcttagatgttttgtgtgtgtgcggcattagggagctgccaattgctgcatctacggagtactccctccattccaaattactcgtcgtggttttagttcaaagggagtacttgcctagttgcccaatcagtgaactcgatcgtctgacaagtgggccctgtgcttatgttgacgattaatgtg

SEQ ID NO: 59293 - DNA, 423 bp, Triticum aestivum
  unsure (1)..(423): unsure at all n locations
  Clone ID: PAT_TA_59293
ttgacatacttgctacttcctcttgctgcttggataactttgtagtccaatatgctttgtccaacatttagactttccccttcaaagacacattgtctccgaaagttggaagattctatattttatatcccttatcttttgagaaaatatatgtgagtgaacctgaatgtggatgtataagattagtatgaaaccacaaaaaatgcaataatgcatacttacatgcaaggcaaccattatctttctaacttataaaagacaatatattaatacaaccatgtttgatctcaactttctagaaatccaatgatagtaagcttgttaggaaagaaacatatgattagttttaggacaaatggccaaagttgttatagaactggcatgtaatacacataacatgagatgttagttaanctaattttt

SEQ ID NO: 59294 - DNA, 439 bp, Triticum aestivum
  Clone ID: PAT_TA_59294
gtattaataaacctgacaggttaattgaagagtgcaatatcgtttcttttgctttatctgttgcagaagaaattgaaggtaatgctgagccttcttcatattccgaggctattatttctggtgatagtaataagtggatgaccgctatgcatgatgagatggaatcacttgaaaagaatggcacttgggatttagtaagattacctagagagaagaaacatattcgttgcaagtgggttttcaagaggaaagaaggtgtttctcctaatgatgagacaagatataaagcaaggttagttgctaaaggttatagccagattccaggtattgactataacgaagtcttttctcctgttgtgaagcatagctctattcgcactttactcagtattgttgccatgcatgatcttgagcttgaacaattggatgtaaaaactgc

SEQ ID NO: 59295 - DNA, 374 bp, Triticum aestivum
  unsure (1)..(374): unsure at all n locations
  Clone ID: PAT_TA_59295
ggccacatcaagtacggcggttggagctcggacaacggcggaagcggcgttgcagagtgcaaactaggcggcttctggctcctacggcgcctacgggagctcacgaggttactggacatggattccaggccagtaagtcacgggagtgacgccggccatgagcttgagcggcggtgggtttcggcctcgatggaactacggcctagagctcgcaatcgagagcgttgttagaggggaaatgaccaggtgctcacaacgcgttggatggnnggctcggnagctcgggcgaggctctggagtcggtgtgtggtcgccggcgatctcggcggacgagagttgaagacggcgaaggcgacggcgatgcaaggcgttcg

SEQ ID NO: 59296 - DNA, 347 bp, Triticum aestivum
  Clone ID: PAT_TA_59296
gaagaagaagggctgccgaaaaagtcccagacaccggacgaccggccgggaccgaacgtccggcgcctgaagcatcaaccgagtcctagccagcggacgttcggtccaggccggatgaccggtgccccgacacccgaagcaaacgagctgacgtccggtccggaccggacgaccggcgcacctgcacccgaaccaaagtcagcggaagaccgacgtctccggacgtctggcacccccatcacagagcggaaccagcggacaaccggaggacaccggacgtccggcagctcctgagacaccggacgaccggtcccaagcggacgtccggtacctgtctgcgcacagtg

SEQ ID NO: 59297 - DNA, 443 bp, Triticum aestivum
  Clone ID: PAT_TA_59297
aaagttcttgttttcgtaatttgttcactatttcagaaaaatgttcatgtttcaaaaaatgttcgggaatttcaaaaaatgttctcgttttcaggtagaaacacaatttcagaacaatgttgatgtttgaaaaatgttcgcggtttcaacattgtgatcgcaatttcaaaaaatatccctgtgtttttttgttcgcatttccaaaacacatatgaatacaaatattgttcgcattttaaaaaaaatattcatgttttatttcttttgggtttgaattaagaaaatgtgtttttcaatttttgtttaaaaatatcatttgtggtcttagaaaatatttaggaatttccaaaaaaggaaatagaacatcacatttttcgaaaactgtttgtaatatatacaatacttgcgtgatttcaaaactgtttgcaactttaaaggaatgt

SEQ ID NO: 59298 - DNA, 226 bp, Triticum aestivum
  Clone ID: PAT_TA_59298
ggaagaggaaggaaggacatggagttattcgtgacgtgtttaaaactcttgaggttttttttttgaaaaaaagcaaatacactgccccgtggacaacttttctcggacagagggagtattatagaagaaaatgttgtattgaaaaaaaaaaaaaaaaaaaaaaaaaaaaaaaaaaaaaaaaaaaaaaaaaaaaaaaaaaaaaaaaaaaaaaaaacggtcaaacaaa

SEQ ID NO: 59299 - DNA, 453 bp, Triticum aestivum
  Clone ID: PAT_TA_59299
gatgaggaagacgactcgctacaagtagagagcacatcagtgggcttatccatgacacgtggacggtgagtgtaatggaaaggaaaagagggaagagggggaatcaccgaaggtgatggagatggagacggggaagacatcgatgataaaggtggagacgaggaaggcatctgtgatgaaggtggagaattggtgttggtgtcaccccagaagctcaaagattatttgatgcattgtcgaagacgcttccagttcattgggacaagaccgacattgttgtaatgaaggaggttcgtgtatgcagtccctacctgcctgaaaatgtcagcggcggaacatcagctgctaatgaacgggttaagaaagtgctggactttgagaggaaaagacaacatgtgcgtgtacctggccaattctaacttgttcgacttgacaattttcacctcaactcct

SEQ ID NO: 59300 - DNA, 424 bp, Triticum aestivum
  Clone ID: PAT_TA_59300
gctgagagaagacgacagaatcgacgggttcctcattgttcaagttcagttgggttatgctacttgaatggttcgaaagcacaggtttgaagatgatttccctgcatgtttggttttgcctttcctgctgatccgtttcttccctgaactttcagttatggttgcttatacagaagagagacggtcaatattgtatgcttgtgtatgctagtgaagtggcatgattcatttttcttgtgtgtgcatgctacttatagttcaaaattgttcgcttgtatatgctactgtaagtgcctatgttgaagcacactatttaagtttgttttacacacagaacttcaactagaaacttttgagaaagtacgcccgctttgtttttgtgaaaagttcaagtatgattgtttgaaaagtacaaaaatgaatg

SEQ ID NO: 59301 - DNA, 441 bp, Triticum aestivum
  Clone ID: PAT_TA_59301
ggtcatatcgacaatcaaccgtgatggcgtccaaagtccttcttgcaatcctcctcctcgccgcggcgacgccagcgtcgctggctgccatcgatatggcgcagatgctcgctgacaagccccagtacgcgaccttcctgaggctcctgaaggagacaaaggtcgccgatgacgtgagccggctcaagtcggcttccgtgctggtcgtccccgagaaggccgtaaagccactcttggcggtgccggccgccaagcagcggacgatcctccagcatcatgtcctcatcaagtatttcgaccccatccagctgggcgagatgaagaccaacgttgccaagctccagaccatgctctccaacacagataaggacatgggcaccatcgactactccaaggacaaggacggccagatgtacctacgctccccaggcgccgatagtg

SEQ ID NO: 59302 - DNA, 441 bp, Triticum aestivum
  Clone ID: PAT_TA_59302
tcttggggatgctatgtttaatgaagatgatatttttagcctcccaagttttgatatgcaaagttgttatgatgatagcatgcctcttacttatgattatattgatgaaagtgggtctggaagagtgtcaactttaggaagtgatgattccactatcttgggagaggtctcaatcgattatgatgagaacaaagttggtacttatgatgattattgtgatgaaacttatgctataaaaaatagtgacgattatatttataaaacttgtcatgattatgattaccctttttcttaacgttactcttttaatgtggaaacaaattttagtgttcaagtctcttatgatactcccgctgttccgaatgagaagaattttgcttatgtggagagtagtaaattttctatgcttgtagattatgaaaagaatgctttaggtgctgg

SEQ ID NO: 59303 - DNA, 218 bp, Triticum aestivum
  Clone ID: PAT_TA_59303
ttctccacatttgtacagtgaggcaggtcccgcttctagccagcattatgctacattgtactgcctgtaacttgtaatggagtctggagcgattcagtgtgtctgtcagttgcggtgcggcgcatccgcccgacggccatgattggcgtgtcagtctttcgacacagtacgttattcgcatatgtgtgtgtgtgtgtgtgtgtgtgtgtattgctgtg

SEQ ID NO: 59304 - DNA, 431 bp, Triticum aestivum
  Clone ID: PAT_TA_59304
gagggatggatacgccatcgatgggagtacgatggggtggtgaggcctgcacagctgcacagccggccgccgaggatagagcaggcagtcgcgccggcgcttgtttaagcggctggagcatgaagagcacatattgaataagcacgactgtcattggatggacatccaacagtcactgcttgtgtgtcaacatttttttacgacaacctcaagtctgtggtaaacagcatacattccatctgccattatttctaataatttacatcccatttgctaattcgtatgggttttttggagcccagattctttttgttagcattacaacccatattgtggcacacgttaaaccactatacgaaattttgcataattcagtgctgtccaaactatttttaatcccacaatttcgagtcagattcagactgatttta

SEQ ID NO: 59305 - DNA, 381 bp, Triticum aestivum
  Clone ID: PAT_TA_59305
attactggaggacgagaactctgaattctccaggctcatcaaggagtactcacggagatccaaggggttctaaagcaccacaaacaattgaacggcggcgaaaccggcatgaagccaactaggcgcaccgcagaacccagcagaaagaccgcacacaccacaacgacctttctccagacgacaagcactcacgaaacccacccagacaaagacgatataggatgtacaatggacgggactagctagattattcaggcgatttggaaaaattatcaaagccatgtaatgcaatagcacagtagcactatgtaagatgctctctgatgtgagaaagatcgagtgtatgtatgtaactgttcaaaaagcatcacctcatttgac

SEQ ID NO: 59306 - DNA, 425 bp, Triticum aestivum
  Clone ID: PAT_TA_59306
gcgtcccgacccctcactcataaacatacacgtaacccagaagaccgttctgtcacgtatacacaacgtatcggcatctgtctatgtcccactcaagcatgataatttgcacaatcagaactcaatgtctggatcacaggcacaggatcgcgagattggcgctccggcagaagacaaatacggacagagatacacgtcacctctcaatgaagcagacaaatagagtaataagtgaactaacgcgcaactaaaacgtctagctcgagtctcttacaggttggagctaaattcatctatatggaaatattgtagcttcgagaactttcgtaggagtctcggtagcataaatactatgaaagtacaaatggtagaataatgttccaggattggtttagatacatcgagatgttaagtggatcgatttc

SEQ ID NO: 59307 - DNA, 367 bp, Triticum aestivum
  Clone ID: PAT_TA_59307
tctgcaactatacagcttcgtatgtagttcgcagatcactacgtcattctgtacatgctgcttccatgctccacttggagatattccaaatgggttgttccactatacgtatccggtttgctacttagagtcactcagataggtgtcaaagcttgcatcgacgcaactctttacgtcatcctcattatcagctccatatccgagaagcatatccgtattcctctaatgatagttttgaccgctatctggtgatctactccttgataacctttgtatcctcttgccagatatgtatcagggcacacatcaagtgccgtacttataataccgtagagccgatgtctgaagcataagggactaccttcgt

SEQ ID NO: 59308 - DNA, 393 bp, Triticum aestivum
  Clone ID: PAT_TA_59308
tcaattccaacgagtctgtaactgcagcgaggcgagcgtctgggacatgcattagtacatgcgattagataatcagtaacacaaacccacaaacggcaacctgcccttgattagataatgccatataaaatccgatggatggaacaacaaggtacgtgcagctgcatgcatgtaaaattgagtccatatccacgagtaaaggctgctgcatgcatatggcagcaagccagccagccagtgtacgtgcagctgcagcgaggcaaagggcctggatggctccggcactcttcggccttcccgaagtcgaagatcacttttcggtcaacagtaagttgaagttactattttcagcccagctgaccacttttccgccgattggaggctaaaaagctc

SEQ ID NO: 59309 - DNA, 317 bp, Triticum aestivum
  Clone ID: PAT_TA_59309
ttgatcctgatgaaaatcagaaacttttgaacccagtaaattagtttttttaattcacataaacgtgattttgatcgtattctttttgatctggattggtacaaacatttctaaggtcttccaaatttggaaaaatttttggagttccagaagtatgcgtttgatgcaaatggcaaaaaacggtccggttttgacaaggtccccttttcaaggggtggttgcctaatttgaagcaaccaaggctaataaaataatttataaaccatagataagttgggatacaatatggttaacacacaaataaataaagaaagagt

SEQ ID NO: 59310 - DNA, 458 bp, Triticum aestivum
  Clone ID: PAT_TA_59310
gcgtatgaaaaaggtagacatcaaaacataaatttgaaaatatgttaatcatgcatttataaaacggtaaacatgtactgtataaaacaatgtttctcatgtaaacaaaaaatatagagggtgtatgtaaaaaagtccacataaaaattactacaaaatgttaatcatgtattaaaaaaatgttaattgtgtgttttaaaaaatgctcctgatatatatggaaaatttacaatgtgtataaaaaagttgacatcaaaatatatatttgggaaacaaagtgtaatcatgtgtttgaaaattttcaaatgtatgtgaaaattgttgctgtataccaaaaaattaatgtgtacgaaaaagaaaatatgcatcaagacttatatttaaaaaaaatgttgatcatgtatttaaaaattgttaaacatgtattaaaaaatatacccgatatatacgaaaaatat

SEQ ID NO: 59311 - DNA, 351 bp, Triticum aestivum
  Clone ID: PAT_TA_59311
gtggaaggcaagcgccgggactaggcaccccgtttctcatcgccgctatgggttcatgacgaagacaattttatcttaagttagaaccgcagcaacaattgatgtaatataactctgcagtactttaagatgaaacatgctatcttcctgtgttgatctttctttgtatgtatacaccctacgcccagtgggatagggttgccggcgcgtaaacccatgctatggcgcttcgaggacggatccttagcagcctgccgggggcgcttgctgccggaaaaaccaacttgccactcttagcgcggccgcttgagctgttgagcggactcaaaatagaacaaggacgttgctaat

SEQ ID NO: 59312 - DNA, 363 bp, Triticum aestivum
  unsure (1)..(363): unsure at all n locations
  Clone ID: PAT_TA_59312
gcggctgcggctgtcttctttccttgcttacgaggcggaggagaaggactacgatgcgccggagcagccggagcggcggcgggtctcttccgcccttgctgacgaggcggagaaggaggatgctggctgctctggcgcgccggcgcaggcagagaaggaggcggagtgccgccacgcgccggagaaggaggctgagtgccctgatcactcgccggaggaggaggcggagtaccgccacgcgccggagaaggaggctgagtgccctgatcactcgccggaggangaggcgaagtgcccttactcgttggaggcgtccagttcggaaggttgatgagctccttccgccataggcatggagtcttc

SEQ ID NO: 59313 - DNA, 107 bp, Triticum aestivum
  Clone ID: PAT_TA_59313
cacatcctaagagattgttgcacaagcttgtgctgacaagccagcatcttcgttgcttcaaatctggccgaatttgtagaataaatacactacaacagattatcata

SEQ ID NO: 59314 - DNA, 376 bp, Triticum aestivum
  Clone ID: PAT_TA_59314
cttcaagacacctgaagacgttcgggatctcatccaagactcatgaacaacaatttggtgaccagtcatcagatatcccaatactactacaagcattggacgaacattatgcgtgtgaccctgcgggttcaaaaattatgtagtgcacaaccgagacacctctccagtcaataaccaatagcgacacctgggttcccatattggttcctacataatccaagatcatctttatccgtcgatgctttatgacatcatacataagtcgctttgtcagtccgtacgttacgtgcacaagattcgatcatcggtatcactatgcctactttaaactcattattggcaagtcgctttactcgattcatagtacatcatcctg

SEQ ID NO: 59315 - DNA, 390 bp, Triticum aestivum
  Clone ID: PAT_TA_59315
gagcgccatacttatctctgcaacaacggtgttgttacaggaatggtggaagactacgcaagtatgcgagcgcccggagatgctttttgcagtttttgcaacatgagtcatattgtagaaaattagatgcggcggagatgttgcattaacttttgcaacaagagtcttgatgcagaaaattagacgcaacggaaaatgttgttgtaatttttgcaataaggatcttgttacagaaaattagatgtgtgaaagatgtgcaagaaattagacgcgtaaaagatgttgttgttgcagaaaattagacacagtgggagatgttgtttgcaatttttccaagggtcctgttgcagaaaactaaagaagaagaagttttgcaacatgggtcctgtt

SEQ ID NO: 59316 - DNA, 359 bp, Triticum aestivum
  Clone ID: PAT_TA_59316
gatcttgagcaaatatcacaccaaagtttgatgatgacaaaaggctatgaggagatgtctattgcgtaggtgcaaaatctccatcgatacagatcgcgctaggtgccagtttttccgcagagaacgggccccgctggtaatgtgctgcaagattgattgacagatcttaagcaggtcctcgcaagtcctcacgccggtgatgatcagtttgtcagccagatacataaggatcgtaatagaaacggggtcaatgcctaacaaccagtaacgtagattgtcaagagacggcgacacagctcatcatcattctcttgtatactctgcacaggctagtccacttttccacagaagactcaatg

SEQ ID NO: 59317 - DNA, 420 bp, Triticum aestivum
  unsure (1)..(420): unsure at all n locations
  Clone ID: PAT_TA_59317
gaaaatgctcaaatgcatgagatgaacacgtatgcaaatgcacatcacatgacgacatgataagagatgcatggtcacgacaacagcacacggtgacaaagagccgaacccgggaaaatagattaacttaacgccggaaacggcaatagttggcgtacatatacggaacgttacatccggggtgttacacggtgtcccaacttagcccatcacaagatctcacggtcattgaaggatattccttctctcaagacatccgataagccggatccggtaacagacatctcaatataggaaacatgtcagcatagccagccgaatgtgccgacatatcccgatatgagctgcacatatctcgttctcacggcacactcagactgtccaaacctccggtaaggcatcccanaattgcccctggtg

SEQ ID NO: 59318 - DNA, 269 bp, Triticum aestivum
  Clone ID: PAT_TA_59318
atgtacacttgtttgggccagtgaggtgtcgttgaatatgggccgagtaataacgcaccggaacggacgctgttcttgatgcgcggaatggcaaagcattctttcaccgagtgatggtgattgacgacttgattacagacaagatagattttggtacattcttacctcgaaagataatctgccaaataaagccgtttataagcttgccactttgataatctcttgtactgacacaatttgaaacaatttggaagaattcctttgagatc

SEQ ID NO: 59319 - DNA, 443 bp, Triticum aestivum
  Clone ID: PAT_TA_59319
attacttctagtgtttcttttcttgcaacgatttgcaataatatgcaatcgagtcgatatccctgtgattaaccttttaaccacaataccgaagaatcagtgatcaacaaattgatcatatttcccaaggactacacttcacttgaccaacctactctacatctcataactgatgtggttcaaactgatgcatgcatcgatgatggcctcgcgggcccacagatggaagcgtcacacgtacgtcctaggataaccacctcctgcatgcatgtggcccaaagaggtgttgtgtgatgtttgaatagccaatttcacaactttgatgtggcacgtgcctcagaaaccgagaagtcacgacactgagtgaggtgtacttgttcacagacgcgtacgtaaagtaaacaaggcaattatcctcctacctcttcgacgcatactatata

SEQ ID NO: 59320 - DNA, 405 bp, Triticum aestivum
  unsure (1)..(405): unsure at all n locations
  Clone ID: PAT_TA_59320
tcttatacgatggacttagaggattctaccactgcttgcaaacttccacaatggggtagtgctagtgaacctcgcaaatctgaatttagaaattttcttgctagtataactgtgggggaatctagagatatagcagaagctaccatagggagcattcattttcctgctatacattattttgctctcttcataggtaggtgcataaatggtaaagatgaagcatgtcacatgtgtgtccctgaccttcagtattcttaggagtgctgtgttaggagacaaatcttataatttgggagccattgttgcacgtaggttgcatcataatagttttaatggagatttctttgcangaatttatgcaacccgcttagctaatttcctggtgtggacatacgtgatgatgat

SEQ ID NO: 59321 - DNA, 380 bp, Triticum aestivum
  unsure (1)..(380): unsure at all n locations
  Clone ID: PAT_TA_59321
agagaaggtaacaccaaaggaaaagaaaacacgtacacagaaagtgaatatagaagtgttcaagactgtgaagcgggaggttcctggtatatctacgtttcattgtacttagttaagttgatgttactgttgttttttctcgctgccgccatgccatgaacaggcgaggcaggcagcttctcaaacttgtgttgttgtaacttgtatgatgggagcttaagtacattactttgtttcataaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaanaaaaaaaaaaaaaaaaaaaaaaaaaaaaaaagggggccccccaa

SEQ ID NO: 59322 - DNA, 318 bp, Triticum aestivum
  Clone ID: PAT_TA_59322
gccgtcgatcatgtctgactaactcccgtcgcttctgctctccacatcctacgttaggtactgaagcccgtagataacttttccgcccaggtttagaacgtcgctgcaaacactacgtatgaaaattgataaatgagatagctcctagtgatgtttctcgctgaactgctgcgatgttggacactttgtcagcgacaaggagttatctcctacgcgacccatcgtggtattgtgtacatttgcttaaggttttgcttatcgttgttatcatctatggtatgcaattcatgggtcggcaatcataactcatgcaggagc

SEQ ID NO: 59323 - DNA, 439 bp, Triticum aestivum
  Clone ID: PAT_TA_59323
agctgaacaataagagtaaagtacccgcagttgatgcaataaagtatattgcaatgtccgctggggagtatcaaggtgtgtggctaggaaggttacacagtgatctcatggatcgagatccaacaagtggtacttaatgttgatagcaagtcttaatttttttctacgtgaagatccagcacgccatgatagaagcaagcacattaatacggtgtatcactacataaaggactgcatggaaaaagggaaagtcaactacatttacaccaatgatcagatgatagatatgctaaccaagactttggaccgagagaagtttttgaagatacgaagaaggatcgacgtccgagttgtaatatggtgacgtggtgtttagggggatgattgttagaatttaacacgtagtcacaatcctggctcggacgtaaacaggacaccg

SEQ ID NO: 59324 - DNA, 402 bp, Triticum aestivum
  unsure (1)..(402): unsure at all n locations
  Clone ID: PAT_TA_59324
ggcttccatcagacaggaactttggaaatttgctgaggaaggttcactangcaaatttcgttgaattttggcatggggcaatgttattgacagaaaaaggtgtcaaaaaagtttggggtcaatgatgcaaagataaatgacacttccttctcaaaaatccacttanggcagaatgagaaaaaggaatatttgtgaattatctttgatgatgccaaggaaggtttttgacatatctatggaagatatgacccaaacaaaattttgagaactatttgggaatttggggagtgacggaaaatataggttgtttcacaaactaatggcaaaaatgatgattcctttaatagaaaaaggaatattcccaataaaaaaatattgggaatggcccaagatgaaaatgac

SEQ ID NO: 59325 - DNA, 374 bp, Triticum aestivum
  Clone ID: PAT_TA_59325
tcgatacatcaggggaggcaaattgaggggaggcatgatggttcctaatgagaggcacttttgtatctggaatggagtcacggttcatgactctgttattgcaatttttattcaagcagttgttgacccagggagccactgtttttttatgtacgttgggttcaggcgggaatatctatgatagcccacagttatttgtatgtgagaagcatggacagacatagagatgcaggtccgttgatatcactgaggtttgtctttaaagcaaagtggaggcacgcatgtggcttttgtgctggccgaaccgtgcttctatttttctttagtccccatgtagtatttgcacgatagggtcatcttgtttgcttcctctc

SEQ ID NO: 59326 - DNA, 381 bp, Triticum aestivum
  unsure (1)..(381): unsure at all n locations
  Clone ID: PAT_TA_59326
ggcggataccaaaaccatcgcactatataataacaagcaatacaatagtaagaaaattagacaagtatctatctaaagtaagaattttttttctttcagaaagaagataagaacaagaggctcatcacggtggtgccggcgacgagatcggcgcgggcaatcgacggcggtgaagacgggaatgggacgtgacgggccgctaaacctagacaaatctcgaggaaaatggagctttgaggtcgagcttcgagagaagaaagcttaactactgtggctcgggcatttcatcgaacacctcatgtgcatangaggtgagctagagcagcacaaagccctcccctcgccggccagagaaaaacagagcactggagttgctctgct

SEQ ID NO: 59327 - DNA, 181 bp, Triticum aestivum
  Clone ID: PAT_TA_59327
cttcatagcaaaattacacgagagagagagatatcactggtaatgttgctctggaagtatctcatgctatgggatcaacacaaaaatccagggcccacgtgtggatcacaatccaccaatgactgaccaggggttcttgcgcacccaaatttgttgtgaccaactggttgaactccctccg

SEQ ID NO: 59328 - DNA, 385 bp, Triticum aestivum
  Clone ID: PAT_TA_59328
aagcactatgtatctatggaaatttcagttttggcatcgagcatctctcttccctcacacgagtccatgccatgattagctgcaaatgtgctgtagcttcggaggtgaatactgtgaaggatgcgatacgagaacaagcaggtaacttgtctagcaaacccacgatcgaatttaccacaataaatgaacacatgataattcctgatcacaaagcaaagacagcagcagtttcccctaaaatttggttaaacgggtgtatcaacttcagacaaactgcctagcatcgtaagaggtcaggatggagtcaattttaatcacatgtggctgaagcactcatgcagaacaggacacgcgacttcgtcttcctctctagtactccctccgt

SEQ ID NO: 59329 - DNA, 377 bp, Triticum aestivum
  Clone ID: PAT_TA_59329
acgtatacaacgtatctatagtttttgattgttccatgctattatattatctattttggatgttaatgggctttattttacacttttatattatttttgggactaacctattaaccggaggcccagcccaaattgctgttttttgccaattttagagtttcgccgaaaaggaatatcaaacggagtccaaatggaatgaaaccttcgggagcgttatttttggaacaaacgtgatccaggagacttggagtggacgtcaagaaacaatcgaggaggccacgaggcagggggcgcgccctccaccctcgtgggcccctcattgctccaccgacctacttattcctcctatatatgtccatataccccgcaaacatcca

SEQ ID NO: 59330 - DNA, 325 bp, Triticum aestivum
  Clone ID: PAT_TA_59330
tccatgcaactttctactgttccatttattatgacatgcatcatcattgtcatattgctttgcatgatcatgtagttgacatcgtatttgtgggaaagccaccatttataattttttttcatacatgtcactcttaattcatcgcaatcccggtacaccgccggaggcattgacatagagtcatattttgttctaagtatcgagttgtaattcttgagttgtaagaaaataaaagtgtgatgatcatcattagagcattgtcccatgtgaggaaaggatgatggagactatgattcccccacaagtcgggatgggactccgtacg

SEQ ID NO: 59331 - DNA, 393 bp, Triticum aestivum
  Clone ID: PAT_TA_59331
tggctacaaagtgggtggtgggtgggcctcgaatttcttcgccgtccgtatcccaaccatgctgaccgtaatccggccagggctctcctgacaaagagagagactttagtgaattcaggatgtcgccaaaaggcgagtgctgaaagacgtccgcggcggtgaactccatgatcggagcccaatcgggtttgatcggaaggggtgcggaggattcggagtccggaacggagtccggcaccttggaatcacgggccttgcaaaggactaggctggtatttggctctatcgccgtaaagattgcggctcctggggcagcgtccaatcgtccgtccttggttggtgtagtcggctccgggataatggtcggagcggacacctgagccgcgctctggg

SEQ ID NO: 59332 - DNA, 287 bp, Triticum aestivum
  Clone ID: PAT_TA_59332
ggagcaaatggagcatagccacctactgatcacctctgcaggcgaacgcgcacgatattgctgttatttacacgaaacacgaataatacaggcagacgaaacaactaggcgattggcggccatgaaatcttactactggggggtgcagatatgagactacttgtgtaccttatatggtcagggatgtatacgtgcagagaataccatgatatgtgctacatgtaaccgaattgtgcactaaacttgctggatgctgctgatgtcaaaaaaaaaaaaaaacttgctgg

SEQ ID NO: 59333 - DNA, 104 bp, Triticum aestivum
  Clone ID: PAT_TA_59333
accttcaaactgctcaggcattcaaaaaagatgaccttctcttctttggtcagagcgtagctggcacgaccttgaaaccattccggatgccggtcatcagggac

SEQ ID NO: 59334 - DNA, 423 bp, Triticum aestivum
  Clone ID: PAT_TA_59334
tggcgcagtggcgccaacacttcccgcgggacatcatcaacgagcgcgggttctatgcgcaaaggagggcggagagggataagatgagggcagagcgaaccgcctatcgcgaggacaagcgtaggcgaaaagtggacgctcaattcaacatgaggctaggagcagcgtcgccttgggaattggacgacgatcggtatcttctcgcctacagtcatacgtcagaggaggacatcacctaggaggagtcagacaacaaggagtagttgaattatctttttttaaccaaccatgctgagaactatcctctactctatctacttcttgagctcagcactgtaaacactttttttaaagcgccgcgcattgtgattctgttggagatgctctaacatggcagatgagtgctttaatgttgcccacaag

SEQ ID NO: 59335 - DNA, 229 bp, Triticum aestivum
  Clone ID: PAT_TA_59335
agtggaacaggagagatcgaagtcgcgctaagtgctgtatatatagcaaaggctttggtcccggttcgtggcactaaccgggactaatgccccctttagtcccggttggtgccaccaaccgggaccaaaggcttcgctacacccgcagaacttaacgagacttcgctctctcctgcgctactcacgcagccctgggcgctccggcccggtctctggaggcgctccagct

SEQ ID NO: 59336 - DNA, 396 bp, Triticum aestivum
  unsure (1)..(396): unsure at all n locations
  Clone ID: PAT_TA_59336
cacttgtaacaacctgngagtttccccttttttttccttcataatttcggtttttcaaaatgtttaatctcttgagccatgtgtccaaatactgaaccgttttcattgttagatttatcaccttgagatattcgaaactggatcccaagttaatagatttccatgatattgtttccatagaaaagttgaaaataaaaaaaatccaaaagagtgaatacccaaaaaacaaaatccaaaaaaggccaaaaattggttcatgcaaaaaaaatgatgaatactgaaaaaagaaggaaaatattgaatcatggaagaacggtttgcagttttgcactttttttggaagcacatgatgtgcttttcctatttttgaagaagcataattaaatttgtgctttt

SEQ ID NO: 59337 - DNA, 385 bp, Triticum aestivum
  Clone ID: PAT_TA_59337
tgtgattatttgcttatggtgggttccgggagggattgaaacctgtaccccaagttgtgagtcgttgcatatgggatgaagagggcaatttatcttaaggtcatagttgagtttgccttaatgaacttgttcgtatttgtggatatttgctaatagttctaatcataagtgcataaaaatccaagaaagaaatagtatgttagcagaggcctctcccacatataaaactacaatgacgattatcgttctgttatcaattgcctcccaaaataagagtctctaccttagtacaactttgtactaaagttagtccaaagtcaagacacttatttcgggatggagggagtattaggataggaaataccataataattttcttgaaaca

SEQ ID NO: 59338 - DNA, 378 bp, Triticum aestivum
  Clone ID: PAT_TA_59338
caggaacagatgatcacacaatatcttttgataaatcctttttacctagcttctgatttctattaccagaaacagattgtctgttcttacaggaaacatctacaaacagccgttattcgttattgtgctcttccatgttgcgccgctgacaagaggatggagggttttagtcgtcgtcgcggagaagaagggtaaccaccaagcaggagagagggaggaaagctatgcccgttcgctggaagccaggcaacccggcgccatcgtcgaggagagcgaggaggggctagattacgccgccacagaggtgagctacgaggggctgcggcgtccctgcataggaggggggagagaagccgccaccgcaccacgtgattctgc

SEQ ID NO: 59339 - DNA, 346 bp, Triticum aestivum
  Clone ID: PAT_TA_59339
cgcggcgtgcagctgcgcatcgccgatggcgcgcaggtgaccgtgcagtatgcgcacaacgtgatcatccacaacatccacgtcaacgacctcatcgtgggcaagggcggcaggatccgggactcgccgcagcacgccgggttccgcacccagtccgacggcgacggcgtgagcgtcttcggctccaccgacgtgtggctcgaccacctctccctcgccacctgccaggacggcctcatcgacgtcatcgaccagtccaccggcgtcaccatctccaactgccacctcacaaaccacaacgacgtcatgctcttcggctccagcgacagcaaccccaaagacgaga

SEQ ID NO: 59340 - DNA, 386 bp, Triticum aestivum
  Clone ID: PAT_TA_59340
aagtggaaatcattcttcatttctgagcgtatgaagctgcttcgggtccttgatctggaggatgcaacatcagatataacggctggcgatctcaagaaggtagtgaaacggctgtgtcgcctcaagttcctctctctccgagggcatactgagatcgatcatctaccaagttcattaggggatctcaggcagctccaggccttggacgtcagggacacctccatagtgaccctgcctgcgagcatcaccaagttaaagaagttgcagtacattcgtgccggccgtggcaccaccgtctcagcactacctgcttcatcctgctggttgcccgatttctgcaagtgccgtcaactagttgatgttcaagtgcccggggaaattgggaa

SEQ ID NO: 59341 - DNA, 437 bp, Triticum aestivum
  Clone ID: PAT_TA_59341
tagaaggaagaagaaacacaaaggaggcagcataaagctcaaactacactgaccatgttgccacttggccaatatgcaaattcaaatctacaaccaacaggacgcatattcagtttccaactacaactaagataaccaatccaccggaactgaataacagtgttctctaacttccactaaatggaacttagtaaaaggtaaatggtccatactcgattattcaccaagagaatcaagtactcagatttcgcaatctaggtgaatgagtggttggaaggatgaacaaatgaataggcttgaaaatgacaatataggacttaagaatgcctgtttacataatactcctccgttcacaaatagaagatgtttttgatatttcaattatggactacatactacggaatgaaatgagtgaacaaacacactaaaatgtgtct

SEQ ID NO: 59342 - DNA, 444 bp, Triticum aestivum
  unsure (1)..(444): unsure at all n locations
  Clone ID: PAT_TA_59342
tggcgtaaaccgtagggtgtccattggtggagccatgatgcaagcatccaaaacagacatattgtatacgaagaatgttcatgctgccaagagaagtgaagacattgcccatttgtcccctggatgggcgtgtaactagagaacaaaacactatggcggcaaacgagactatcgaaccgaactgattgtactgaaaactaggacctaaacttgtgctgctggccaaccttttcttcagggaatgccaagatattcgccaaacaaagccataggatggtgctatacacagaggacaacctatcagcaagtcgggctccagtgtgtttgggtcagcgtccacggaggagcagataactgacgacatttacgnctgccgggttcacaatcctcatcacacatgaccacaacccacccaaccgactgttacaatggtcgtggagcttc

SEQ ID NO: 59343 - DNA, 230 bp, Triticum aestivum
  Clone ID: PAT_TA_59343
cgtatgtcatatttaggtaggaattttagagttccagaactttgcgttacttacagattgctacagacttttctgtttttgacatattctgtatttcttgtgtggtttgcttattttgaggcatctatggatattaaattattttataaacaatattgaagttggaatacattaggttaatcaccaattaattaaataaggatttaataacgttacctaagttggaggtt

SEQ ID NO: 59344 - DNA, 359 bp, Triticum aestivum
  Clone ID: PAT_TA_59344
cgctagattttgttgcatttaatgaaaaccttagaaaaaaggttcctaccaatattctagttgatagaatttctgaacttaatgacgattttgctattcgaaataatgagctaggatattctctcgaatataggctcaccaagttctgtcaaaagaatgcctataatgatgaattggttatgcaatatgaagggccgaaggaggaacctatacctcctaaggttgatcttggggatttttgtcccattaaatttagcccttttgattacttttgcttgccacaaagaaagcttgctgccgaacgtagagagtatgaaatgagttttaatgatctatcttattattatggcagtacctag

SEQ ID NO: 59345 - DNA, 436 bp, Triticum aestivum
  Clone ID: PAT_TA_59345
cgcctgtacagcaggtgctacgcacgacagatcttccagagtcttcgcgtctggatggacgagcgcatggaggtggagccgttgggcgccgtagtggcgtcgacggatggccggactggcaaggatgatgcggatctctctcctgaagacgggtcagtggtttgatgatgatggcagcttgtaaaacgtgtgcgtgtggtgtacgctttaggtctgctgcaccggctgttggttccgatacgttatgtggatgaatcggcaatgacaccggttttagatatgaggagtgagagcactccacattatcgcgtttgtaggtgtgaatggtggcttcgggtgacctgacgtatgttttggtcagtcctttgctgaataagttaataaagatggccgtatgcatcaattgatgcagaggccggaggtctcaacctccttt

SEQ ID NO: 59346 - DNA, 438 bp, Triticum aestivum
  unsure (1)..(438): unsure at all n locations
  Clone ID: PAT_TA_59346
tacatccccagagtccaagtccatttgatgaggctggtgtcgctgcctacgtgacccagaggggtagtaatactgaccacacacctgtacatcggcctcgtgtcagtgttagcgtcagcggcgtcgcccctgacgcacactatagagacggggcggcggcctacgcgggcctcgccggtgcccacgatcaagaggaagacgctgccgtcctcctccgagactagcaggaggcggtgatcctccagcgactccgacatggtgaacgggtagcacatctcgtacttgatgttctccgccaagggccagcaatggacgaagggctccttggaggcatcgaccaggccgtccatgaaatgggagtggctgttagggaacatgcgcaagttgantatatgagcaagttactatgagatttaatccgaataagcacaaaataaa

SEQ ID NO: 59347 - DNA, 369 bp, Triticum aestivum
  Clone ID: PAT_TA_59347
ggctcaacggtcgctcacgacctcattttgccaaacgtgtgtgccaggagggcatatcccggacggtttctgggtcgtgtgggaaggaccccccctatcgcccacactcacttggcgacggttccaaatgtcgtcgcggaaaggggtaaagaattgtttgtttaggatcgacgcgcaccagtgatgcgcatgtagttcaaatttgaattatgcacataaatgcattgagaactcagttaatgcataaaaatgtccaaacgaaccccgaaaaatcataaaaattcacacaacgctcccgttgttctatgttgacacgagaaaaaaaaaatgaaagcaataagaggcaatggatatcgtttcctccccaaa

SEQ ID NO: 59348 - DNA, 372 bp, Triticum aestivum
  Clone ID: PAT_TA_59348
gattatgacatacatctgcaccggcgtcactgtcctgactgcctaccattttggtctaaccggcctcggtgcctcttgttggcgggttgctgccgcttcggcatggcgtctcgaattccatccctataaaataccatatacacaaggtaggtgaagtgtctaaaatgagatgcctgcagttgggattttggttattcggaaatgcgacgcatggagctgtccaagatactcggacgtaatggccattatggcatcagcagacctcaattgaaagaactgactgattatcatccccatgaatatgtcaggatcatcgtcgagtccgaggaccatggtccagtcaaggtcatctggttgtggatatgggctgtt

SEQ ID NO: 59349 - DNA, 311 bp, Triticum aestivum
  Clone ID: PAT_TA_59349
agacgctgcatgcaagtatgatcgatcgatgatcgtccgaagcaagtggagtgcagtgcagtcagccagaggaagacgaaggcgtttctatcagtccgatctcctgccccttttacatgatgattattattattatcttagtgcatgtgtatgtaatatccaccatgaactgatgttacagtagactgccacattggtagtgcagtgcagcacagcacataaaaaaaaaaaaaaaaaaaagaaaaaaaaaaaaaaaaaaaaacaaaaaaaaaaaaaaaaaaaaaaaaagacatacaaaaaaaaacgaaaat

SEQ ID NO: 59350 - DNA, 385 bp, Triticum aestivum
  Clone ID: PAT_TA_59350
cgatgacagccgcagttaagcgctcgacggcgacgtgcaaattgcttgctaaacgtacccaggaatgtgtcgtgtcgtgcgcgcgtgtggcccaactgttttttttagcatcagtacagacacaagcgctcatatacacgcgcatacactcacccctatgaacgcacacacgcacaccttacccctatgagcacctccgaaagacggatccggaaacttatgatgatgcacgggtgcggtgcacgtctggtccgaacgttgacgatggtgcccattttctgcagtctgcaccacattttattgacctgcattgtatttgtatgttgggcctggcaagtttgactcctctcggcgagcgtataaaaatgccactgggttgttgttg

SEQ ID NO: 59351 - DNA, 271 bp, Triticum aestivum
  Clone ID: PAT_TA_59351
gaggatcaagaagcacgagctgaaggccaaggctaaggagcttggccctgtgaagaagagcacgatgtgagctccgatgttgagatacatatacgtatagtggaccgtggacgctagcgccatcgtgaataagttatgctctggggaaattcccaagtgaaggcttgtctgtataagaaattcaagcactcattttcattcaagaaaatactgtagaagacaagagggagacagaacacgaactcttgcatctgtacaagaaagcaacgtc

SEQ ID NO: 59352 - DNA, 426 bp, Triticum aestivum
  Clone ID: PAT_TA_59352
ttctacgagaataaatagtgtgccgaatccattgattgtcatcaatttaaattggtgaaggataagcataatgtaattcttattcttgtttcatcgactaaattcaattccttattccggagcctcatcaaaattctcggtttcaattgtttcatcttctcttcccgcaattccaagctctctcaattatatcatcacaaagatccatccaagtcactacaaggattcaccttgtgctttcaacttctctttctttttgtttgatcattctttcattaccggagttcttcatgaaggttctacatgatggtttcatcaaggatttaatttgttctcgaagtgttcatcaagattcttttcagaggagttcaagcattcttcatcttgctatccggagtgcaatttcttctacagtatcatcggagg

SEQ ID NO: 59353 - DNA, 409 bp, Triticum aestivum
  Clone ID: PAT_TA_59353
gcagaagaaagtaaaagaagcattcgaacatgcatggtctggctaccgaaattatgcgctgggtcatgatgagcttatgcctttgagccgcagaggtgtagacggattaggaggtctaggtgctactgttgtggattctttagacactgcaataataatgggtgctgacgatattgtgtctgaagcatcaaaatggattgaagacaacctaatgaaaaagatcagcgagaaagggcaggttaacttatttgaaaccactatccgtgtcttgggagggcttcttagtgcgtatcacttgagtggtggagaccaagcaggaggaggtgattctgggatagcagtaacacctaacaagactaatccagatcgtcttctggcaatctcaaaggatttagcagacagattattg

SEQ ID NO: 59354 - DNA, 426 bp, Triticum aestivum
  Clone ID: PAT_TA_59354
aatgacaacttattccctagtatttggaggtgaagccgttctacctttggaggtacaaatcacgtcattgagagtcgccacacatgaaaatttatcggaagaaaaatcagtacaattacgtctcgatgaattggatagactagaaggaaggcgacttgaagctttgcaaaatcttgaggcataccaagctaggatgtcgcgagcattcgacaaacgagtcaaaagaaggtcgttcaaacaaggagatctagtacttgcggtcatccgtcctatgaatatcacgcgacggatgaaaggaaaatttgaaccaaaatgggaaggtcccttcgtcataaaagaggtttattctagcggcgcatatagaatcatatcaccagatggggaatactcaccggcaccgataaatgagaaatccttaagcattac

SEQ ID NO: 59355 - DNA, 409 bp, Triticum aestivum
  Clone ID: PAT_TA_59355
accatcaaatgcatgcatttatttgtgaacggcaccagtacgcaccacaatagatgttgtaggactcgtttgttcccatgcatctctcaccaaccatgtccctttccttcaaccaacgagcttcaaactggttgtatcctctcggttgctgcaggttacctccgacagccccttaagtatccaggaaaacagttttgtggtaagatttttgttttctgcggttacaacctttgcatttggaaatacaccatgaaactctccattacaaacaaccgtatccagtcgttcccgtggcctcatccttctccatgtaaactgatctccggtaaaccccctatcttcaactcacagtcaatcagagcatcacagaaatcttgcatcatgtgcatcggatgtggagctcgtccct

SEQ ID NO: 59356 - DNA, 426 bp, Triticum aestivum
  Clone ID: PAT_TA_59356
tgcgtgtgagagtgtcggattccgaaacggataatggagaaatcggatgcaagttttgaaaaacatgaagatgaaatgcacatgatgacatgtcaaagagcaacatgcaagcgaatgacatggtaatgatggtgaataactggaagacacctggcgcatcggactcggggcgtcacaactctcctccactaacaaaagatcttgtccagagatcttaggaacgagatggaagtgaaagagggtgaggtaaaacaagagctgaagagagaagaagaacaaagtcgagaacactcgagttgaaaagaggaatgatgaatatgatgagaatcaaagctcaaggattaaaatatactctgaaaccactcctgttagaacaagatataaaaggaataagaatgaaagaactgtgataacatctcggttgga

SEQ ID NO: 59357 - DNA, 183 bp, Triticum aestivum
  Clone ID: PAT_TA_59357
ggtgtagatgtgagcaaagcggcggatgaacggcgaccatggctgcgcgctgccgccgcccgagtcgattagactgaatgtgtagttcgccctgacctcggcgttcctggagaggagctcgaggtagacagagatgtagccattgcactcgggggatgagtatccatcggggtagtaacggac

SEQ ID NO: 59358 - DNA, 420 bp, Triticum aestivum
  Clone ID: PAT_TA_59358
tctccccgaggacccaaccatctgtgttccccaaaaagaaaaaaaaaacatggtagtagtaatgtaatgctgtaatggaattacccgagatgtgtactagctgttttgtggcgcgccgcggcgtcgctgtgagcgagtgtgtacgggctgttccgtggtgtgtgtgtctgtggatgattgtgtgttgcgttgccgtgggactggtgcaagtgtcgtgtgatgtggtatgcgttgtgtgtgggtgggtgctgtatatttgcgtacctctatgtgtactgaccgtgatgcgttgtttgtccgttttatctctctatatattgtccgttgtttgtccgttcggcatcccagctggtgcgtcccagccgagagatttggcacgcggagaggaggaagatccgcgatggacatggggatgcacga

SEQ ID NO: 59359 - DNA, 349 bp, Triticum aestivum
  unsure (1)..(349): unsure at all n locations
  Clone ID: PAT_TA_59359
gatggaggagcanaggatttcattctgaattatttttacatcagttattgattctgttaatacatattctacctcacatgacctcgtcagaaacaagtttgttttacgtatgccatgtactcaaaaaagttccccacagaaaaaagttccaaaatcccgggttcgccttttctgacaggcaattgagcatccttcactgaagttgtgtgtgtgctcaatcagtcttcagccgtgggacttcactgaacctggttcacagagctgttcatgtgaagactgccaacgtcgtgtgttcggttcctgggtgtgctgcttctaccgaatacatccacgacatgaatttgttcac

SEQ ID NO: 59360 - DNA, 401 bp, Triticum aestivum
  Clone ID: PAT_TA_59360
ttctgcgaaaggtaaactgcatctgcatctcttagatggagttcacagatttgctacctttaggttttcttcccgcaaatgaatctttctgaattaatagttaccagaacggtatttgctacaattgcttccttcttaagctgatcaggtgtttgtttttctccagggagatgtgataacaagtttcgacggtgtctcggtaggatgtgaaggaacagtaccatttcggtccactgagcggattgctttccgctacctcacaagtcaaaagtaagtgcttcctcacaagtaccatcattttcttaatcatcttgaagtgcttttcctaacctttttaatttatttatgttctgttctagggcagaacattttttgtcaccagtttctaatggtccggaaat

SEQ ID NO: 59361 - DNA, 413 bp, Triticum aestivum
  Clone ID: PAT_TA_59361
ataagtagctcataatcaagaaaatatgtataatttgaggatcacgagttcatgacatggtgcttaggacatgggtgcgattcagagtaaattgatctgactggcaatgttttcttttcataaaacttttgatctattcataacatcatggcagcataaagaacatcaaaaataataaaacatagtaagtaataacaattacattgagcatttcaatggaaaataaaattgttgccaatttagtaaggaatattaatgcccatgacaacgcctgggaaaaaatctagttcctatgaacaaagatagaacttggggtacgattcgagtaaattgatctaattgacaatattttcttatggaaaaagtttggttttattcatagcatcattctgataatctaaagcacattaaaa

SEQ ID NO: 59362 - DNA, 367 bp, Triticum aestivum
  Clone ID: PAT_TA_59362
atggggaatggggcagcagcgggcggcgacggcggtcgcggtaacgctagccgccactcctagagggaggagaaaacgagagaggcgaatgaggagacgaggacaggaataggatctatggttcgatgcattttcacctcttttgtctattcctatacgacacagtaaaaatccaggtggcatagcccatcggccgctctttacgcgtgccttattgttatggatttttatctcatatgtaaagttatatgctacactccaatgagacaacaattttatggtctttcaggtattatttaacatgtgacttggatcagtcttatttcatactatcagtttacgggctacagaatgaagcaattaaaga

SEQ ID NO: 59363 - DNA, 247 bp, Triticum aestivum
  Clone ID: PAT_TA_59363
cgtggtgcaccagtggcggccaccaggaaggcgccttccggcagatcctgcggcgggagtaccggccatgcctgttgatggccatggcgtggggggtgttcctgagaggcatcgacgtgacgcgtgtcggccttcttctcaccgatactcttccggaccataaggttcggtagccactccgccctgacgggcaccatcatcctccgcctgatccaacatccgaggtagcaactcctccggcgtctcc

SEQ ID NO: 59364 - DNA, 397 bp, Triticum aestivum
  Clone ID: PAT_TA_59364
caggcttttgttttcgttctggagcttttagccccatgaaatggccaattgcacgtgccactagcatcaacggtgagtcgtgtctggcatcactttctctattgctacttccatcgccctgcactgatctgcaaatgcagctcaacattcattttattgaactagtatatatattgaaaaagagacgacatcacaaagagtgtgctaacaagaatggaaaatcaatacactagtctgtcagtgagtgattgtgtgatggcctgtgctcacttatgtaccagccgttgtcatttgatcggagtaactatatcattgtgggacacttgcaacggtaggaacgtgtgttactatttttgggaccccctgtgaacatttgaacaaaaagagcaaatgtttc

SEQ ID NO: 59365 - DNA, 120 bp, Triticum aestivum
  unsure (1)..(120): unsure at all n locations
  Clone ID: PAT_TA_59365
tctangccaatnacgaggcgtcctgcagctaatagctacagcgatcgtcgatcgtctcaggcatcaccatccccattgcgacagcgaacagggcacaaccataggcgcgggagcactaat

SEQ ID NO: 59366 - DNA, 421 bp, Triticum aestivum
  unsure (1)..(421): unsure at all n locations
  Clone ID: PAT_TA_59366
gcaccctcttggtgaagttgttcttgttggggaaggacttggccttgtctttgcgaatgagctttccaccattgtcttccctcttctcataggagaaatccaccataatgtggctcacattgccacaattatagcatgtactcacacgttgcttgcccttggagccacttgagttgttcttggagaagttgggccttgagtttctcttgttgccccaaaattgccttcatacaagagccatgtgctcatggtaagcatattttgtgtcttcggggcaactctcttcctcctcctcctcctcttcttcttcttcttcttcttcttcttcttcttccaggatagccttggccttcaaagctaggttgggtgaggatttttcgaccgttggacatgagctagagcgttgtcngcggtcttgttc

SEQ ID NO: 59367 - DNA, 426 bp, Triticum aestivum
  unsure (1)..(426): unsure at all n locations
  Clone ID: PAT_TA_59367
gctctctttggtgtaccttgctgatctggttccgtcgccttttgccgctctttttgactctaatcgacttgtgttctctctctcgcatacctcgcgtgggggctaggcaggtgccctcgcaagtgtttttctttctccctgccttctgccaggtttttcgcgaggcccctcgttcgagcccacaagttggtgcatctctcctaatccgtgcccctccggtaccgcgatatgaagcgttgggtcaaggcttgggcgaacgataagtttcccggtgaagtttcctagcgagcttcctaacgaattttttctgcagttcctgagcgaccactaaggtcaagacgagcacgaggaaacaagtgcccagtgaagaagaagctaccccgaacgcgcaaagctaagttacctccacacanaataacgacacag

SEQ ID NO: 59368 - DNA, 185 bp, Triticum aestivum
  Clone ID: PAT_TA_59368
gagagaatcaaaactggagggtaacctggtcatttcgctgctttttcacctggtcggaaaaaaccccagcgtcatgtattcggaacggagggagtaatacgcaccatcacgcgtactactattcgtacaacaaattacgtcgaataaacaacaaattgacttgcctgggtgccaagttgttcttg

SEQ ID NO: 59369 - DNA, 242 bp, Triticum aestivum
  Clone ID: PAT_TA_59369
tacggcagcgagaagacgacagaagtcaacggttacggctgcaaaaaaacaacaaaatcaccggacggcgcccatatttgctacgcaactgagaacgtcagctaagctcaaagtgttggggcatttggaccacctgagtatgcgcttgtcccattctgacttcagtgggcgctagattaattagccgctctccatgattgaaacttacattgcatctgtccgacttccttacccgccgctct

SEQ ID NO: 59370 - DNA, 423 bp, Triticum aestivum
  Clone ID: PAT_TA_59370
ttagcgatatactgggatagtttcttctcagcttgtggatctgtttttttgcaactcaggttatgttactgcattgcaaattagtcgagataagcttgtgtaatcctacatttttctccttgggttcatgttctcggcagaatgatcaggaaagctgtgcacgttgtggtgcatttacaaagacagtgagatggacatttgttttttgtttagctcatgcattgcttgcatatcttttttggtgattgatctttatctgtggtttcgatgctatgagtgttcattcacattagctctgtttcttttaacatcactagcaaaagggcccgtgcgttgcaccaggagaacgaaatcacatgcccctaacccaataagaatcaatcttagaaatagtcatgtaataagagtcaatcggttacaccc

SEQ ID NO: 59371 - DNA, 379 bp, Triticum aestivum
  Clone ID: PAT_TA_59371
gaggaatagccatccagggtcaagcccctggcaaaatcgtaagtgtccggatacccaaataacttatggcgctcctctattattcggtattttctgacgccgaattcaatcatgcagtctgcccaaggctcagcttggcgattcgtcgagcggctccttggattcgtcggatgtgaatagtgcttcacttccgacggcttcctccctgctccctgcggacgacgccgaggtggagtcccaaaagggactaaaccaggaggaggttgttctggaggtgccgcaaggcatcctcctggactccaggcccaaagggggtaaagccccagtgggatctaagtccggccctgggccggacactgctacagaaccatcaacggtt

SEQ ID NO: 59372 - DNA, 377 bp, Triticum aestivum
  Clone ID: PAT_TA_59372
aatgctgcagaaggatagagatatcaatgaagacgtgagccatcgaatcaaagccggatggatgaagtggtgccaagcttttggcgttctctatcacaagagagtgccacaaaagctaaaaggcaggttctataggatggccattcgacccgtaatgctgtatggcgctgaatgttggccgactaaaaggcaacattgttcataagttagggatagcggagatgcgcatgttgaggtggatgtgtgaccacacaggaaaggatcaggtccagaatgatgatatacgtgacagagtttgggtagcactgattgaagagaggcttgtctaacatcgtctgagatggttttgggcatattcagcgcagaccccaaaagct

SEQ ID NO: 59373 - DNA, 427 bp, Triticum aestivum
  Clone ID: PAT_TA_59373
atcctagctgaggaaatccacaagacccccctggcaagcgccatgccggggacgactacaacgccatggcaagacccttgccgggcccccggcaagacccttgccgaaggcatcagcggggccactgccaggcccgcgccagccaaggctccgccaccgttcgcatacagctaccagcccaaccagctgggcaggcacctgcgtggcaacatgcggcttacaagccaactcaccaagcacctacgtggtggcatgcagatcttcgtgaaggccctgccatcgcgccacctcagcagcctgcctgcctacatggcactgcacacatcgctggcctgggcgcgtgtcgaagcgaggcggagcggcgacggatgggacgggcctcgttcccatccccgataaagctaatggacacctaagtagcgcattt

SEQ ID NO: 59374 - DNA, 427 bp, Triticum aestivum
  unsure (1)..(427): unsure at all n locations
  Clone ID: PAT_TA_59374
gaatttcatttgtttgggagcgggattttacttcagagaagggcgctgctttttctttgagaggagaaagagaaagagaagggcgctgctatcgcgacatgggccgacccagccgcgcgggatgcgatattaaccatgtacacaaaatgttacctcccaaaaaaaatgtacacaaaatgttaaaattgaccatgtacacaaaaaatgttgattctcaaaaaaaaaaagttaagaatgtattataaaaatatattacatatataccaaaatttacaatgtgtataaaaaaagtaaacataaaaaactaagttttaaaaatcatttatttcagaaatatttagcatttgtataaaaatgattctaatgtatatgaaaagtgttgaatactctctccatccggaattgcnttgtccagaaatggataata

SEQ ID NO: 59375 - DNA, 247 bp, Triticum aestivum
  Clone ID: PAT_TA_59375
atggtcacggtctacgagggcggcggagggacagggagcatggagctggaggtgtgcctcgcccctgatgcgctcgccaggctcgtcgccgacgaagagctgatggccgcggtggtaggagggccgacgtactgatccgcgatggtaggtgcatggtgcaccaatgcgtcgaaggagtttgccattcagaatttcagacatacaatggaagtctactgtattatttttcctaaaaaagagtgtattg

SEQ ID NO: 59376 - DNA, 420 bp, Triticum aestivum
  Clone ID: PAT_TA_59376
ggcgggagctttgtaccaccacgctggtagaccttcttacccccctcaaccaacaagccctcgctatcactatcatcagaaaagctgtcctcgccaccatcagcaaggtcactagcctctagagcccattgggatgaagactttgggaccggagtctcctggggcaaaggctcggcggcccgagcctcgtcggtccgaggctcgtggaccggagtccgagacaggtccatgtcagacgggtccacctcagacggagcagtcctgtggtcgggagaatcatctgggggtggcggcaaggaaggtgcaccagccttcctacctctcccgctgccatgtccacctctagcacccctcttcgtcttccctcgacctttcctagccgaacaagaaacgcccaacggtggtgtctgcatactgtct

SEQ ID NO: 59377 - DNA, 373 bp, Triticum aestivum
  Clone ID: PAT_TA_59377
gcactgcatggagtagggtccaagtctcctggatcacgtttggttggaaaatcacgatcccgaaggtttcattccgcttggactccgtttgatattctgcaaaaaatagcaattctgggctgggcctccggttaatcggttagtcccaaaagtaatataaaagtggaaaataaagcctaatatagtccaaaacagtaggtaaagtagcatggagcaatcaaaaattatagatacgttggagacgtatcaggcatccccaagcttaattcctgctcgtcctcgagtaggtaaatgataaaaaagaatttttgatgcagagtgatactttggcataatttgaatgtaaatcttcttaattgtgatatgaatattt

SEQ ID NO: 59378 - DNA, 401 bp, Triticum aestivum
  Clone ID: PAT_TA_59378
ccatacaaagtcatcaagaactggaactacaccggcctcgtcgatgccatccacaacggcgagggcaactgctggaccgccaaggtgacatgcgaggaggagctgatggcggccattgcgacggcgaccgaggagaagaaggactgcctgtgcttcatcgaggtggtggcgcacaaggacgacaccagcaaggagctcctcgagtggggatccagggtctctgccgccaactctaggccacccaacccgcagtagacattatactagatctcgattttgatgatttgagcgaggcattttcgatttactagaatccagcgtacgtttgattactactcccttcgttcctaaatacggatgtatgtagacatgtttctagacattttgaatgactactacat

SEQ ID NO: 59379 - DNA, 372 bp, Triticum aestivum
  Clone ID: PAT_TA_59379
gtgccaaatagaaccgttgggaagacttggggaaagtctttttgatcctgctgtaaaaaacagaaactttagtgctcgcgagaattgatgccatttttttattggagagttctatttacttaattctttttgcatatgattaatagataaattcctcgcgtccagaaatttattttagaatttttggagttccataagtattataaacctacatattactacagactgttctgtttttgacagatactgtttttcgtgtgttgtttgcttattttgatgaatctatcactagtaacagagtttataaatcatagagaagttggaatacagtaggtttaacaccaatataaataaagaatgagttcattacag

SEQ ID NO: 59380 - DNA, 404 bp, Triticum aestivum
  unsure (1)..(404): unsure at all n locations
  Clone ID: PAT_TA_59380
gaagacgtggatgatgacgacgatgatgcagacgaagagtatgaggaggaggatgatttgggagaggagatcgatgaggagggtgatgaagatgacactgttgttgaggtacttgacgtgcccagtagtgatgatgaggaggatggcatcgatgaggatgatgatgatgatgaggaggaggttgaggatgatggtgatggtgaggaggctgagccagagagtagtggaagggttgctatggcggtggggggtgttggagaagagattgatggacatgagcaaggtgaaggtgatgatgaggatgagaatggtgagatcggagaggaagatgaggaaagattggaggatagtanggtttatgaggaggacaacgatgatgacgatgctgatgatgaggatgaaga

SEQ ID NO: 59381 - DNA, 401 bp, Triticum aestivum
  unsure (1)..(401): unsure at all n locations
  Clone ID: PAT_TA_59381
gtacagccgtgccgacggtcgtactcctccgtctctcggaggcggaagctcggcggcggcgagaggccgtagttggtccacttcctcgccccgtccgaccggacgcgccgctcgcgctcggggtcgcttccgctgtcggatctgctcccgaagctgcgtctggagctccacatgcggccccacatggtggctggaggcggaaggtggtcgccggcggcgagaaatgtggagaagggggtgggaattgcgtggctcggcggcagcgggggatagggtttcgacccgcaaacgcgtcgtggaacagtagatatagtggtcggggcgtgcggtttgcgggccgcggcaaattttgttacgggccggacgagtatgtgggctctgttctgancgaaaaattgggt

SEQ ID NO: 59382 - DNA, 381 bp, Triticum aestivum
  Clone ID: PAT_TA_59382
ggtggcaagagggcgtccggcttcaatagcttgtctcagcctgagagaaggaacagcagcaagaagctccagcgccagctttccttgcactattaattttagttgcctaattcgttcatcattcatccatcattttgctgctgaagtgtattaattcttggttctgcttactagattccaccttatgcgctagctgttggcgcaagtacgtcaatcacctcaaaatttagtagatttgaaatatcgttttcattagccattagtctctatgttgaaagagtttctgttgaagaaatagctagctaggcctacaacttttcccatgtctttttgtttgatgtctggatgttattggaaaccttaagtttctgttgaagaaat

SEQ ID NO: 59383 - DNA, 302 bp, Triticum aestivum
  Clone ID: PAT_TA_59383
tacggctacgagaagacgacagaagcgcgggatgagtgcatggcgagaaggacgctcgccgcgcacacggactacatctacacccaggagaagcacaactagtagccttcatatctgcgtccatgtaatgtaatgatgttagtcggcactgcgtccgcgtgttcgatctctatcctatagcttccttcataaaaaagggaccgatcccaccgtgcatgcatcgcatgcatgcatggcgcacttatgtattgcctataatttagtaattcgataatcaaacttggttttattgctcggtttgc

SEQ ID NO: 59384 - DNA, 405 bp, Triticum aestivum
  Clone ID: PAT_TA_59384
aaaccatagcaaggcacgcaaacatcgtctggcagtcgcagcgattgtggaggactacgtgaacttgcccagccactcagaacaacgcgacgacgacttgatatcatcgccaggacgaccgggcttcatgtaagaccgtatcataattgccacaccagtgaatgatcatcgtctaactcccattacacttctgtgatcacctctcctctactagcaccgcagcagcagcagcaagggatggagtaccgaacgcagcacgaaggcagcgtctactcggacctcatggagacgttcttggagtaacaacgcaacgcatgcatgcatgcgtcgatcgatcatcctcactacgacatgcgtaccgactttatgttttcttgttcccaccttttgttttgttccaaccaa

SEQ ID NO: 59385 - DNA, 445 bp, Triticum aestivum
  unsure (1)..(445): unsure at all n locations
  Clone ID: PAT_TA_59385
atactgtagactgcaacattagcctgtataaatcatccaaacccctcaagttcatctanggatgcangtgaccaaagtatttgggacctcatctggaaagcaaaggtgcctgagaaaattagaatttttgggtggagagtagccacaaataccctggccacaaaaagcaacaaatttaagaggacgctcgaggtggactcgacttgtgacatttgtggcaatggcgtggaggatgaacatcatgcggtgatcaattgctcgaacagcagggcccttcgcgttgccatgaggaaggagtggtctcttccatcagagaaatccttcagacatacaggtanggactggctacaggcgcttttggacaaggaaacagaggaagttagagcaaaaatcttaatgctgctgtggagatgttggcacttgagagaagatatcctaagacaca

SEQ ID NO: 59386 - DNA, 429 bp, Triticum aestivum
  Clone ID: PAT_TA_59386
gattatatttataaaacttgtcatgattatgattacccttttctgaacattactcttttaatgtggaaacaatttttagtgttcaagtcttttatgatactcttactattctgaatgggaagaattttgcttgtagatcatgaaaagaatgctttaggtgctggttatattattgaattcattcatgatgctacttaaaattattatgagtgaggaatatatgcttgtaggaattgcaataatatcaagttccctccccacgtgcttaaaatcttgaagctatgcttgttttaccttcccatgctagttgattattgttcccctaagttgtttgctcacaaaatccctattcataggaagtgggttaggcttaaatgtgctagtcatatgcttcatgatgctcccgttatgtttcaattcttaaccttt

SEQ ID NO: 59387 - DNA, 414 bp, Triticum aestivum
  Clone ID: PAT_TA_59387
ccttcctgcggtgtcgctcccataatctcatctcctgccctcagtatgatatgagctccgacgagggaaggacatgtcggtccgcctgagcgccctttaaatccgccgcgtccctctctttggctttaatcaggggctgattcccccgatgagtcatgtaggcaataattctgcagggccaaagcggcggcaggcatccacaccgcaccgcactacctggccctaccctacgtacatactccagcacaccgacgtactacgatgtaccctacactacacagtacacacaccctaaagacggagatcccccatgatcatcatcattagtgctgccatgatcctctttaatctgccgtacgcaccagatataatactgtctccctcccagtcccagttcaagcactcgttctgctg

SEQ ID NO: 59388 - DNA, 217 bp, Triticum aestivum
  Clone ID: PAT_TA_59388
cagggctgtcttcaggagggatggctcctggcaaaaaagttactaacttagggaacaataaattaacaaacaagttgggaatggaataatttttgggccccggattggttccaaaagaacttagaatacataacaaattcaacccccccccttgcccccaattgtataaaatgtgcaacaatcgtccaatgacagttcttgaaatacccacttgttg

SEQ ID NO: 59389 - DNA, 427 bp, Triticum aestivum
  Clone ID: PAT_TA_59389
tcgtgcgatggtgtcggcaaacgatggcctcagtgggtggacgccgacacatgcagctggtgcacgatggtgacttcatggagctcatgttccaagcaaccctctccttgttggctcaggaggttcgcgatcgagcttgggctgctgatacctcttcctcgccgcccaacaggaatagcatgagatgagcagccaatccctcattcctagctttcataccaagattctgtgcaccggttcccctacggttgaagatggagagccattggtagtagagagggggaagggatgtagagacggaagcagcttcacttgccccgtctcccaccccattgccgatgcagcggtcgaaggagttgcggacctcgccaacaagcctgtgaccctgcatcagcgatggcttgatgtacgcactggaaacctccta

SEQ ID NO: 59390 - DNA, 307 bp, Triticum aestivum
  Clone ID: PAT_TA_59390
cgcgagctgagcaccagatcaaatttcaactttaccggctcagtctcacaaagacgttcataacagtgagtacatatatgcgtacatgttctgaggaaaaaactcacagctccgaataaaacttgaccaagagttgtaaatactccaagttgctagctgtgatgcatgaacgctacgtggtagtcgatccaatgacctggttcagcggtactctgatcggctatgacatccgcggccggcccgtcttgacagccatcactccacgccatcgatggtgtcatgcacatccgatacaaaggagtgatac

SEQ ID NO: 59391 - DNA, 265 bp, Triticum aestivum
  Clone ID: PAT_TA_59391
agtagaacttggtttgaataagttcttgaagtacatgattgcattattatgcagacgagtatgaggaagttctctgtaggaattttatgtggatgaagtgttcgactaatcaaaagagtctcaatatgagaacaaggaagaaaagcatgaagatcaagattgggatgcacacggcaaccaaggtgaatatgcagaggtactcaagcatcaagacatggagatgaagaagaaggcgtcgactcatacgacgacgaataacaataag

SEQ ID NO: 59392 - DNA, 430 bp, Triticum aestivum
  Clone ID: PAT_TA_59392
tcactcaatctctctctctctctctctctctctctctcttttttgagggactcattccttcctcttaattctgctagtcagtggcagaaaactctttgtggaagggaaatcccatgcggctgtagccaaatagcgctattaattttccttgaaccagataagtgtggcgtgctctcagttgttgtaggagatgggatcatacggacttgtatttgtaatttgttttattttggaaggtacgtacaagtaaattgaaatcttgttcatttcttgggtgtgacaagtgctcagttgacttagatttggttaagtctaagtcggttgatatcagcatgtttctacgttatttttctatttttatgttttcctacatttttttaagtgcaggtgaaaaaattaagaatttaaatatgttttcgccttggaaaat

SEQ ID NO: 59393 - DNA, 385 bp, Triticum aestivum
  Clone ID: PAT_TA_59393
tgactcctgtcagcaaatgttcagtggtggtacatatggtacatgtgaagttatcatagacatcagtggtggcatagaatcctatgcaagtattgctgcggatggtatcggaagcggagcgctcttgatggcaatgaagtaccatgtcagtatatcaaatagtcctttgtgggattacatgccaatggttttctacatctgatcatctccgaaatttttgcaccgtacttcagccatgttatgccgcgtttcatcttttgcttgtaaagatagtacatcaaccctttatgtgggaaaagccgatagtggttagatgctgtgtagaaaataggcatacagggaacctaacaacgacattttccgcatcacggtctattccttgcag

SEQ ID NO: 59394 - DNA, 395 bp, Triticum aestivum
  Clone ID: PAT_TA_59394
catcttcaaggccgtagctccgaatttaatgaactttgtatgtaacatgactagaatttcgtgtagatcatcctggtgcatcttaacttgctgtttaacaacttgtacataatacttattcagatctggaccaatttcgaaatttgcttatgaggacttacccgatttgttacatgttgtttccggcctcatttaaacttgctttgatgtgttgctctagtatgtatcatatcttgccatgagtagcgtaaaatagcctttgtcatgcatcatgcttggttgtgcatcttgtcatgtttatgtgttgtgtgtttaccatgtggtttgctcctttccggttgtgcttcttctcgatagttcctgtttcgttgcgatcgtgaggattcgttctacta

SEQ ID NO: 59395 - DNA, 404 bp, Triticum aestivum
  Clone ID: PAT_TA_59395
gatttagaaggtactaagtaaaccacacctacatatgcaaactaagtgttgttttgacctcaaattgcatataaatcaaatactaccacatataattcctcccaaattactaaaacccacaaattaatcactatataaaccattgcaagagctaatctagcaatgagagatgaaaagacaaagttgctaacctttgtgaacatttgaatggatgggggccttcaaatcttgacaaaatttgggcagaatgtgtgatgagctcgaggaagaagggaagaacagagcacgggtggacgaagggtttatataggacggcctttagtaccggttcgacgcacgaaccggtactaaaggtgctggaggggccccagactgacaacatcctgccaccactctctttagta

SEQ ID NO: 59396 - DNA, 153 bp, Triticum aestivum
  Clone ID: PAT_TA_59396
tagaagcaagcatgcacacaaattaagtaaactttattttgccacagctttagttaaccgataggctcaacatggaaagacacgaagggctgtgtccatatatagaagttgcctgtttgttaaagaaaaaacaaagaaacacaaaataaagaa

SEQ ID NO: 59397 - DNA, 381 bp, Triticum aestivum
  Clone ID: PAT_TA_59397
atcccggaagtcacgaggagttccggaatggtccggaggtaaagaattatatatgggaagttgagtttcggccattcggaaagtttcggggttcaccggtactgtaccgggaccaccggaagggtcccgggggtccaccgggtggggccacccatctcgaagggccccgtgggctgaagtgggaggggaaccagcccatagtgggctggtgcacccccctggtccccccctctgcgcctagggttgggaaccctaggggagggggcgcctccacttgccttggggggcaagtctccccccttggccggcgccccccctaggagatcccatctcctagggccggcgcccccctggggtccctatataaagaggggggttgga

SEQ ID NO: 59398 - DNA, 423 bp, Triticum aestivum
  Clone ID: PAT_TA_59398
gatgatggagccatggatcgtgaggaggatctcttcctctcctcgttgctctccaagttggagacgctggaaaacgatgatgatccggacggtgccgaactgagctccatcaatcctcacccggagagcggcgaggaggcggggccaggcgacgtggcgaaagacctgagcaagatcaagaggcagaacatgatcacccacatcctgctcggcacggtgatggtgatgatcgccgcgtggcagttcaacgaggtgtcgttcctcctcgcggtgcagaagaagctgaccaaccctttcaagtccgtcggggacatggtcaagagtaccctcaagatagggaagaagccggtggtcgaggcgatcgaggcgtcgcctctgccccctgtcggcgtcccggacgttggtcgggctgatctgccgatg

SEQ ID NO: 59399 - DNA, 415 bp, Triticum aestivum
  Clone ID: PAT_TA_59399
ttcttattgttgaaaataggaattatgtgcccgtagacttcgttgttctcgatatagattgcaatcatacttgtcctattattcttggtaggccttcccttagaacgattggtgcaattattgatactaaagaaggaaatattagattccaatttccattaaggaagggcatggaacactttcctaggaagaaattaaattaccttatgaatctattatgagagccacttatggattgcataccaaagatgataatacctagatctactcttgtttttatgcctagctaggggcgttaaacgatagcgcttgttgggaggcagcccaattttatttttgcttcttgttttttgtttcccttttagtaataaataaatcatctatcctctgttatgattgtgtttcttatgtttta

SEQ ID NO: 59400 - DNA, 423 bp, Triticum aestivum
  Clone ID: PAT_TA_59400
tcggctgcatgcatggtctggcctccatccacgtctgatctggccgatgcggcctgctcgctgcgcgacggcggagatcgatggcagtcccgtgcacacgatgctggatggaggttcgtcgagcagatccgggtgaaaaccttgctctgggctagttgccaaggccggcaatggaaacgctcttttgtgtcgcccccttcttgaaggcatcgacatggagaagctccaaacctctatccgctacctccagggaaaaccctacaccagtcgattggatgatgtcggcgctcttgtgtcgtcctccctgggggcatcattcttggaggtgtgcattggctcgagggaccagtggacggtttcaatggtgaagcagcatttcatgtgacacatcaacgacgtggagtcttggcggcatggtgctgc

SEQ ID NO: 59401 - DNA, 403 bp, Triticum aestivum
  Clone ID: PAT_TA_59401
ccaggaacattgataaacttttggttgatgttgattctcttaaacttagatcttctcctcctaagcatgatatcaataagtctctcaaagtaatgggaatttccattgatgagtgtaaggaaagaaccgctagattgcgtgctaaaaaagatagctttataaaagcgtgttcttctagtttccatgaaaataatgattaggatcttaaagttattgatgcgtctcttattagatctatgttttgcaatatgaattttgatgattatgggactgatgatgaatcaactttgcctataaggcgtcccaagaattcggagtctttagattttgatgcgaaatttggtaaaagtgagattggagaagtcacaactttaaataatattgaacccactagctcggaatt

SEQ ID NO: 59402 - DNA, 404 bp, Triticum aestivum
  Clone ID: PAT_TA_59402
acagtcaaaaacatgcattaagattaaccaacaattagtgcaagcatgagtaggatataaatcaccaagaatataaatatcgtgaaggctatgttgattttgtttcaactacatgcgtgaacatgtgccaagtcaagccacttgaatcattgaaaggaggataccaccctatcataccacatcacaaccattttaatagcatgttggcacgcaagataaaccattataagctcctagctaattaagcatggcatgagcaactataatctctaattgtcattgtaaatatgttttcatccgtaataagttgaatcaggaacaatgaactaatcatttttacaaaaacaagataggtcgagttcataccagcttctctcatcttaatcatttcatcatatatcgtc

SEQ ID NO: 59403 - DNA, 311 bp, Triticum aestivum
  Clone ID: PAT_TA_59403
atgagttgaatcgcttggttaccttccggcgttgatagttttgtttccaatgctggcaccgtgaacatcaaacgttgcggaatatgtgcctgcggctgctgttgatattagtatccacacattaaaattatatgggatgttccattgtcttgttcaccaggttatgacgctttgggcatggttttaactgcactttcgatttacattgacatgtgacacctctacttgaaatactatttccatagctatacctatgggaagtatctaccatcgaatacctgacgttacccaacttaaacaccttaaagcga

SEQ ID NO: 59404 - DNA, 438 bp, Triticum aestivum
  Clone ID: PAT_TA_59404
gcggcgggcggcgctagggttgggccgcgggtggctggcttcggctgggcctccccccggcttataaagcctagtgggccgggagtccgagtcggacacgacccctaggtcggttagtttttttttaaattattccgctcggaagaaaaataaaaagaaatactaaacggactccaaaaattccgaaataaattttcacgggcttctaaaatcaagccgcacaaggtgaacatttatttgggacctaaatgcaatttcgaaaaacgcacatttttcctaaattcaaataaaacaccaaaaaaatcttatttgatttttattattaaatcctcaatatttctttattttgggaaagtcattttattccctctctcatatttttgtaatagaaataattgatgataaaataaataaaatgaaatgattctattctcaaaa

SEQ ID NO: 59405 - DNA, 364 bp, Triticum aestivum
  Clone ID: PAT_TA_59405
tacggctgagagaagacgacagaagtcaaggggttaaaaattgtcagtactcaatgatgtatcgcgacctgaacgacataagcgacagatggcccttgtacaatcatcagaagcagagaattccgcgtggtggagcgcgtcgtgcgcgaggaatccggggcatccatgatgcacacccgcaccaaattaccaaaagtgggcgcttgtcatgcaagtcaagcggcaagtcgctcgtgtctagaaaacggtgatcaaagatggcgccgaccagaacgactaccggcgcgcactgcagcttattctcaccggcactcgcaagaaattcaaataaatgtgttgaagatcatcaaaggaaggaaaaaga

SEQ ID NO: 59406 - DNA, 390 bp, Triticum aestivum
  Clone ID: PAT_TA_59406
gaggagcgagcagccgcgacgagtgcccctgctaccgcgacatgctcaccgccgggcccaggaagaggcccaagtgcccgtgatcctcgtcggtcgaccgtctgaacggaccaccggcttcaacccccatcctaccgagtaccgacaagagtaatggctgtgtgatattggacgcgcgtgcttatgtaacttccctgtgctgtgtgctcgtgctaaatattggtatgatacgtagacgtactctactagctgggatcctcgagtgagtgagtttgctgcctgtaaattaacaagtgtgtgtgtggctacctgtgtactcccatgtggttgtagcacgtactcgtagtagctgaaaaaaaaaaaaaaaaaaaaaaaaaaaaaagcggccgc

SEQ ID NO: 59407 - DNA, 437 bp, Triticum aestivum
  Clone ID: PAT_TA_59407
tgttacttgcatgttttcaattataattgtccgttattattattgtttcgtcttaagtgagttaaccacatcaagtgttggtgcctggacacaaaagagagagaaagagagagagagagagagagagagagagagagagagagaggccaacagaaacagagtggtgctctgatggatacaacgctcgtggtataaaaaggtgcctggtccaattaaaagagtgcatccttatgattgtgtaaggtttggccaatggaaaatgaatgttttggtgtcatcatgatgatacagccatacaagaacaccatgaggggtgttacatgcacgtttccaattacaattgcatgttcattattatgttttactctaaagtgtgctgaaccacataaagcattagcgcctagatacacacacaagagatagatagatagagagag

SEQ ID NO: 59408 - DNA, 330 bp, Triticum aestivum
  Clone ID: PAT_TA_59408
agctccgtagcctcgctcctcgcgacgccgctggacgggctgcccgccgcctctggtcgcctctggctgcactgcctagacgcccgatgggaactcttcttctctgtcacgtcgctcttctaggtctgtattcttctctgtttctctgttaacatctacgtgaatagattgatggatagatgcatgtattgatgaacaaatggtactgctaatgcattgatgtagttacggtcttttaatagcaaactagcccccctatgatactgtgtattatactttactgctatggtggttacacttttcctgtccgtaagatcggttaattacgat

SEQ ID NO: 59409 - DNA, 420 bp, Triticum aestivum
  Clone ID: PAT_TA_59409
aaggcaccatactattatgagtgcggtgatctagaaggttcagtccgccaagagcggactgactgaagcctgtgccagccttctaacaggctttgaggtaagtaaagaatatgtaaaattattatcgcatagatagtaacccatgatgctctgttcggcgttcagaaagaaaagccgaatagaggatctaataatcgcgggagtctaacataatcaagtcaatatgtgtacgcaggcttcgctgctggcctctgctgcactgactgcggaggtggatacgctgtagcagaaccttaagcggtccgagcaagagctcgtcctagccaagcagcagctcgaggagaaggatggtaagaaataccttattgaaatatgtgaaaggtgcaattgcaaaaagtgacaggattaacgcgggtattg

SEQ ID NO: 59410 - DNA, 405 bp, Triticum aestivum
  Clone ID: PAT_TA_59410
atcgatgaagaacaaaacaacctcctctcgactagatcgagcgacttgggaggacagaatcaagcgtggctacgaacactggctcctcatctcttgtttttctccaacatttcatagtactcggttgattgatatggcatccgtgaataagtcttgaacaagctacacctgaacaggggtttttataagttcggcatcatggaattccttttgttcctcatgcgaacctcatttcatgaaaggttcagtctattttttttcttctctttttgtaagtggaaacgaaacatggaaatagaacgatcacatgattctgcagtgtatactctcgtgtgataaaactaaaagagatggtaagatggttttagaatgacttgttcaatacttatcacacatttagctaac

SEQ ID NO: 59411 - DNA, 312 bp, Triticum aestivum
  Clone ID: PAT_TA_59411
aacagcaatcagtagtagcacaagttgatctccgcataagtgttcttacatacaacgacggagatcttagatacaggcaacttgattaattgagaggttgtcagataattgtgtcataattggtaaatcccgtaccatgcacatatggtgcaccttgaagtaaagaactcgtaccataactgacgtaatgactgtcatgcttacaagtatcactcgtggacgagttatggaccttgcatagcaatcgagaccccctatgatcatgtgtataatactttactgctataatgattacacttatgctgaacgtaa

SEQ ID NO: 59412 - DNA, 304 bp, Triticum aestivum
  Clone ID: PAT_TA_59412
ggagcaggaagctttcgagggtgcgtgccctatttccgagtagcccgccctctgagagcgagttttacccccagtgatctcttgagaaataaggagaaaagccggcaaaccctccaagttgatgatctccctcccatgtttatttgtatgggtgaatagcgcgtcattgagctgctcatcccattcgctcgtctttcttcagcaattacatctctgttttgactttcgagttggatgccaaacttgactcaactgtagccctaagttgttgttgatgatgatgattcttcctttggctttggtt

SEQ ID NO: 59413 - DNA, 415 bp, Triticum aestivum
  Clone ID: PAT_TA_59413
ccataattgggcccaaatacgtagcaggccgttaacggtcttaaattgacgatgggctggaaactgtcaaatctagaattggcctttgatgggccaattctatgtaacttgtatgggccatgcttgtaaatgggcctgactcaagtaggccgctaatgggcaggcccgcttattttgatagtcccggccttttaacctgaatgggccactgttgggctgagacatgtgtcaacgtatcataggcgtgttccgtccattcgctggatgacaactgtccgaacgccgagccgacacatggatctgccggacaatgagaattttacacatggaaaatccccattggtctacgctgttaacgggttatcggatccaaaccggaacccgatagcttaatggcgaccagttacggtggatg

SEQ ID NO: 59414 - DNA, 409 bp, Triticum aestivum
  Clone ID: PAT_TA_59414
ggcaagagacgtctcaatgttgagaggactaaatatatgcaaaagattgtttgtggatgctcggggaaacctgagcagcagaatagcagatcttgccgttgcgagtgccctgcgatggtgaggttactaagagctgcagacaatggatggtacattgctgagcatcgggcaagccacaatcattcgctatctcttacatgcggggaaaaggttcactggccatcccacaaacacacagatgtgtacacaaaggatctcgtgaaacagcttagggaaaacaatctgaacctcaacaaggtgtatagcatagttgggagcttcttcggattaacacagagcgtgccttttacaaaaaggtcattgcgcaatctgtgcgggagaataagcagagaccaagttgatgatgatg

SEQ ID NO: 59415 - DNA, 431 bp, Triticum aestivum
  Clone ID: PAT_TA_59415
gactcggtgacgatatacttgtgccgaaggttactttttgagttgagtcgatcccggaacaggagccatgcaaagatcttcgcgtgatttggaacgcgtgaagaccagatggcaatggcatgcatgtcgtcgtcgtcatcgtgggagcccatggttagcgcgtatgctgccctcgtggagattcatcatcaccacccttgatgtctctcccgtctccacctttcaccttggcaccaacacccaacatcaccgacgcagtaatccatctatagttctgcacacaaaggccggggaaaagacaggcacaacagctacgagctcatgcacaggatcatagtctggcatgaatttcacctgattttgttcacgcgaatgatgcaacagtacttgttggatcgtggtgaactgtatatttaattttctcctcaagg

SEQ ID NO: 59416 - DNA, 335 bp, Triticum aestivum
  Clone ID: PAT_TA_59416
ctttcagtttagagcagcaatttctgtacatttttattgatatattcggttgattgatcacacttgctgatcaacgccaatctgatttgttctatgacctctgcatactttttacccctcagtaattcaggccattgtctcccatgtaagaacgagatgcttacagtaatgccctacagaaagtcagtgggcacataatcttggtgctcacgtgttggataaaaaaaaaaaaaaaaaaaaaaaaaaaaataaaaaaaaaaaaaaaaaaaaaacaaaaaaaaaaaaaaataaaaaaaaaaaaaaaagataacacaaaaggttaaaaattaaattaa

SEQ ID NO: 59417 - DNA, 202 bp, Triticum aestivum
  Clone ID: PAT_TA_59417
tcgtactcaaactaattgtacatatggagtttcgatcttctgctgttgtggcccggtttaaaatgccactgacaagtagtcttactggcgcatttcctatttcgcagtaggaaatttctgcagtgcaggcttcataattgatctgtatactccatagccgtatgtacattcagtttcagggtatgtgcaactgccatttctc

SEQ ID NO: 59418 - DNA, 382 bp, Triticum aestivum
  Clone ID: PAT_TA_59418
gaggatcaattgctaggaaaatcacatcgctcatcctacgaccgccagccatcactgacgcagcagaccagtgtaccgtcatgtatcccgtttagtgcatacctctcgacatctctgcagtccaccggattcaccatctctaacacacgcatccgcttaccttcactcaacagccatcaagcaaggcgtttaatatcataatctccacatcccagccaatctacctggtcgcacatttatcagaccatcatatcacattctatgagacattctatgagaccaatcctcaataccgacgattctatgcctaattctataatcatatcagatcacacgccgttcaaggttagtcttgtaatcagttgaatgcagtctccaagac

SEQ ID NO: 59419 - DNA, 440 bp, Triticum aestivum
  Clone ID: PAT_TA_59419
ttcccactcccaataatgggttgtgcttcaggtgtgaacaaccagggcatcgttctaaggaatgcaaccagaaccagaatcaaatggcccttccagcaactggccgtggaagcagtggtggcagcggcgtcggcggtgcggggcagtggcggtagcggcggtgcggggttcgagacagggcggctagggttttatcccaggacgggccggcggcttataaaggttgagcctggaggagtccgggcctagcacgacccgtaggtcggttcagttcttttgaaatagttacgctcagaaaaaaaaaggactactaaacggacttcaaaaatcctgaaataaattttccccggcttccaaaatcaagccgcataggatgaacatttaattggggcccaaatgcaattttgaaaaacatgcaattttcccaaattccaattaaa

SEQ ID NO: 59420 - DNA, 387 bp, Triticum aestivum
  Clone ID: PAT_TA_59420
tcgtttccgttcagcgcattgcccttgacatccatgtatttttagaagttcatccaatcgtcattttgatcagcgatcacgtcatactgcatatcctctatcgaggtagatgcttggatggacacaatcagttgatctccgcaccttagcagattcaagcaacaagtgtgtattgccatcaaattgactttggagagatggcatgctcgtttaggccacccttccttcttccaggaccaaacacgttcttagtagaaataaactctctgttgttggggagcataattctgagacgatttatgactcttgccagatagcacaacaccatcagttgccttaccctgtttcaactaccaattcggtgaagccattgtaactcataatttc

SEQ ID NO: 59421 - DNA, 283 bp, Triticum aestivum
  Clone ID: PAT_TA_59421
tgattagagatgagaggttaaaataattcataaattcgcaaaatactagattcacaccataatcttttttaaaaggaggcactataccctcgcctactcatcgccccgacgagcatgccgaggagaccaggaggcacacatccaagggagtgggtgtgggctagggttcatcttctgatattgccaatcgtgtctaccgcccggtgaatgccaatcagacgtgcgcgacaaaccttacttgggcctgcagccagacattttgactgcagcaccgatttcacgc

SEQ ID NO: 59422 - DNA, 290 bp, Triticum aestivum
  Clone ID: PAT_TA_59422
atacggctgacgagaagacgacagaagtcgacggggaaaaatcaagaaaaataaaaataaaaaaaaaaataaaaaaaaaaaaaataaaaataaaaagaaaaaaaaaaattaaaaagaaaaaaagaaaataaacaaacataaataaaaaaagaaataacatcaaaaaaagcgcctgtcttaaagtttccaaccttctttacccttccagacaatttcaacctccgcaaaattttccccacatattcatttaagggaccttctttttacaagctcttgatgggaaaaccctg

SEQ ID NO: 59423 - DNA, 416 bp, Triticum aestivum
  Clone ID: PAT_TA_59423
gtctagcagaacatctctcacagattttgccactgattcgtgagtggggaagatatagatgccaggcgggatatggtgagatacaatgccgatgtctaacgacagcagtgggtcgagcgacacgggcttctgtccagcgacgccaagaaagaagcggtaatgacgggcgccgaccagtctacgcgtattatggtcttacagtccaattttgtgtttttcatatcaacatgattgttttaccgtcaattttctgaatattgttagtgactaactatttcctaattttgtttatttaggttgaatgttgtttcattccccacgcggctgaatccaactcggtctttatcctgccttggagttctctctcataactgaagccacgaggtattcgatttatcggatttcgagctacctgc

SEQ ID NO: 59424 - DNA, 354 bp, Triticum aestivum
  Clone ID: PAT_TA_59424
tgctccaatggcgtcgggttcgctcgggcggctcgctccgctacacttccggcgacgaaacagggtcagacaagctcattgtggagaggggaaacgaggagagcaagcggtgcggctggagatccccttacggcagcgataacgttcggcggcgacggcggtctgtggcgcttccccgcgagatcggttttttcctaatcgaggcgtgcggcgagcggaagaatcgggagaaagggtgcggcgttcctcgcggagtcttgcccgtgtacggtgtctctgaggagcatgggatcgaacatgggcgcagatcaatctgggctccgctcggcctgttcgcgctgtgcgtccgtccca

SEQ ID NO: 59425 - DNA, 370 bp, Triticum aestivum
  Clone ID: PAT_TA_59425
aatgcttcaacagtctgccatacatgatatagaccgtagttctttttttttggcaaaaacaatgtgtattcaactgacattgagtggttttctctccaagaaaactgacaatgagtggttttgcgacatagagtactcaacgaagcagtacagagctccatgggagggatgcggcacgtgaaattttgttcactacgagtgactttgtatggccggagcatggtctagtttgtgcacaaagctttgtacccagcgatttagttactaagttcagtaattcattgaatcaacattgcttggaatccagggacttaatgctgtgaactcgtttcttccaaatgaatcaacgtggcttttttatttatatgat

SEQ ID NO: 59426 - DNA, 380 bp, Triticum aestivum
  Clone ID: PAT_TA_59426
caaaaagaggcaaatagagaaagagagggaggatagagagagagggtgaataaaacggcaagggtgaagtgggggagaggaaaacgagaggcaaatggcaaataatgtaatgcgggagatagggattgtgatgggtacttggtatgttgacttttgcgcagaccccccggcaaccccgcaaaaaatcctcctggcaactccggaacactgccttgggattcccccaagaagaaaagaagattccaaaaagttaccttagttattccccaagtttttgaaaaccaaggtatcaatccagtaggaggctacgcgcgagtccctcgtacctacacaaaaacaataactcaatgcaaccaacgtgcttaaggattgtcaatccc

SEQ ID NO: 59427 - DNA, 430 bp, Triticum aestivum
  Clone ID: PAT_TA_59427
atctccctctcattacattatttgccatatgcctctcattttcctctcccccagttcacccttgccgttttattcgccctctctttcccgtctgtctccctctttcgcttgcctcttgtatgctcgttgtcatggccagctcggtcttcatcccttcgtctcccgacattgaagtccttcacttcaagcatagacaaggagaaaatttaaaagatgcttggtttaggatgctagaatcttatcgtggttgcaatatagaaggagatttcaaaattttacttcacaatttttacgttgggctaaccatatcccatagacaacttcttgattttgctgccaaagggagttttattgaaattgatcctagcttcgcttatgaaattataagggggatagtaggagtactccccctacaaaatgggtcaaccct

SEQ ID NO: 59428 - DNA, 443 bp, Triticum aestivum
  Clone ID: PAT_TA_59428
aggatcgactacagcgagttcgtggcgatgatgaggaaaggggcccccgagggggccaaccccaagaaacggcgcgacgtcatgctataggagacggcgggttggtggaggaagccgccggccgatcggcgacagaacagcaagcgatcgagcgcgcgtacgaggccgctcgcaacgacgacgacgatgggctcgtgtacatttttcacagaaggggtcgagtagcaaatgttcatatatataccgtgggattgggaatcgaaaatgttcgtacgctgtcgggcgctcatcttcttcttctctggttctgctggttcccttgacttgttagtatgtatacatcagttgagtaagttggcattttttagcctgaatttgtacacggtttcaggcttggaaatgtacaggtatgtaacttgagtgaactaacgagtgtgtttttg

SEQ ID NO: 59429 - DNA, 370 bp, Triticum aestivum
  Clone ID: PAT_TA_59429
ggcacgacccacgtaccgccgacgaggcagtggggccccgcggacccaaacaccatcctccgcgtcttgtgccaccgcgacgacgaggccgccaaccagttcttgaagcgcacgttccagctcgccaagcggcggtgatgtcggccaaatgctcgaagaatgagtctaggtgctactatacttttttagtcccattactgcaacaacaacagttgcggctacgtgggctgtatctgtgccagcccaagtgagcggcctatgtaatgcgttcaggtgtgagtgtgccttgttaaatagccgttgctaaagcgtgagggttgaggatccatgtactgccaagtgccaacttccctaaaaaaaatgtactatc

SEQ ID NO: 59430 - DNA, 408 bp, Triticum aestivum
  unsure (1)..(408): unsure at all n locations
  Clone ID: PAT_TA_59430
tactagagtgcatcactttgttacataaagttttacaaaaatattcgaaacgtttataaactacactctgggtttaaaagataaaatacattcaaacttggaaatcatatgaaaaaaaacatgagtgagtagaacatggcattgactctgccacaaactagctatggcaaaagctgtcagcattgatggaggaagtgcaaaatggggacgcatatgcatgtgtaaccaagtctcgaactagatgaacggctgcaccatgcatgggatatcccgtgcatgcagtggcggatccagggcccaggcccaggcctggggcgcggagaagatttccttcgtgtgctatagcagtatgtgcactgtagctgtactgtagcagagtgtancagcctggggcccggggctttgccc

SEQ ID NO: 59431 - DNA, 417 bp, Triticum aestivum
  Clone ID: PAT_TA_59431
gatggccagatcaactactaagagttcgtcaagggcatgattgccagatgagctcggacccatgtgctccgaagacaggaggagaattgtgcattgcacagtcactttaacatgcaactcttagttgatcaatctccagttaagcagcctaactaggctgtagtgctaaaactgatcagacgactgcaattcctgctacgttctccagtgtgtttcaagacatcttgagttttatgtgaacttgtgtccactctgatgtaaccggaatgctgtttggcccgtatgtaatatatttcttcacctggatctgcttgactcatctatcatcaatgcaaaaccggtgttacgtatccgaatactcggtttgttcattcgccacacgtccctagcagaactaaactgcaaactttcccccac

SEQ ID NO: 59432 - DNA, 386 bp, Triticum aestivum
  unsure (1)..(386): unsure at all n locations
  Clone ID: PAT_TA_59432
tggatcatcctcgtgagtccctcatcataccggaaggaaaccaggaaagtcatggtcttgggtagacacgagcttgtccttagtccctcatcgagacgagtatgtccggtatggcatggtgaggtttgatgagtggtgatttattccactagtggtaatattgttggaggatacttggaccacctgactcggtcgtangccgagtcttgatcagtaccttccctatttgttggtaccaccacttgtccctgtcacagacagggtatggtttagtaagttgttaaccccttaccaaagcacacatcgtacagagaggccatggtggaagataccggaggcctccggtaggcatgccacctggtccggnggcatgggtgtttccggtt

SEQ ID NO: 59433 - DNA, 426 bp, Triticum aestivum
  Clone ID: PAT_TA_59433
ccctttcatcttcaaggaaaaccgacgcaagctcaagacgtagcaagaaggatttctggcaccattgtcggggaggtcttcgctcaagtcaagacattccaagtacccatcacaaactcatctccctcgcatttacattattttccatttgcctctcgttttcctctcccccacttcacccttgccgttttattcgccctctctttcccaatctcctcctctctttttcgcttgctttcttccaacttgcttttgtttgctgttatgttggaaattggggaaattatcgtcgatacgggcaataatgataacatggaaaattctgaggctccggctgaagaacccctatcttgcatactaaaaagtttcgaatcggtagtggtaacattattggaaaggatgttattcaagatttcattacttgta

SEQ ID NO: 59434 - DNA, 431 bp, Triticum aestivum
  Clone ID: PAT_TA_59434
tccatcgccgtcgaggtcggcggcgtggagatcgggcaggggttatataccaaggtgaagcagatgacggcgttcgggctggctgagctctgctccgacgccgacgagctcctcgacaaggtgcgtgtcatccaggccgacacgctgagcatgatccagggcggcttcaccggcgggagcaccacctccgagaccagctgcgaggcggtccggctgtcgtgcgccacgcttgtggagcggctcaagcccatcaaggagagcatcgagtccaagtccggcgcccctgcgccatggaaggccttgattacccaggcgaccatggcgagcgtgaacctgtcggcgcaggcgtactggacgcctgacccagccttcgtgaagtacatcaactacggacccgccgtcagcgaggtggaaatcgacgtgctgaccgg

SEQ ID NO: 59435 - DNA, 370 bp, Triticum aestivum
  Clone ID: PAT_TA_59435
cgatgttgctgttgaccatatctggacgcgttcacaagttacggcaccagtttcacgtactagtagcactagtcaatgtgtacgtgcaatgcacgttaatttggaactatattaagtgcatgcagatattaagtaggatattatttgtgtgttattatgtgattagcactatttttggcatgaaattaactacacgctaaacgtgttgagcgctcgacattgaatcagtctaggtcattggatgagaaggaatacatgcggcttgatgacgttttatatttaatttgatatggatctagcagaacattcaatcatcacaccatagatttcattcagtctgactccgactttacattcatacgatgatcga

SEQ ID NO: 59436 - DNA, 434 bp, Triticum aestivum
  Clone ID: PAT_TA_59436
ttgacaagaggagtgtaaccactttctttgaatcatttgcctcgtctctataattgcccgttttagttagtgaaaaaaatcacctaaaaaaagttagtgaaaaaaaaacaagtgaaaaccgtcacggcaattcatagggcaacgctggccgatctgactacccgcgtaaagagatacacgttgtcaagaagagaacatcgttgtttcgttgagattgtcatgaagtgtcactgtcgtcacttctccacgaggcaacggctccgacttcaccattgacaaccgtcaacggaacccttactgaaacaaacgagactttgacaatgagccttgcaagagaaaaatggaagaaatgcccaattttttattaagtttgatattttggatgtcaatatttttctgcttacattgtaccacaaaattgcatcgtgtcaaaa

SEQ ID NO: 59437 - DNA, 443 bp, Triticum aestivum
  Clone ID: PAT_TA_59437
tacggctgcgagaagacgacagaagtcgacggggcctaacgtgtagtaatattgtacttgtacgtaccaaatcaattcgcactttcctcaaccaaaaaaaaaaattgaaagcaataagaggcaatggatatcgtttcgtccccaaaggtgggacattccctaccgaaaaccatcatgcttgttgtgagaagctccggtttgtgagaagcgtatacccaaacctgccccaaatgggacaaaatttgtaccacggcatgttgatgccgctccatgatagcatgccaagtttcttgaatttcagatgacttttggatttacttgaatttaaaaaccaggcatctcaatgttttgctggcaatcaacggtgccctggtgttcgaaattcattcccatttcttgcatgggacctaagcatgcacccaaggacacagatttggtttttc

SEQ ID NO: 59438 - DNA, 309 bp, Triticum aestivum
  Clone ID: PAT_TA_59438
ggactagacgtggtagatcggactcagctctccttcattccgccaaggaaaaatcccatccgcgagcacctccccatacgcacaagaaagcgcacctcccttgtgtcatgcaggaggaaaagatcgtcctcctcccgaacccgtccccctcaaggatgatgcgctgcctacgagactgacgggcagacattctctttgaaagaccgacacgcgtcattgttgatcgagttcccccgtgcatcgtcaaatgagatgccgaaggagagcgccttaaggtcggtctggtcgagaggcaattgcgggaagagt

SEQ ID NO: 59439 - DNA, 444 bp, Triticum aestivum
  Clone ID: PAT_TA_59439
gcaatgaaacacccaatttttttgtgcagttccaccaaaatcgagcatccctgttggcacatatattgagagagtgagattactgtaatagtgggactacttgatgaaacatacactaacaaatagaagcaccgtcattatcttaatgggtaaagttagcaacatagtagtcttgcttaaagagaggtattagtttatttaatcagtgccaattagctcaacactcaaagcattaccatttatcataggttgcaaaactttaatgtgcaaagataaaggagtttctcatgacagtagcacgatacaaatagagatgacaacaaactaatatggatgaaggccttaggcccgtaacaacgtgagaaaaaaagcttattcatgtagtcccataagagatgataaagcactcactggaatcacactatagtatatatttttgtgcac

SEQ ID NO: 59440 - DNA, 420 bp, Triticum aestivum
  Clone ID: PAT_TA_59440
atatgtgataacttgtcactgaacacagaacgttctttcttggtttgcatttggtgtaaccccccttgattgttctttttcctctgtcttataatcctctgattgtcaatccagtcatatattgatgatgtattgatcattgtttatcagaagttttctacacattgctgctggatagagcatctattgcaactacaattggcgatatctacacagatctatacataaaagataataggaagtaagcttctatagtgtgacgtagaggtattggccatacaccatgaatgatagaggttgtgcagctgatattcatagtttaattacttattcctccaaagagatacatatttttagctataatgtgttaccttgctgacagtacatcgatatattctccaatctggttcaactatgcct

SEQ ID NO: 59441 - DNA, 387 bp, Triticum aestivum
  unsure (1)..(387): unsure at all n locations
  Clone ID: PAT_TA_59441
accggagagagagatggggaggagcagagcttcaccgtgggggtgttgctggagtcgtactaggtcgaggctgaccggggacggaggaggagggcgctgacagggacgccgccggttccgtgaagaagaggaagcagagaagcatacgacgaggaagaagccttcggggtcctcgtggtcgcgtgcgagggtgaggaagacgacgaagagggtcggggttctctccccgtggcagcaacgcagacgacggaggtgttcaggccggggacgagcttaagctctcctcatccagggcgacggctatggtgggcgacctacctggtggctgcagcagggagagggggaaatggagagaggagaggctanggtanggtttggagaagtttt

SEQ ID NO: 59442 - DNA, 289 bp, Triticum aestivum
  Clone ID: PAT_TA_59442
aataccaatagtcattcgaagtagaacaagcttatcatggatcaatggaagtttgcatctaacgtgcatgcagtccgctcaggcaggtcaatgtttcagaaaggcactgttcttgttcgcagctcatcttgctatataagcgtattcctactcagaacaatcatctgattccatcttgactgcgactacgctaaaggatccaaccttacatgcccgtgaatacaacctcatatcgcaactatagtgtaacaacgtttcaattcacaggactatcgttttacaatcatct

SEQ ID NO: 59443 - DNA, 434 bp, Triticum aestivum
  Clone ID: PAT_TA_59443
tgtccaaagggtggcacgagggaaagatctacttcgcgccgacgtacaagtacaagctcaactccgacacctatgccggcgagacgaccaaatccaagaggaaaaggagaacaccctcatggtgcgaccggatactgtggcacggcaaggggatagagcagctgcagtacatcgggggggagcaccggttctccgaccaccggcccgtctgcagcgtcttcgtggtcgaggccgacgccaacaacgggagcaggatcaggaacggctactccaccctggactccagggttcattgcgagtcgccgttgccgataccgcagagacacagcttctatgacttttgacctgttatagtgatcctcttttgtcgatacttcttctatacgttacaaggatcagaaatgtctattgagacggggggctgaacgtttttc

SEQ ID NO: 59444 - DNA, 430 bp, Triticum aestivum
  unsure (1)..(430): unsure at all n locations
  Clone ID: PAT_TA_59444
acatcacaccaaagccacgccttcattcgaatcatttttgactgtcccacctcagtgcgttttgcgaggcagtttccttggcacatcttgttgaagcagagatcatgtccccttatcacgggattctcatcaatacgggcgttggtaacccaaccgtgccaatgattacgggacttgggggaaaagcgagttttgccaggctggtggggacacatagccttatccgcccatataaggggataaggattcatccttttatccacgccttcttcctcctttgctcatccatcttcgcacactcgagctccagcgcccaagtccgcatttcccacctcaaccttctccaaccatgtccggagtgggaggcangtggatggtctcctccgtcacgganggaaacatcaagaagctgaggagagccggatacctg

SEQ ID NO: 59445 - DNA, 399 bp, Triticum aestivum
  Clone ID: PAT_TA_59445
tccattggagctgatgtttctgatgctgagcagggaaaggcagttgaggtttctgatgctgagcagggaaaggcagctaaggtttctgatgctgagcagggcagggcagctggagatatcattttggaggaagatccagttgagggtgttgttgagactcgtggtagtgctgctgcaggccaggagaagtctcctgcagcagagccatcagttgatgttgatgctggttctccaactcttcctagtgctggagagccaatggtttttgttgtttcagattctccagctgctccagctgctggtggtgtccttcccgacaatgctgctatgtcaactggagatgatgatgaagagactgaaagcgatatctatgaagcccaaaaaaaaacaacccagggc

SEQ ID NO: 59446 - DNA, 158 bp, Triticum aestivum
  Clone ID: PAT_TA_59446
cggctccgctcgacaccgccaccacggtcgcaatccgcacgtctctcaccgatcacggaatgagggtagaaacaacagcaggatcagcagctcaattgggcatgtaccgtacgatacagtgaaatcacaccgtgtcccagtcatgtcatgtcgactgt

SEQ ID NO: 59447 - DNA, 317 bp, Triticum aestivum
  Clone ID: PAT_TA_59447
aaatgacatgctgcaataagttgacaccgacaaagatggcaggcttaactacaaccagttcgtgtctattattaaaaccggcacatactggagaaaggcatcaccgcactacccgagaggcatattcaggagccttatcatgacgcttgtgacggacggttccgtcaaattggacgtgaattaaaagccatggtgttgacttgtgcatgtatgttacagcatttgggccccacgaatcaacagctcctttaatttttgtcatggtctttttgcgtggaaatttagatcagtggaaccccatcagattggctcacatg

SEQ ID NO: 59448 - DNA, 354 bp, Triticum aestivum
  Clone ID: PAT_TA_59448
cgtatgtagcccttgattatgaccaggatctggatactgccaagagcagctcctcggttgagaagagctactcagcttcctgatggtcacgtgatcatcactggcgcacagaggttcaggtgccctgaggtcttcttcgagccatccatgatgagcattgagtcttctggaatccatgatacgacctatacctccatcacgaagtgtgacgtggatatcagtaaggacttgtatgagcaacattgtgctcaatggtggcacaagcatgttcacaggtatcgctgatcgtatgagtaatgatataaccgcccttgctccgaacaacatgaagattaagttctcgctccacctgat

SEQ ID NO: 59449 - DNA, 391 bp, Triticum aestivum
  Clone ID: PAT_TA_59449
cgggcgccctctcaagggggtggatgcggccggtcggcaagacgggctcctgtggtacaaggacgcaaggcagctcgtcgccggcgagttctcgatggccgtggtccaggctaataccctgctggaggaccatagtcacgtggaatccgggtcgctgagcacaacggatcccaagctgcagggcagcttcgtcggcgtctatgatggccatggtggaccggaaacggcacgctgcatcaatgaccacatgttcagccatctgaaaggatatgcatctgagcagaagtgcatgtcagtggaagtaattcggaaggctttccgagcgacctaggatggatttctcctctctagtcagtaatcaatggtcagtgaggccgcaattagcggcggt

SEQ ID NO: 59450 - DNA, 403 bp, Triticum aestivum
  Clone ID: PAT_TA_59450
acggacccacatggcctgtggatgatgcaacccgaggggcgcccccagtaaagtaagctaaagatgtaaaaagggatacatgccgcggggacaggcccacggggcctgggaataatgcagctcggggggcgctcccagctaaatggacttggaaaatgtcatctggttttgttgttgaaggagcgttgtggtagctaaaggcgcgcgctaaagaaaccgctcctcatgagccgccaaaacccaaagccctcgggaggctctgggggctcgggtggctccctgaggaccatctctatctccgccaggaccacatgatgcccggcctcctgggtttccaggatgctccgtaggctgcgctggaaagcggctgccatgctcggcaggccaaatggcatgcgaacat

SEQ ID NO: 59451 - DNA, 391 bp, Triticum aestivum
  Clone ID: PAT_TA_59451
atgacatagcaagattctcgggaaatgaactatgatagcaagctccaaaacatgagctggttctgctactcacatgtgaatacgttgtcccagacaaacattatcacatggtagtcttacaataaaacactaccgagttcaggtggggaaccatcattaatgacatcgaagtctccacgcgtggaagtccaaggagttcaccttagacagactcctttatctttgaacaactcaatcagtggcttggtgtgctaggatatacatatggaatgaagatgattactctaacagaccacagaattcttcgcacgagcatgactgacttgggatgactccaaaggaggtaaaacaagccttctcaaattcacgacggcaacttacatcaaatgca

SEQ ID NO: 59452 - DNA, 414 bp, Triticum aestivum
  Clone ID: PAT_TA_59452
cccatataaagcgccacatgcgagtgagtgtcctatgacaaccaccgactgcatgtggcccaaacatgtatgtatggaagggttgtgtaatgttttaaataacaaattcatgactttgatgtggcacttgcatcacaaaagggccaatcctagacggtggttgacgacccatagtgtactggcagcccccctcccccccaacacacacaccgcacatccaccgcctctatgaggcatgttaaaattttctgctatgaacatatgtgaccaaaggagtgtcgtgttaaaatttgaaaaaaaaatcagagatcattcaaacacttttgtacattgattaatttcctagggatataatgtgcggaaatcaaattagagctacatgcacacgtgatagtgcaccaaaatggttagaaa

SEQ ID NO: 59453 - DNA, 425 bp, Triticum aestivum
  Clone ID: PAT_TA_59453
tctgcccatgatgtctgatactaactacatgggactgagcatgacagagctcgccgaaagctatgtcttctcccagctcaacgcgcgcagcgagggaccatgatccatccagcgaccacttcatgcaccatcctcttgtgcaatctgtctgtggaactacatgtggtagaatatgtgccctgaatcgtcaacgggtacaattcaccattgatttgcaggctacgattgacatgagactattgttgatgcttctcgacgcctcgcagtcatatgtaactgtctagagtaagttgttcttccacgtactagcgcaacttttaagcgtcagctttttatttcatggcctgttagaatgccaatgcaccttaatctcacctacacgcatggatcaacgtcgaattgagttatacgaaacttggaaaatt

SEQ ID NO: 59454 - DNA, 185 bp, Triticum aestivum
  Clone ID: PAT_TA_59454
atgtagcaaacaatgaatcgatggacatgcatctatcattttgtaaacataccagttgtctcggtgataaaagcataaatgtttcctcctttcagttagtgaatattctcctttggtcctggtttagtattttcggagtacatgcaagttactgtaacttgattgatagtgttgttaagagatat

SEQ ID NO: 59455 - DNA, 419 bp, Triticum aestivum
  Clone ID: PAT_TA_59455
caaagaggttatacagcagggttcacgatgcattcgttggagcattttgtcaaatgacttctcatgcagctcctagcttttcagttaagcatctctgtctattggaattcgcccaatgtatgtgcttgggctttgttttgattgatggaccttaaagctgaagcattaatgcatgaacttgctaaatggatggagcaacaggcatagaagaaatccacaaccaatttttcttggctgcgccatcttccgctgacagtaactctatacaacagcctgctaaggtacgtaagagtgatgataatgttacttaaaggaggccacaacttgcaccaaatatatgggcatgtgcaacggcaacttatgtaaatcgtttctaggtgatgctgatgaatcatgtaaggatggagcataactcacca

SEQ ID NO: 59456 - DNA, 266 bp, Triticum aestivum
  Clone ID: PAT_TA_59456
gcgtatgacattactacatcctaaagtgagtcgtattaaacggttagcgcgcgaacgagacaatttgtggccatccacgtgattggaatttccatttgtaggctttcaatagcaccacggtatgctagagataacagttggaggctttcagtgatagtttgtcttgcaatggggacataatatttctagtgagtaaaagacggacgtgggagagaggaatcagcgcagaggagatcggcgagtaaagaggcagtagaagtaaagaa

SEQ ID NO: 59457 - DNA, 377 bp, Triticum aestivum
  Clone ID: PAT_TA_59457
gctccgcacggtggaacagagagggagccagagaagggggggagaaggcacggggagagtgcgaggcctgggagggtgcgtggcatcgcggacggggtccagggcgacgagaggaagcaggaggtggccaggggaagcaggaggtggccgaggcctctcgggcgcgcgccacgcctcggtccttctggcgaggaggaagacgacagggggagtggagatgggctgggccgtgctgggccaggtaagtgggcgccaggtaacttccttctctctctctcttttatttcttttctatttctgttatttttttttgatttgatttaaaataccaaatcatttaataaaatcctggaaacaattatgggtgctttctgaat

SEQ ID NO: 59458 - DNA, 424 bp, Triticum aestivum
  Clone ID: PAT_TA_59458
atgcgcgaacggtttaactagaccggccgcatgggcaacccgggaagaccggaaggaaccccttaccggcaaaaggtgtgtggcaatttggtccacaaagtggatgaggtgatcctggtcctcatcacaatcggcctgcttgcgctccaacctgctcccctgacggcctatcgtatctcctgctttctacagcaatgtcgctgatgcctcgagcatctttgtggtggacgcctgccgcttttgaaggtccatgaactcctgcacataatgaaggagcatgggactcctctcctccttgagctcacggagctccacgtccttggccctatgctccgcatccttggcctgcagctcctgtgtctggcgcttcacctcaaattccgtgatctgatgtgccgccatggcactaggtagaagcaatggg

SEQ ID NO: 59459 - DNA, 411 bp, Triticum aestivum
  Clone ID: PAT_TA_59459
tcactctacttcgacgtgttggtagcactacgttatgccatcaaatctatcgtagacacatagaaagatcaaagaaatgtgagagaagaacatgaacgacatgagaacacatgggaatgtgagacatccggggtagtcgtggaacgagttgtcattctggcacttgacggcaccaaactactagatatcgagagagcaaggatactgtggcttcatttattttagctgatcgtatattcgcattcatctcgtttgtctttttgcaatccatagctcgagagttcgaaactaaattctagggcacaagaccctattcttcctccttttatggttgggcacgaataatttctaattctagcacatcacaatcataatcttctagcatattcattgttggcattgtgtcatccg

SEQ ID NO: 59460 - DNA, 416 bp, Triticum aestivum
  Clone ID: PAT_TA_59460
ttttgcaaaaaaaaaccctgccgttttctcgaatcaacccagagtacaacacaacacttgaattaattctgtctgaatcttcagttaactagaaattctagccactaaatcaagctcacgtaagcgaccagctagccctacgcaacgctatcttctccatcgttgtgtttagttcgtgcctgcgttttagctgatggatctttcacgttttgatgaagctgctggacgaccgctgcgcccgcgtgaacaggcggcgcggccccggcgtcgtgacagccgcgtacgatttcctctacctgcccatggatttcaggtgattcatttcatgctcgctcttctctcacggtttgacagggtgatttcttgcctgcattttttcttgtgccgtaccggaacagaatagtcgcactatcatc

SEQ ID NO: 59461 - DNA, 295 bp, Triticum aestivum
  Clone ID: PAT_TA_59461
ggagagcctggacaaatcacaaggggaaacactcaagaacaagtccaatcacacatccactagacaatcaaacacacaagatctacaaggtacatgaacaacaaagagaaagatacaaggtaaagttcatctccaagaggaggtcttgatggtatcctagacagatcttcccatgaggggggtcttgaatccaagaaggatcttctccgaagaggccgcagtctctcacgaggactagattcgtatggatgagcaaagctctatctcaaatgagctaaacctgtgctaaccctag

SEQ ID NO: 59462 - DNA, 300 bp, Triticum aestivum
  Clone ID: PAT_TA_59462
cgtaccaggtttaccggagatcagggcgaaagaaaagggcacgtcgtcaatctgcgaggttgtaatgtccctcccgagctaacacattcatgacatacatggattgcacgaaacagggaatttgactagatgctgattatgtagcaaaacgatcacatctgcgtgtggaagtaactgaaactattgcatagaaaaccatgtctcaactcgggtcatgggacggtagcgctatacgatccacgcaaaagttgacgaccagccaatttacaacaccgactaaagtgtaagggaaaggcattc

SEQ ID NO: 59463 - DNA, 122 bp, Triticum aestivum
  Clone ID: PAT_TA_59463
aatctgcagtgtctctgacggcccaggtacgatttcttccggacatatagacgtcctcgtagtaagctttcaaagtatggggacactggcagcagatagtacgtaggaaagattgaagtacc

SEQ ID NO: 59464 - DNA, 388 bp, Triticum aestivum
  Clone ID: PAT_TA_59464
gtattttgtgtcaaactttgtccataaatttaactagaaaaataataatgcatgtcatcaaaaattatatcgttgaattcgtatttaaacatagtttcgagtgatattatttttggttacatgtattattattttcttagctaaacctatggtcaaagtttgacataaaatactaaggggtccaataaaccaggaggtagtaagttggatggccaaaaggagaggaggatgtgcgttcgtccacgcagatgcggtgcgttgccgatgctcctccatgcccaaaagctggcatctgcccttgagtactgatattgagagcatctccaacagccgcgctaagcgccgcgcgcaaaaaacctgttgcagcgcgcgcttcggctggtttagc

SEQ ID NO: 59465 - DNA, 411 bp, Triticum aestivum
  Clone ID: PAT_TA_59465
gagaattgtcttatgaattctcccaattgcaatttttctgatagactaggagctatatcttcgcgaaacataaaccgccgcaaagtaagctttcaagaaatggggacagtggcaccaaatagtacttggaaaacattgaggtaccaggatcagttcgtgcattcaccagcaaggaaaagatattatccatacccacccgagcattactacagtccccacacaccagctatgaggagtcccctggcgccaagtaaaacgcctttcacatcgacaaccgcgaggcgcaagatgatcttctggaccgaggcagaggaggtggctctgagggaggcagtggcgaagtttgccccgaatggggaggccgcgaaggagaagaggtccatctcgtgggtgcgcatacacgagtactgc

SEQ ID NO: 59466 - DNA, 397 bp, Triticum aestivum
  Clone ID: PAT_TA_59466
gaatttcaagtttcccctagattaaatttattttcttaccaattgtccaagaaaaagctacaaaaagttagacctattcatcctttttgtccaagccagtctgagcctttgcaattttcttttcattgtttgcattattgaattatcggttgcatcgtcgtgtcgagttgctggtcttagtgtctagttcgtttagagtttcgagttctgttcacattagtcacatcgccgctgcatcgttatcctttccgctgtccaccaccccatccatcaatttccaccacgtgctacccatagttcattgtcacaatcatagttgaggtcgttcacatcttcgcttgatccaatctgcatcttatctagtttgtcttggaaagagggagagaaaaaaagacag

SEQ ID NO: 59467 - DNA, 241 bp, Triticum aestivum
  Clone ID: PAT_TA_59467
aaatttattttcctatcagttgtccagaactgtgctataggaagttatacatatgcatcatttttgtccagaccaatctgagccattgcaagtttcttttcattgtatgcatgacagaattatcggttgcatcgtcatgtcctgttgctgctcttatgatatagctcgattacaagttcctaattctgttcagactactcatatgttacagcagcatcgtgatcctttatgatgtgcaata

SEQ ID NO: 59468 - DNA, 352 bp, Triticum aestivum
  Clone ID: PAT_TA_59468
tgggataagaatgtcgaaagggaataccggtatttcactaccatgactatacccgacgccaagagagctaccgtgaacgtcattgcaaaaatgagccatgggtacacgctaagcatgtgacacaatgctttttcataaccgacccaagcaatcccagccgtgttgtcgtgaggagaggcaaaaggaacatcattggaatggatggagtctccaacgaggaggactacgaccagtacggcaaccctatgagggaagatgacgatgacgatgaagtatacgtcaaaagaagaatcagtactacattacctaagaaagatcatactccatggaaaaggaaaagccacaatgaagg

SEQ ID NO: 59469 - DNA, 429 bp, Triticum aestivum
  Clone ID: PAT_TA_59469
tttgtcgtcatatgctggtgtggaaatgtttcactatatgaatttgctaattctcgtctgacaaagtctcgtctactactacactacttgattaatcaaacaaaaaatataaaaaaatcaatacgaattaccgtgtaaaatccaacggtataggagttagatgagacatagttatttctcgagctagactagagctagacacacccctttactgtatatattctttgggtgacgttttgtttttgaagtctgatctttactcagctcaactattggcatctgggtgtgggccggtttagtcatttctcctgccagtgtcaatttactgttacctttaagcccgggcccgtgtgatgaatggtagtgtatcctggaacctctctgttgttcacatgcatttttcttgagatataaatattgataaacttt

SEQ ID NO: 59470 - DNA, 416 bp, Triticum aestivum
  Clone ID: PAT_TA_59470
ttctgttattgctgcatagtttgcttgttttgatgaaactatcgatttctattagtggattaagccatggagaagttatattatagtagctacaatgcaaacatcaaatatgaattggtttgcaacagtacttagagtagcgatttgcttcattgtactaatgatcttaccaaactttctattaagttttgtgtgattgatgttttcaagttttcggagagatcacgatggatgaaggaataaggagtggcaagagcctaagattggggatgcccgaggcacaacaagtaaatattcaaggactcccaagcaaccaagcttggggatgccccggaaggcattccctctttcttctaacgatcatcggtaatttcacttggagctatattttattcgtcacatgatatgcgtaaatc

SEQ ID NO: 59471 - DNA, 384 bp, Triticum aestivum
  unsure (1)..(384): unsure at all n locations
  Clone ID: PAT_TA_59471
aacaaccgacgccgccacgattacgatgattgatcaaggcatcatgacatgagtttagctgacgctaataagcatagttgcggcggctttgcatcgatgaatctccatttcctattttttttcaagcatttttcatttggctattcaccggtcaccatgctccaatcgtatgctcgagcttctcttggaataaaatgtgtagtttgacctaaaaaaaaaaaaaaaaaaaaaaaaaaaaaaaaaaaaaaaaaaaaaaaaaaaaaaaanaaaaaaaaaaaaaaaaaagaggaatcaaaaaaggttaaaggaattaattacacttgatgtaaaattcataactgatggtaaaaaaaaaagcggggctccctaaagggtcccatcttt

SEQ ID NO: 59472 - DNA, 417 bp, Triticum aestivum
  Clone ID: PAT_TA_59472
atcaggtcgacgggccatcggcgtcgcgccgcccaatcctggtcttcttcgccggcggtgaccatggccccgttcggccactgctcctgcagcactggaagggcaaggacaccgacgtgcaggtgagcgagtacctgccccggggtgtgtcgtacatcaacgtgatgcggcggagcaagttctgcctgtgccccagcggctacgaggtggccagccccagggtggtggtggaggccatctacctcgagtgcgtgccggtggtcattggcgacgactacgtgctgcccttcagcgacgtgctcaactggcccgccttctcggtgcgggtcgccatggcggacatacccaacctcaagaccatcctcgccgccatgtcgccgcggcagtacatacggatgcagcgccgggtgaggaccg

SEQ ID NO: 59473 - DNA, 413 bp, Triticum aestivum
  Clone ID: PAT_TA_59473
tagctccatgccatgctttactttgccatgttcaggtcctgtagcatatagttttcatgctccgaagagggctacctgatctgaaattccagacaagtgttaatttcactaagtctgaaatctgtttgccaaatgcattttttccatgcttgtttgaacctgttaatggatgaattggccgtagctcagtgctagacttttgttaagcatcatgaatggattcttgccatgtattttgttgccatgtttgggtgttgtagcatgttcatcttgttgcatttagatggctacttgctgtaaatcgcagaacgtggtcatattggaatcgcttgccatttcgaaaccgtaactccgattccggcattctttatatcgttttcaagcgatttcatctcatatttccagtggtacac

SEQ ID NO: 59474 - DNA, 428 bp, Triticum aestivum
  Clone ID: PAT_TA_59474
ataggagaatgccacagaagtgtggtatcatttaacatagtctggaggggttgaatagactaccattaacaaaggggactgcttgtcaacttttagtttccttgcaattttaagcttttctacagtagtatgttgcctcccaaaggagttattgggtttcccccaaagaggaaggatgatgtagaacaacaacaaagtatttccttcggttagagaacaaaggttatcaatcctgtagaaagcttccatgctaacaatataaacacacctacacacaaacaagatacaaacttgcacccaacatggcaagagggttgtcaagccccttgccttgctaattacaagattaaaagaaaattatagagataaatagtggtaaaatagcacgggaaataaaaagagtaaattgtgtacaagaatttattaat

SEQ ID NO: 59475 - DNA, 359 bp, Triticum aestivum
  Clone ID: PAT_TA_59475
agtggtggagaaatggaggaagaagaaggaggaacgggcgtgcacagtgcagacgcctcggccccgtcgccttataaagggttgcttctgagtgactggcgcatgggaccagaaaatcctctcaaatcccgcaacagtcgcgcgcaatgtacgtggcaaaaaaggcagcacagaaatcgaggcatcgttgtttatccgctccgcccgcttcggcgctccccgtcccgcgcgcttccccgaaatttcttatcccgtgaaatccgggatacacagcagtcaatcgcgcccaagaccctgcgctctaatacaacactcggcgcatgatgccacaagttgagtcaacaactctctgaatgaat

SEQ ID NO: 59476 - DNA, 412 bp, Triticum aestivum
  Clone ID: PAT_TA_59476
gacgtttgagattttgagttcatgaatttttccgtttcctaaggtgtttcggctacttagggacgagtctccatcatcttggtttctacatcaagaacaccgctattcatcatcgtcggacggtaacctccatatcatcttggtatcgtggtaaccctccattgtatattccccttgccattgcattgttaacccctagcccattttgcgttacttgcctatcgagactagccatttgagtattgccggcaacgttacttgtgcacattactgatcatacttcccatagcatacataccatatcatcgtggtgcatatattggtatcatatcttgtgtcacaagtttgttcccgcatatacacaattgctatcttggtttgtgcattgtgcaaagttggccatacacaataa

SEQ ID NO: 59477 - DNA, 429 bp, Triticum aestivum
  unsure (1)..(429): unsure at all n locations
  Clone ID: PAT_TA_59477
gacggttaaggtanggtttcgtccacaaattcaaggaaaggagcacatattaaaaggtaaaggaacctaggaaagtcaaaataaggtgcggtttttggccacccaatcgtgatcaaatgatcaaaatgataaaggaggtttaggtgggtttttgggcaactttggaagggtgttgggctgcaacactaacgaagccttttcggtcccctcggtaaacctttgagtatcaaacgaagtcaaaatggcacgaaacttgacaggcggtctaccggtagtgaaccaaggccgcatggcaagtctcggtcaaatccgaaaatgtttaacacccgcacacgaaaaangaggtagaaagggacaccgggtgacatangaacgccggattgcaaaacggacaacagggaaaatgcttggatgcatgaaacgaacatg

SEQ ID NO: 59478 - DNA, 435 bp, Triticum aestivum
  Clone ID: PAT_TA_59478
gttggcgtaggtgatgtctgtagtattttcgtcctcgccagtcacacaattcctaggttatgggactggatctccatttccaagattcttagctgataagtatattgtgcggaaaaatctctactgaatgacagatccaagcaatctggatacgccatgggacaaagttgaagctttgtacatcacttctctacctgtttattaatgtgtcttcatgtttggcagtgatctgggtttccatgtacttgatagatgcattccttatctttatgtgttccatctacgtagatatgtttctgcccataaatgtatttatgagcttgctccgtttttactgctttcctacgtcaatttgaaaagtaccctttattcacctaataagggctatacatgcatttagacgagtgcacattttctataaacataagcattgtc

SEQ ID NO: 59479 - DNA, 138 bp, Triticum aestivum
  Clone ID: PAT_TA_59479
ggtgtgggtgagtagagggatgtcctggccaacggtgggaataataagaagccgtgaagcctccgccggaacaaaaccgggcacgggaagcaagaacatgcgacacgaccggcgctgccttgggccgctggagcaaga

SEQ ID NO: 59480 - DNA, 420 bp, Triticum aestivum
  Clone ID: PAT_TA_59480
tctccaaactacactataacagagaagtttgcacttattatggattatattgatgggttgccttttaccgttgcacatgatgattttgatgaatataacatgcatgtgcttgctgctcctacttgcaattattatgagagaggaactacatctccacctctttatgtttccaacacgataaaattgcaagaaactgcttatgctatgtattgtcctttacttgatgtgcatgaattgttcttttatgatatgctgatgcataggcagagagttagacttcgtcattgcatgatatactttgctttgtgctcataactaaatgacaaatcattgttaattaaaattggctttgacataccttgggatccgggtggattcgttacttgagcactttatgcctagcttaatggccttaaagaa

SEQ ID NO: 59481 - DNA, 401 bp, Triticum aestivum
  unsure (1)..(401): unsure at all n locations
  Clone ID: PAT_TA_59481
atattgcctctgggctaaaaactctgacgatggggtcaaaagtaactctctcgcggcctgggaaattgtctgccgcccaaaatgctgcggaggccttggtgttattgatattaaaacacagaatgcagccctcctcctaaaacatctattcaaattctataatcatgaagatgttccttgggtggagcttgtttgggatgcctactacagggacaagataccgcatgcatctgaggcggtgggctctttctggtggaaagatgtgatgcaactcagtgggatcttccgagggatcactaaagtcacccccggggatggctctagtgctctgtctggaaggatgtttggtttgataatactcaggattccncaataatggatatatacccacgagccttttc

SEQ ID NO: 59482 - DNA, 430 bp, Triticum aestivum
  unsure (1)..(430): unsure at all n locations
  Clone ID: PAT_TA_59482
catttaggacgaagaagacaatcgacccccaagggaccataatgtattttcctangatgtctatacttattggtttgatcaatagatttgaggccttctgcaaacaataaaactaaaataggtcattgatgcatggtggccgtcggagagtacctcataataaaggaaaataattccgtctttgaaccaaagctaaattatcgtatttcggattgacgtaaacataaggaaatagtcggtatctgaaagtaccattcttctcccgagctcaaatgcacttgtcatgaacagtanaaaaataaaaattaagttaaaatataaaattttctgatttttcttgacagtaaacattgttgaatgttttacatacgtgcaattttcatgaagaaaaaacattcccagtgctctaaaaagaacaaagctccaacat

SEQ ID NO: 59483 - DNA, 431 bp, Triticum aestivum
  Clone ID: PAT_TA_59483
accatgggccgcaggcaggcaagtctgggaaccctcgttcccagaatgccgacaaacatgtccgtccatttatcgacctttttttcattgagataacttcaaaaaatgtagaacttatcaaaaacacaaacaactttgtatggtgccttgcattgttcatacaaggtcatgaacttttgaggggggggggggattttaaaagatgtcaagaaacaaagtgctctcagactgagtcttctggcctacccggacaccctccgttgaatattagctatttttagacattactaaaatgatcccaacttttacaagcaggtgggcatgtccatggtaagcaccaatgtgaggtttgaacgatatctgacaccgtctgtaagttgcgatagttagaccatttatcaccattttgatagagaaaactccagagaatg

SEQ ID NO: 59484 - DNA, 432 bp, Triticum aestivum
  Clone ID: PAT_TA_59484
gcaggctaacatataggtgtagccatttttctgacataaaaataacagtaaagaagaccaagttaacatatgtatcaggttgcgtttacctgatcagaagaaacaggcaggtttacaatgttttgtgttgcacattgctactttggtaccttgatgcgaagtaataatgtctttaagctttattagcaccggaataacagcaacaaaagacagtttttaccactgcacttgcagagttctctgaacttctgataaccagacatcagggttctctaaaagaacagacattagctaacataattcagcacaagaataacagttcaaaatgccaaaagagtattagtacaccataagcaagtgttgtgtcgttagcagcgtcgaagtttctatttctgaacttgcagaacttcattgtcatgtaattcagattga

SEQ ID NO: 59485 - DNA, 439 bp, Triticum aestivum
  Clone ID: PAT_TA_59485
cggccaaaggatataatccggctgtctggatacctcctaatccaggactccctcagtagcccctgaaccaggcttcaatgacgatgagtccgacgcgcagattgtcttcggcattgcaaggcgggttcctcctccgaatacttcatagaagattttgaacacgaggatcgtgtctggctctgcaaaacaagttccacatacaaccgtagagagaataatattttcacaaatctaatctgccgacgcattctgcagtgtgacatcacaccacagccaggttaccattcaaatcgtttttcacaaccaacctcagcgtgtttcgcgaggcggtttccttggcacgtcttgtcgaagcagagatcgtgtccccttattacgggattcctatcaatacggacatgggtaacccaaccgcgccatcaattactgtcacatccct

SEQ ID NO: 59486 - DNA, 405 bp, Triticum aestivum
  Clone ID: PAT_TA_59486
tggaccagaaaagattgataagccgcccgctcagccgcctgctgaaccgcccgctctgcctctgggcgtgtcctgtcctgatcaaccaagttaggggctccatcacgcgtcgggtcatgcccgcacggttggtcacggcgccgggcgttgcttgaaactgcagccgagtccatatgcctgctatagctcgggctccggcttgggcgaggggtcgaatgaatcctgtctcgactataagaatatgcttcctgctgtgccagagccgtctgaagaagttctgtgacccttcgcgtttcgaccgctgtcggagagtcgccttccactgggagagccgccaatcgtgccgccgcagcaatcatgttctccaacgggttagaataatgacccggaggtgtcggtacatac

SEQ ID NO: 59487 - DNA, 406 bp, Triticum aestivum
  Clone ID: PAT_TA_59487
tcctatgagaaccccttttaatagtatggatttcctacaaccaaataaattaaatgcatcggaaatgccgccttcgctcttttccatctggaggggtgcccaaccatcttgtgcctaataaagtatacatgcgtagcttaggcacgcgtttagtctgtaagttgcattgtcatcaacatcaaaacacttaaggaggaaaatgcccttccagtaatgtgccttgttaggcctttggcgttggaacccaagtccccacctatatttcaagataaagcatgcttatgtttaattcgtgacaaatatgtgttttcaaattaacgcaacaaaaagaatgttcaataaaagactagatgcttttcttcacagcttcttatgccaattggtccatcaatttaccttgtccaat

SEQ ID NO: 59488 - DNA, 392 bp, Triticum aestivum
  Clone ID: PAT_TA_59488
tcaccacatgcttagatagccgattacattgggcgaagactaatgatcaacatttaacttgacaatgcgtattttttttagaagaacagggaggctcctccccggttccattatcaaatgaaacctaaagtgtcttacatcagctcactgagaggagcagttcaaaggaaggactgcggcgaaaccgactcaagtttaatgacaagcttacagaatcaaaagcggcaaagacacgggccataagcgcccacacacgcactacatgttttctaagtgcacttgataatgcgtatgtccaggtgaacctccttggagcccccgtgcaccgagtcggtgggtaaaggatggaattgatgccatgtgttttccaagtccacattggcgggataatc

SEQ ID NO: 59489 - DNA, 404 bp, Triticum aestivum
  unsure (1)..(404): unsure at all n locations
  Clone ID: PAT_TA_59489
ctctatgacatgaagcacaccacacagttctgcaaaattccagctcggtggctccgtacttcgagcaatacaagaatattttacgctcggacaacccggggaagcctgaatcctggattagaaaggcccacatggagactttcggcagttggttgcgaaaacatttaatgaatgacaatgatgttggagatcagctgtacatgttggccaagaaaccatcttcgactataacgactttccaagggtacgagataaatgggaatacattttacaccatcgcccaagataaaaagagcaccaaccaaaacagtggtgtccgctttgatgcagcaaccgagaatgggcaaaaggtcacatattatggttacatanaggagatatgggaacttgactatggaccctcc

SEQ ID NO: 59490 - DNA, 397 bp, Triticum aestivum
  Clone ID: PAT_TA_59490
acctactattaaaattagaaccaaagatcatgaatactatgctttgtgtgatttgggtgctagtgtttccacgattccaaaacattgtgtgatttgctaggattccgtgaatttgatgattgttctttaaacttgcaccttgcggattccactattaagaaacctatggaaagaaataatgatgttcttatttttgcatataggaactatgtgcccgtagattccattgttcctgacatagattgcaatccttcatgtcctattattcttggtagacctttccttagaacgattgctgcaattattgatatgaaggaagggaatattagattccaaattccattaaggaaaggtatggaacactttcctagaaagaaaattaaattaccatatgaat

SEQ ID NO: 59491 - DNA, 256 bp, Triticum aestivum
  Clone ID: PAT_TA_59491
cgatcttgtggggcaattagcagacctgggcgaagcagattacacagccgtcaacagagctctgtgtgcaatgtgccagtacaatgccagcggcagctacgtggtctcggacctgtcgaacgatccagacatcaggaaggctaccatggaggacatagcgcatcaaatccgccagcaatggtcagctcaccgtccgacgtgatcaacctgtcgtactcagtacaaccagtggttttccatttgggggttcgtgaag

SEQ ID NO: 59492 - DNA, 288 bp, Triticum aestivum
  Clone ID: PAT_TA_59492
gaccagtactgagggttgtcgcttggcacaagggtatgatcggacggctgacgttgggagctagggttaggcgaaaccccgcgggatttagagggttttgagatggtcaacggggtttcgaaggctttgactgagcataactaatttaaaaaaatcaaaaaaaatatgaaaccttcgccgttcgtcgttttataagacaaactaacgaggaaaaatactaaacttggtctatgctcattttcatgaaaaaaccctaactggtacgatcgaggtcaaatgagcaccata

SEQ ID NO: 59493 - DNA, 336 bp, Triticum aestivum
  Clone ID: PAT_TA_59493
ctgcgtgaaggcccgattgtcctgttgacgagtgccatgcatggcagttggcagggaaacctcctcgttgttcacccttgtgttgtactactagttcatctccttgatacaatgctgcatacgtaagtaaaaatattgagtgaacaatgtgctgcattgagaaatctgagtaattaagtaaaaataagtagcaaaagtatcctgtaatcgactacataatcatctgtacgtgtgcagacgatatgcaacgaaccgtcaagcagtgccctgcccacgtacgtacagggtctcataaccatggcgtacgtgcatgactcgctcggccgggcgacagcc

SEQ ID NO: 59494 - DNA, 436 bp, Triticum aestivum
  Clone ID: PAT_TA_59494
cacgatgaaacaatgacattgtctggctattcatacaattctatacaagatgcaatggacgttgcagctgctcgagtaatgaaatatatggagaccatgcgtgccaaggtattgaaagactatagttacaacgagttgcaacaaacaaaggaaagagaactgcatctgattggtttgttaggacaaagaaaaagaaatcaaagaacaggctctgaagattagagaacttagcaaagactttgcagactacttatatcaggttaaaagcacttcttctgagattcaccgcccagctaaaggaagtgtatgctcagccaattccataagtggttgcgagctccacaaagcggctatagatattcataatgcaattgctcatcttggccagttgagtgaaaaccctatgcaaggtaaccaaaacacatcggtatatcca

SEQ ID NO: 59495 - DNA, 415 bp, Triticum aestivum
  Clone ID: PAT_TA_59495
gtattggacaattataattcataacctgcactaaaaaatactcaaaattttataataccaccgttactttaactataagaaaaatggctatttgtatcaaatcctaacattaaacattaaaaatagacgggcgcagcaacgccgccatcggtgatctagttgtgcactaaactactccaatttccatcttatgggagaatttcaagctagactcctgctatatgcagattttgtcttccaggttatggatatcacattgcatgtattcaccgttgtggtgtcatctaatgatactttctaactatatatacatcattgacagttcatatcttcagttgtgcaatattttacacacaacttgtccttctattgcgggaaacaccaatatatcttggcaaagctggactgagaatga

SEQ ID NO: 59496 - DNA, 349 bp, Triticum aestivum
  Clone ID: PAT_TA_59496
gtgtggcagcggcactggttctggaagaggttcttcgccgacgccgatgaggccaagattaataactgctacccagctgatgatgacgataatgcccggctttgctacacacacggaataatacggagttttacgggcctggacgcccaccccaccagttaaaatcagggggggcggttaagtaggtggagaagtttacttttgccaattacaacactaaaggtcagcgcgtccgtaaaacttgtgcgtgtgcggcacgtgtgtctagcatttttgcgataatgcctgtgtcctgaagtcgcacaagccttgcttccaagcaacatcacgagtactgaacacctttcct

SEQ ID NO: 59497 - DNA, 418 bp, Triticum aestivum
  Clone ID: PAT_TA_59497
ggtggtcaaagaaactggatgcatgttttcattatttctggtgttcgttgtactgccatgattgcagatgaatagatatgaagttttctcgcaaaaaagaagtaagaggtttttcaatgttatcgctgtaacgcaagaataagagtcagttcttttgctagctcctagaataaactgaaacaagttgtcccttacccaacttattctaaaaatccaaccaaatttatctttttagaagcctactaattaaagacttaactagtaggattttaaaatttatttttggttaggttcctagaataaactgggtaggggtagcttattttacaagcccgaaaaggccacaaaaagaatagcccctaaggcacgttgctttgattacaactataacataattcaagtaatacactttgcaaag

SEQ ID NO: 59498 - DNA, 196 bp, Triticum aestivum
  Clone ID: PAT_TA_59498
cgtgtatggaagtcctaggccaggcgactatttcacggacagccgaagaggaattccgtcaatccgccaccgttttgactcttgagaacaactctatcaactcagtagatccttttaggacgccctcagtgaccacaggttgaacctaacgaagttagactgtgctatggctcgatattcacgcactagctgtacg

SEQ ID NO: 59499 - DNA, 390 bp, Triticum aestivum
  Clone ID: PAT_TA_59499
tcaggaggcatgcacgaatgatgaggggggatgatgtggctgtggtaagcagacgtaactacataggaagatcaatcgccctttgttagagaaaggagagacataacttgtgaggtacgtcgatcgatgggggggtagttaaagtcgatctaggtatatgttgggagatcaatcggtatacatgcatgtgtgtgttagaagcaaatgaggcacgaggagaaggatagagagagagagagggatgcatgtaggaggtggtacgagaggcatactatatcgagggtggaggagtgtgcgagtacgagaatgatgaaaagagtggtgggagtgaggcatggatggtgacaagagaagaggggaagcttgtgtttgtgctaggcacacctggct

SEQ ID NO: 59500 - DNA, 175 bp, Triticum aestivum
  Clone ID: PAT_TA_59500
tgcttctatttcagtctgtgacagacctgggtattgtaaatcgtgattacttatgagcacttgtgaattggttaattgctgagcactatgccttgagactaaagatttccgcccacagcccaatacataatgttgcattttagtgaaaatatataacgtatacatgttgcatgtt

SEQ ID NO: 59501 - DNA, 154 bp, Triticum aestivum
  Clone ID: PAT_TA_59501
atggcatgtcatgcgacttcgaaggtgtacggaatgttcacatgagtggccgtcgtcatagaacagtgatcatggggataacgctgaagtcagccggtgtggtcgctgtgcagcagaggctccgtgagctcgctggggcaatcatgaggaggcg

SEQ ID NO: 59502 - DNA, 388 bp, Triticum aestivum
  Clone ID: PAT_TA_59502
tcgttcacgaaattagtctgattgaagaggtatgatttcgccgacgtgactttcctactgtcaggaaattgagtgccccgacggaattgagagttcaagtgtccggccattgttgtgctagcgccagctgtcaagtggatttttatcctgacaactgtcatgtccgaagcggcatttatgtcttattagcacgtcgggtcgcccctggctatacatagcccccctaaccatttgttggttggctgctccaagagagagattgacaagtatcaaaggagagcagcccatactctgacgagcttgaaaatccaagtatggaattccccaaccaaatccagagtgattaagcatcattgaagatattggcatgtgtagtcccacgcctatt

SEQ ID NO: 59503 - DNA, 354 bp, Triticum aestivum
  Clone ID: PAT_TA_59503
acgacctctagggcccacagagagagtcacacatgagtgtgtgtcataggacaaaaccaccgcgtgtatgtgcccgtgtgttatgtgatgtttgaatacccaatgcacaactttaacgtggcacatgcttcacaaaccggaaacgcactacaccatgatgcgtatctccctcacttcaagccggtgggagagcctcatgtgtacgcacgtgcccgaactttaatatggaatctcaccatgatccacaccacacgcatgccaagatgaatccaccttttggtcaaatgcctctcgttgtcggtggaaactacaaacctttgcgggctaacgaatgggcacgtcgctgataccgca

SEQ ID NO: 59504 - DNA, 255 bp, Triticum aestivum
  Clone ID: PAT_TA_59504
tcataggacagtctgaacgaaacgtatccggatttcaaggtgacttagcgtaagagtttgccagcctgcacgaacgatttcggaaagcaatgcttcttttggcgaaggctttatggccatacgattctcctcctgttctactcccgtgagctcgcgggactattcaactgaccacaccgtaattatgccctgtcgaatcgtattctcatctctacatggtgcacgagacgactgtgccatgatcaaaatccggta

SEQ ID NO: 59505 - DNA, 388 bp, Triticum aestivum
  Clone ID: PAT_TA_59505
gaattggattggctttcccacttgttttttttccttctataagttcagtgtgtggcaaaagcttttcttttcaaatttttctttttgaggaaattttcttttcaattttgggcgaagaccgaagagcggcggcaactataatttccagtgctagcatctgtaaagtatcaccaaaatatgcatctccattcactattgtaagatgttctttctcctttctgattgagatgtatgtagacgaattttgacgtgattgttcattcaattcaatatatatgtaatctatattataaaatatattatatttgtgagcagagggagttgcagtttagatactccctccattcacaaatataagatgttctaacttttgtctgaattaggtgtt

SEQ ID NO: 59506 - DNA, 287 bp, Triticum aestivum
  Clone ID: PAT_TA_59506
tacggctgacgagaagacgacagaagtcaacggtaacgctgccaaaacaccacagaagacgggcccgttccaattgcgaatgttggaaaagaataagaaattagctacaagaaaggaagggaaaattccaaccaagactcccccgcccttaaggttttaaaacaagcccgttaacattgggaatttccaagatttcaacaaatccggttggaaaccttccccggaaccttccaagtttccccggaaccggctcaaccaccattccattgcgccaaccttttgccaaa

SEQ ID NO: 59507 - DNA, 396 bp, Triticum aestivum
  Clone ID: PAT_TA_59507
ccatcacacgccctacttgctggttttcccgtgatatgtagaaattcgcttcttttcttgactctacttgattgtttttcctaattggctggtcatcatctgatttgtgcctcagatcctagcttacgttcaaccatggtctgtaagcacatggtttcttatctagtttccgtatttatcttttgatgatgttggttgttcactattttgaaacatgaataactttttactgacttcgatctctctcatatactacatgattcagcttcacgattttcttcatactatcttatgaaaatgtaacaaacacatttttgaaactttttaacattttaaaaaatgtaacgcacatttttaatatatgacactatttctattatgcaaatatattttaca

SEQ ID NO: 59508 - DNA, 426 bp, Triticum aestivum
  unsure (1)..(426): unsure at all n locations
  Clone ID: PAT_TA_59508
cgggtgacgtagcgcgagcaggttggtcggagtgaggtggctgcgggcggcggacatgtccgttccgatccggacgtgtccggcggcggagagggagcggggctagggttggactgcgcgaaaaatcccgaggggatcgcatatttataggtagagggagctangagagtccaaatgaggagcggttttcgcccacgcgatcgtgatcgaacgaccgagagcgtggaggggagttagatgggttttgggctactttggaaggggtgttgggctgcaacaaaagaggccttttacggttacccggttaaccgttggagtatcaaacgacctccaaatggcacgaaacttgacaagcggtctaccggtgctataccaaggccgcttggcaaacctcgggtcattccgagaaagttaacacccgctcac

SEQ ID NO: 59509 - DNA, 405 bp, Triticum aestivum
  Clone ID: PAT_TA_59509
attcaataatctatttatgttatccagaacaaaagtacttcacacacttttgtgttttgtctaattgcaggtgtatgggacatttgtacaatccacatatgaagataggggaaaaggagaagtttaggttctgttcaaaaagtcctctcacgtcacttttgggccaagagaagatagagtccatgtctctcacgttctggattcagattcgaactgcacagacatacctgactcaaaacgccaacaactttttcatacggactccgaattgggtgattctttctttgttggaaagtagatttcatactctttccaacccaattggattcacctttaaattcgtccggagcgttgagatatggacgaaacaatctgacgctgcagcagaatctgagtcaaacaaca

SEQ ID NO: 59510 - DNA, 334 bp, Triticum aestivum
  unsure (1)..(334): unsure at all n locations
  Clone ID: PAT_TA_59510
caccaacaatccattctttaaatgtagacacaaagaattcgttgtttttaacagaaggacattcttcaaattgtttttggtttaaaaaatgttcaccattttaatattcaatatttccaaaaaggtatcagaatgtttcaaaaaaatggatgcatttaaaaatattcttattttaaaaaaaatctaatttcttttaaaaagcatgtattaaaaaatgtcagtcttaaaaaaccattttataaaaaagaaaatattaatatattttcaagaagtanaaaataaaatcaatgttgcgtaattgcacacacaaagaagattttnggtttttttggcc

SEQ ID NO: 59511 - DNA, 376 bp, Triticum aestivum
  Clone ID: PAT_TA_59511
gcctctgaaaacgctcagcgagaacgggaggggagaggaatgcgacgagagctcgatgtagcatgcacggaccagagagagccaaggggacacggggacgaagaagatacaggagggaaacgacggccggctacagcgcgttcgtgggcgcacggtgacgagcgccagcgaggaggcttccagagggggagatggctctaggaggacggtgacgacgccggaaacatgctagacatgggcatacggtgaggggatgagtgcatagatggggaggaggagacagaagcgccagagcgcgcgggtgacatgccaaaatggtggtcaccgcgtggacacgaagctaacccatgctctgatcggacaaatcatgtctggg

SEQ ID NO: 59512 - DNA, 363 bp, Triticum aestivum
  Clone ID: PAT_TA_59512
ttccaaaaatatatttaaaaaatatttaacaagtaaaaataacatcatattcagattgtacacatttttctaatcaaatttcatatataacatgttaaaattggagttacagtttaaaagatacagataatttagaaaagcatttgttttatttaaatatcttccaaaataatatttaaaaatatttaacaggtaaaaataacaaaaaatacatggagagttgttaaaaaggttgttaaaaagatacatgattttctaatcataaaaatatttttttgtctggaaaagatcatttttgtatggtcttctgtggacgcaggtacttgcgcccctatttcatcactatttcttgctatacatgtc

SEQ ID NO: 59513 - DNA, 364 bp, Triticum aestivum
  Clone ID: PAT_TA_59513
ggcgcagcaggacggtgcagacgtcagcgggctcatctccatgatcatacaggctgtgctgacagcccggcacaataggttcgagtgcgagcagctcgcgcatcgggtcctcatgattgcgcagctcctgccgaacgtgaaggagccagaggcggcgcagccacttgccgggctggacagtactcttcggagagcccacgagcttgtcgtgtcctgccaggagaggagtgcggcgtaccagtttttcatggctagcaggactgccgagaggttcagggaggtagagagcaagatcgactcctacctcatcctcttcccggtgatcagctatatcggcataacacgccgccttgaacgaatctac

SEQ ID NO: 59514 - DNA, 433 bp, Triticum aestivum
  Clone ID: PAT_TA_59514
aacatccagatcatagcccacaccatcactaacatttagagcaacatgtatgagtatatatccttcaatatatagtaggcacatctactctatctagtatacaaacattcactttacaacgtatctattgttgaaaagcagctggaaatatatagatgcgtggagcaagttgtgcataatatcaccatcactaattgttgaaaagcaactggaaaattgtaatttaagaaacctcagagcattgattcaaatatcacccatcatagctcacaccatcactaacatttagagcaacatgtacgagtatctatcctctcaatatatagtaggcacatctactctatcatacattcactgtacgacgtgtctgttgctgaaaagcaaccggaatagatatagatgcatgaaacaagctgtggacattgtgtggcga

SEQ ID NO: 59515 - DNA, 404 bp, Triticum aestivum
  Clone ID: PAT_TA_59515
gcaagatataaaataaagtttagtttgagtttttactttctttactttcttgttgcaattaaaagaaaagaaagaaataaaaagaaaagaaataaacaaaagaaaagaaataaatcaagaagatcatatactaatcttatggtaggtgatggcaccacataaggaaaagtataagtagaaaattttattagagattgacaaacatagcattagtcaatgatgcaactcatgaaagaattaataagggaagagaatattcacatacaaatagactatcctacaaatcttttgtgattgtgagcccccatcagaatattatatgccagaattgttgatgttggacaaggaacacagcttaatgatttacgtttgttcatattcacatagaagacatattgtcatag

SEQ ID NO: 59516 - DNA, 403 bp, Triticum aestivum
  Clone ID: PAT_TA_59516
tgaacataatttgtaatgctggcttctgccccatgctcctggatgaaacatgtagattgcaagcattacatcttactagggggcttcataagcctctgctatctgttagtctgttgttgtgggtatagggttatgtaaaaaaactgcattttttttccggcaaataagcatatagtcaccgtcacaatttccaataggaaaaggccactacaccatctggcacctaatgacaaaacgaagttccaaagacaacaccaacaggtcttcacacaattgtgcctattggccacaacacaacaaatgttgagaagtttcaacctggtcatgaaatgagcacataggattaccagaccattttccttcctcatcacctccctagttaggggagtatcaccaaagaact

SEQ ID NO: 59517 - DNA, 423 bp, Triticum aestivum
  Clone ID: PAT_TA_59517
gccgacaatacgacgatcagggagtacaacatcatggccttcaaggaccacaggaaaaccttggagaagttcgttcaagagcacattgacctcgccgaagccgctgccacttcacgtccccctaccggacaagcagagtaaaagctcgattgccattattaacctagctagctgcaaagacgaaggagggttgttgatgtatcctatttggcttccttatgtagtttgctgcatcatcgttgtcgagccaagaacaactacttatgtatgcattagtgtattacgctacttgtcagcgatcgagtctgtcttaactcttgagtagtagtaatagttgctatcaagctgtgcctgtgcgcttgctcgctataactaattttgtacaacgtaatttgtttggcaccaagttctgttagtaataat

SEQ ID NO: 59518 - DNA, 386 bp, Triticum aestivum
  Clone ID: PAT_TA_59518
ttaacctgagttcattcctcaattgtagaaacatctgcgatatattattgtaaccaccccatgcatgtctaacaacttggatgtattccaattgtattgtgtcttcgccagtccttagagagccatatttgctttaatcctcacatggttacaaccataatagaatgcaccctcagcaatatgtttcatcacattgcattaattaaccaggcaattaactatttacaacattttatgttccagtcattagtcaatcaccatattgcacattataacacactcctatgacaatgtcaactagttacacataccatacgttcgtaacaccttggaaatccaacaattgtaattgtttctcatgtacttgttgcaaccaaattcgattt

SEQ ID NO: 59519 - DNA, 392 bp, Triticum aestivum
  Clone ID: PAT_TA_59519
aaatcgaagagatgagtggcgggaaacggtagcgtgtttggatatataacaacattaatatagaaaacttagtagagaaggaagcactagcacaacgcatgctcacagtgcttacccatatactgcatgtgctatcgaaagggatgatgattgtcgttcgatctgggagcatccaacggtgtatacgtacgatccgtggggtttgggttctcgccaatcagaacgcacgacccagatcacgcgcgcagcaggagggggacatcggccacggttttgtaggcacacggctttcgtgagtgaaccgtgtgctatttgaaaacattttatgagaagaatctcggtttttaaatccccgtaaatccaaaactcacccgagaatcgtgacatggcca

SEQ ID NO: 59520 - DNA, 373 bp, Triticum aestivum
  Clone ID: PAT_TA_59520
gaggcagagacagagaaccgcacagcggcggaaagactgcctggtgccggagaagatgatggaccggactcaaacaagacaacgtcggaagcagctacctcacggtagcaggcgactgattgtctgctgccaacttggcatgtgactgaacatgtataaaataggattatgagttgacaaaggttcaccgcacagggtgtatactggttcattctacaattattttggtaaaggtttaatgatcttttgctaaaaaaaaaaaaaaaaaaaaaaaaaaaaaaaaaaaaaaaaaaaaaaaaaaacaaaaaaaaaaaaaaaaaaaacaaaaaaaaaacccaaaaaaaaacccaacaaacgaaaaaaaaagcggccc

SEQ ID NO: 59521 - DNA, 427 bp, Triticum aestivum
  Clone ID: PAT_TA_59521
tggacgccggtcgtcctcccatagaagcaattatgtttaatcaagaagacataatgcgtttacaatccttagatcatgttgcttataatgaaaatcttagaaagagggttcctaccgatattctagttgatagaatttctgaacttaatgataattttgatattcaaaacagcgggttgggttttcctcttgaacaaaggctcatgactttttgccaaatgaatgcgtacaatgatgagttggttgtacaatatgaagggccaaaggaggaaacaattcatcccgagcttgatcatgggggacttttgtccattaaattttgcccttttgattactttttcttatctcaaaaaaaacttgctgctgaacgtagggagtacgagatgagttttcaagattttccctatcattattatggcaataccta

SEQ ID NO: 59522 - DNA, 378 bp, Triticum aestivum
  Clone ID: PAT_TA_59522
tgagaaactgatgcggatcgtatctgacgatggcaggcggcgacttgtgatcatacttctgaacgcacagtttcaaaacatctggagtgtcacctaaggtaccaagtccttgcaccagatttccttggatcttaatgtgagacatttgtcaaaggaggcttgtcacatgttgccgaagacggtgtagatattcccagttatgacaaagctccagcacatgctcatttccaacaattgaaactcacttttgatttgctataactttaatatcgaagatgcaaaacactatcagacactgaataatgcaataaggttttaatatgtaaaacgatcttgttgtaggtcgtatcacacgatgtgtacagacatgatgccaac

SEQ ID NO: 59523 - DNA, 433 bp, Triticum aestivum
  Clone ID: PAT_TA_59523
ggaggtcagaaaagttgcttgcatgtgcgggtcgggaaaccttgctcaagtccgtgatccaatctattccaacctaccccatgagtacttttcttctcactaagaaagtttgtaagagcctgacttccccatggcaaaatatttctgaagcagctcacttgacaaaaaggcattgcattgggtgtccgggaaggaattggctatcccaaagtgcaagggaatgatgggttttcgagacccgcatcttttcaatctggccatgttgggcaaacacggctggcgtattattaccaatccaaactcactgtgtgctagagttctaaagggtcggtattttcctgatactgacttcatgcgtgctacaatccccaaatctgcatcggccacttggagggcaatagtagcaggaagaagcgccctacaaatgggtttg

SEQ ID NO: 59524 - DNA, 289 bp, Triticum aestivum
  unsure (1)..(289): unsure at all n locations
  Clone ID: PAT_TA_59524
gggtgcgagagtgtaccgcattttttccttttaaactaggttcttcgccccctaaaagacacttgttgctttatgcgattcatcgatactaatactagtaatctagtaatcccgaacaaaacatcgtgtccggggtcttttcccgcgcgatatgctgggaaggttggcttagttgggttttttaggacgagtaatgctacaactacgtaatcccagttacgtaattaacgtaatgtgaaacgtgtgagcagttgattgtagattggggggagaaaaannnnnnnganna

SEQ ID NO: 59525 - DNA, 377 bp, Triticum aestivum
  Clone ID: PAT_TA_59525
tgaatcaaaaggagatgaaccggtgcacgctgacccataatcctctacccgccaaggtcaagatcattaatctaaggactggcttagcatctgccacttacagatactttgtgcaccaaaacacttatccttttgggccatccggtgccatgtcacacgcgagtttcagaacattgatctgccaatccatcgtgcatgttgatttgcataacactgttaaaccgctcgatctgacgtttgaatatctggcacttatactttatcatatcatcagattacgcagaccatacttttcatatttcctgcacatactcatctaacatgtgccctgtcatatttaccccagggagggggatgcgatgtacatatttccatgg

SEQ ID NO: 59526 - DNA, 329 bp, Triticum aestivum
  Clone ID: PAT_TA_59526
ttataggactgcgtttgatttttagtgccgcctcctcgaattgaggtagtagcctgcgctttgggtagtattttgttcggcgctcgagttcgtattcttcggctgctcgggccttagtctgtctgtctgtgagcagatcttggtcagcttggagctgctgctgcttcttttttaggcttcttgcagtggctgtaagcctgcgcttgaagcgctcctgctctatgggatcctctggtatgccaaatttgtcgccattgaggctcacctcgtcttcggagggaggcatatagttatcatcctccaagtatccgtccatcgcctgttcgtct

SEQ ID NO: 59527 - DNA, 410 bp, Triticum aestivum
  Clone ID: PAT_TA_59527
gcacaccaccgtgcctgagtaattccattgtaggcttactggacggtgatgggttgtatgagatttatcatgtaatcgaattagttttgttagggtttgatccctagtatccactatcttctgagattgatgttgctatgactttgctatgcttaatgcttgtcactagggcccgagtgccatgatttcagatctgaacctattatgttttcatcaatatatgagagttcttgatcctatcttgcaagtctatagtcacctattatgtgttatgatccgttaacccccaaagtgacaataatcgggatacttaccggtgatgaccatagtttgaggagttcatgtattcactatgtgctaatgctttgttccggtactctattaaaaggaggccttaatatcccataatt

SEQ ID NO: 59528 - DNA, 416 bp, Triticum aestivum
  Clone ID: PAT_TA_59528
gtatggtatcaacacctatgttttctttgggtcaaagttaccgtggtgtttgtgcataagttatcacacccgtggtgtgtatttcaccttgccatttagacaaaagttaattgcggtatattttcaacaactttttcctaagtcaaaagttagcacggtgtttgtatgtgagttatcaactttgtggtgtgtaaaatatcatggtatttacatagaggttaccagggatatgttttcaacaacaaacaatcccgggtcaaaagttttcacagtgtttgtgagtgtgttatcagctttgtggtgtattaccatgatatttacacataaactaccgaaggtatgttttcaacgatttttttcagtatgctcctctctcttatatttaggaacagggggtgtacaaaacagaagcaacg

SEQ ID NO: 59529 - DNA, 403 bp, Triticum aestivum
  Clone ID: PAT_TA_59529
gtggctttattgcattatgagtcaacatgaatgtaactatttgacctaacataaactcaggatgtaacaatgtagaaaatagctgggtgaaaaacaacttattctgctccctcggtgttgaatagggtgcatagggtactaaatttgccccaagttttgttcaaccgaggaaagttggacttgttagttctcacaattgagcaagttttctaatactccctctgttccatattagttgtagttgatttagtacaaagtttatactaaatcagcgacaactaattatgaatggaggggtaatatgtttttgcacaccgaaggacgttcctaacataaagttttctaatataaagatgttccgaatttaaaactatccatgaattttgaaaactgttcatttttt

SEQ ID NO: 59530 - DNA, 392 bp, Triticum aestivum
  unsure (1)..(392): unsure at all n locations
  Clone ID: PAT_TA_59530
ctgcaatgataaatgggggcattgctgatgtcaacaatgctgatggagctggagctgtgaatggtgctgtgcctattttggttgaccatgctgatgtggagagcgagaatcctgagaacactgtagtgcctgagcaggtggatgagtatgtagatattgatgacgagatgccaaccgcaacttaccgatcagtggagatcgagaagggcgctgaggccacgagtgtctctggtggttcgggaagtggttcttcatcatccagtggttcagggtcagggagctcaggggacagcgcctcagaagctggcgatgctcgttctcttgtttagaggaggttgttctaacagtaggatttgagtangtggaggatgtgagtacttaattctgggatg

SEQ ID NO: 59531 - DNA, 140 bp, Triticum aestivum
  Clone ID: PAT_TA_59531
gaccacaaaacggcggaggagcacaagaagaaggacggggagcacacgaacgacggctatgcacactgagggcatcatggataagatcatggacaacatcagcggctaccgccacggttacggcaagaaggactgcgacc

SEQ ID NO: 59532 - DNA, 401 bp, Triticum aestivum
  Clone ID: PAT_TA_59532
gcagacgtactacgcctgaaaccgggtcactgggccgccggtcatcatcagccccatcatcagctatcaacttcatcgtcaaggatctcagaccctgaggctcactcaattaacgattgcggtcggttctaacctttactctgaatgcgatgcctgttgcgaaatctacctatatgtgctggctttactctcaaagctatttggtctatcacagtaactaaatcaacactaatgtgtacggcagcgttggatagattctcgctcagatctaacacaatcatgaaactgaatcatatttgctcttgaactttttgtcacccatcgtttgcataaacatatgtatacttttcaatttgtacttgtccggacaagcggcaaccgtgccgcccgccatgcaaatc

SEQ ID NO: 59533 - DNA, 373 bp, Triticum aestivum
  Clone ID: PAT_TA_59533
gaaaggggggaatggaggacttagcaaaatattgagccagtgggtggttaattcagaagtagcagtagcgcgttcaagaaagcacgctactgctaagttagctatagcgcattctggtatacacgctactgctactcctttctcttttttccctttttcatttatttttcttcacattttattttttcctttcaccttattcgatttctttcattctcaattacctttctatttgctttcaatttaattttatatcctttagcagtagcgagtttagaagaaaacacgttgctacaaaggacgtagcggtagcgcggttcaatatggatcgctactactatgtgtagcctatcggctaagccgtgggaataat

SEQ ID NO: 59534 - DNA, 398 bp, Triticum aestivum
  Clone ID: PAT_TA_59534
gtcgaggaagtgaagctcttcctcaccggcgtcgatgaaggtaacgatggcgctagggcttgagagctcgagcgaggggagtgagatcgagcggggtaaatgcagtctgaggagggtgaggggtatttaaagccgaggtgaaaaaccgctcgcccaaggaaaatggacgaacgtgcccctgacccttctcatcctagcgacatgtggcacccacgtacagtgtggtgcaaatcgtgtgagatcgtgggtgactagataactcttatcgtgggatgtgggacattttgagcggcaaaagccgaaaattcggataagaatattttaatgtttcgttctcaaattcttcagctgacaaggatacagtgatgattttgaacgagtttcaaatagaacgcaca

SEQ ID NO: 59535 - DNA, 401 bp, Triticum aestivum
  Clone ID: PAT_TA_59535
tcgccttgaggtaacagaattaagtttattagaatgaagatgtaaaataggaggaaaagtgcttacagatcgcatccaggtgctgcagaaaacagtggttaaacttatttagtatagcatttatttgaggcacttgggcctaatattgaaatattaagatagagatttaaattatgtactcttgttttgtaaacactatcttgcaattgcttcgtggaccatgggagggatgattcctagaagccatgttttccaataatttcaacagctctgtgttaagtagcttagttattaatttttatttctgtagtataatcctgggaggttgctggaccaggaaacataatctcatcggtaatttcctaaggaaaatattaggggttctctgttgtgaatttttt

SEQ ID NO: 59536 - DNA, 384 bp, Triticum aestivum
  unsure (1)..(384): unsure at all n locations
  Clone ID: PAT_TA_59536
attaaaaagtaatatgaatattttccttttgggggcataaggtgcaactcttcaactgtgtaaatattcaagtttggtcacaataccttgtcagtatcaaccagaactgtcaaatgtgaggttgaaggcttgtcatgcctcgccacattagcacctggcagatcagaaggtttattcgtgctttgattctggtaagcacgatgggaggaaccaatagctggacttgcagaagggacagtccgagaagccattgtatttccagacatttgatgtgtatcttttatgctagtattagcaggcctactagcancagatgtgccagtactgaatacaggaggctccaaagaaacggctgatcacaaatctgtggtgtgctgaaaatat

SEQ ID NO: 59537 - DNA, 149 bp, Triticum aestivum
  Clone ID: PAT_TA_59537
ttataaaagatctcatatagtttgtgtcagtaatccggccagtggtgaatcccagctggttgttgaagttaaccaaaatgcaatagcggtgacttgtgtgcctgtccattgatccatcctgtgtaggcaagggctatagcttgatggcg

SEQ ID NO: 59538 - DNA, 386 bp, Triticum aestivum
  Clone ID: PAT_TA_59538
gaaaaaaaaaaaaaaaaaaaaaaaaaaaaaaaaaaaaaaagaaaaaaaaaaaaaaaaaaaaaaaaaaaaaaaaccaaaaaaaaaagaaaaaaaaaaaaaataaaaaaaagaaaaaaatgaaaaaaaaaagaggaaagttaaaaaaataaaaataaaaaaaagggggcgtttcaaggggttcaagttttatttccgggttatgggaatttaaaacctttttaaagggtccccaaattttaatttaagggggttttttttaaaaggttgtatgggggaaaaccctgggttttcccaattttaccccttttgaaaaaatcccctttttccaaatggggtttattactaagggggccgaaaggtttgccctttccaagattttgccaacc

SEQ ID NO: 59539 - DNA, 410 bp, Triticum aestivum
  Clone ID: PAT_TA_59539
gagatacagaatggttcctcgaaggcaatttcgagagctatgtgcggaagatgaggaagcctcacgcctggggaggagaacctgagctgctcatgtgctcacatgttcttgggatgcccatcaccgtccacatgtacaccaagggcaccgataaccccaggatcatagcagagtatggccaggagtacggcaaggacaacccggtccgtgttctatacgacggttatgggcactacgacgcgctgcagccatctcttgtaagaacacaaccaagactgagaggagcgtagctaaccggagaatggtgcgctatgtaagcttcttctactacttctctagggcagccgcataaattccgacatctgctgcaacttggtttcgttcgagttggcagatcacggtatagcaca

SEQ ID NO: 59540 - DNA, 390 bp, Triticum aestivum
  Clone ID: PAT_TA_59540
tgtgtgaactcgttctccaccttgcaggctccgtcgtggtgctcccacttctttcgtgtcactccgggtgaaaacttgatcttcaagatcagacggtcacggcttcctatggtcgtatccttcctggtcgtcttggagtcctcgcttcggccgtatccttggtggattgctcatctacatggtggtctccagcttatcatcagggtgcttggtcgtcgttggggtggtcttttcagtgcccggccatcttcatggtgtgtgcattgagtgtggtggtggagtgcgtttgtatcttcttactcgaatgttgtggtgatggttgctttatatataaagcagggaacccctttttcgccaaaaaaaaaaaaaaaagctaaaaaaagaaaaagc

SEQ ID NO: 59541 - DNA, 408 bp, Triticum aestivum
  Clone ID: PAT_TA_59541
atgtgtgagatctggctatctagttgtttatccttagtagcctctcttaccgggaaatgtctcctagtgtttccactgagccatggtagcttgctactgctccggaacacttaggctggccggcatgtgtccttcttcgttcctgtgtctgtcccttcggggaaatgtcacgcgatgaataccggagtcctgttagcccgctacagcccggttcaccggagtcctgctagcccagtgctacagtctggattcactcgctgatgaccgacacgttcgatgctgggtcatggatgcctgtccctgtaagttagtgccactttgggttcacgactagccatgtcagcccgggttctttgtcatatggatgctagcgacactatcatatacatgagccaaaaggcgcaaacg

SEQ ID NO: 59542 - DNA, 391 bp, Triticum aestivum
  Clone ID: PAT_TA_59542
tggggagcaacggcggcaagtgggactgggtggatggtgttcctggatatggtgatggtgtataccgcggctttgtgttcgacggtgggttcacagcaatgccgtgacccgcgaggctcatggaaaaagatatcccagactggtgcgtgactaaatgcgctcaactaacgattttccattgatctgggacatccatctactgctgaagaggaactgatatctccatacattttatttacatcgtacttggttcttagcttgatgaaatacttccagttgttgtacttaatgaacatgaaatgatctgttggttcgttgtttcagacattgaaatgatgcagactgttatatgtttagacgataaaatgttaaatgtcgcatttataggaac

SEQ ID NO: 59543 - DNA, 384 bp, Triticum aestivum
  Clone ID: PAT_TA_59543
ggggcctagccggagttgacgattccggcgaggcagggccgttccagcagctccaacagcaccatcgcggccagtggagcaccacgaacacccaggagaggtcgaaggaagatgaggggcgccggaggaagcagaatgccgaggcgcggtcggcggcgagctccagagcaagacggcggccagaggcccgcctgtcctggacgcggttatctagaggaagtgtgggcgccataggaggagggtggtgtggtcgaacgggctcggaggggtcttatttataggcggggcgaggaaggggatcgagagcaccggcgagctctcttggaggaggtgcacgacgacgagaggcgtcagggagagagaggcgggagtggtcaggggtca

SEQ ID NO: 59544 - DNA, 407 bp, Triticum aestivum
  Clone ID: PAT_TA_59544
gtggctcaggcggcgctagggtttcgggtgctcgggtgctacggctcgggcctccgcggctttaaagggttggccgggctaatgttccaggcggacacggcccggttaggtctgttgacttttttaaaaataaaaaataattccacttagaaaaacaaagaaaagaaatactaaacggactccaaaaatcctgaaataaattttccccttcctctaaaaatctaacggacaaggtgaacatttatttgggcctctaatgcaaattttgaaaaacgcatattattcctaattcaaataaaatagcgataaaaactccgaataaaatcttatttgattttaatattaaatctccaatatttcttgactttggggaagtcattttatcccctcccttttaatttcaaaaa

SEQ ID NO: 59545 - DNA, 405 bp, Triticum aestivum
  Clone ID: PAT_TA_59545
gatgggacgtaagactgcaatctttctccaattatctacctggattattatattcggtgtctatgttgtttaccgtttactattagccagtatgtgccaaaaagggaagatctgagatggagcaaaccaattcatggctcttctaacgcgaatgtagatgcgtcatacaatgaggattaagcagcaccatgtgccacatgagctgttatgcatgatgaggggggtcaattcattgccatagcaacgtagtttataacatacgtaccgaatgcggaagccgctgaaacactcgcccttcgaattggtcttcttccggctgagcagccaggatgtaacaaactgatggcgccatggcggaatctgattgttccctggttatcgatgctatcaacgatgctgagaact

SEQ ID NO: 59546 - DNA, 344 bp, Triticum aestivum
  Clone ID: PAT_TA_59546
ggcgccaaaaactgtcagcctgaggagcaagtctgattgattgatggatggttcatcaaggtgagctatatttgtagggcttgttatacagagactgtattaccactgccagaatacactagttagcaggtacaccagttccagctgagctgctgagcaaagctcatcatactactatacattttcttcatctacagggttgtttcatgggtgatgggctgacatgttgttggtgggcattcttgtactttttttttggaccagattctttgatgtattttttcaaaaaaaaaaaaaaaaccaaaaaaaaaaaaaaaaacaataaaaggaaaaaaaacacaaaa

SEQ ID NO: 59547 - DNA, 371 bp, Triticum aestivum
  Clone ID: PAT_TA_59547
atgccggctacctgcacttctttacccaagtcgtgacctgccatgaaagcagggccgctagggctcgtcagctcattaaggagaagagtcggtatctccctgggcgtgcattctcgcgcgtcttcagctaccttctcagcctggatccggattttgacttcaacaccgcgatagcccccctgcccggggtcgtacagggcgacctggcgagatgggtggacgatcatcttgacgacctgattaaggagtttgctcttgctgacgacgtggctgcactcgcaaccaaggagggcggagccaacgatgatggcgacaacgacgatatgggcaacatcgcgtcccgctaggcctgtacttctttgctcttcctg

SEQ ID NO: 59548 - DNA, 414 bp, Triticum aestivum
  Clone ID: PAT_TA_59548
gtggtgtagtgtgggtgatgctgcgctctgacgaaacatctgtgacggtgttactggcaatgaatttataggattttttccctcttcacctttgagttagtaacctttctccccaaaaaaaaaaaaaaagaaaaaaaaaaaaaaaaaaaaaaaaaaaaaaaaaaaaaaaaaaaaaaaaaaaaaaaaaaaggagcaaaacaaaaggaataaaagctaacaacaaaataaaagcaacgtcaaagtccctgaaacgtagtcaaccaaattcaattcatcgagaagtcgttaaagaaaatacagagaggtaaaaccctgtagtcacccagtataacagcattgtaacaaaacccggtgtcaaaagcaagaggaatacccaaaaggcccgtaccaatagcggtgcacaagaattgggca

SEQ ID NO: 59549 - DNA, 238 bp, Triticum aestivum
  Clone ID: PAT_TA_59549
aattacccacggttgtcgtccggcgagcgctgagcggcacggcggtggctgcagagttttttggctgcagagttagcatagggtgtttttagttcttagtttctttagtttttctagctttgaccgatgtatggtccgaaaatgtctgtaattttaagcttttttgtgtaactttttcttgctgtgtttatattttttttctctctatgtaatgacatgagcattttttaagaaaaat

SEQ ID NO: 59550 - DNA, 408 bp, Triticum aestivum
  Clone ID: PAT_TA_59550
cgtcccgggcttgataacagggagatgggttcctacctcatgcattctactgaactacaagaattcaatatcactactggagggattatgaatggtgacaataaatgcaataaaacataggtgtgaataacatggttaaattgaacttacctggtaagttgatgaagatgttaacgctcttggaaactttgataaactattcgttactccaagaaaatctatatagtcaaacattgcattcacataagcaacaatcctagcaatcaattataccaatcaaaaagcaataaataaagcaataatgatttcaaagaaaatcaaataaaattccaaagaaaactctaaagaaaacaagggcgaaaccaactcacagaatatcaatcaatactcgcataacaactctaaact

SEQ ID NO: 59551 - DNA, 445 bp, Triticum aestivum
  Clone ID: PAT_TA_59551
tttggcacaattgcctgtttgcttgcctggctagtccaaagtcatgatatttttgttatagaattatttttcatagtctaaaataattagagataaatattggggccatgcgtagctatcatcatgggtagcaagttatttctctatgcacaatgccttcctctcaaagtctggctctttttgttttgcgagggaaagtcttgctctttttaacgggcaacgatgcaacgactccttatgcgatacacaaataagtgtaccccgctaagctcgcacgtataccacaactcattcactctattgtcaaattttcacacactatactagaagtttattttaaaaagaatcgcctcgtagcactagtaattctgttaccaaatgaatgtacatcctcctttagttcctccaagtctaacaaaactttcccgtaaaaaaatgtcatacc

SEQ ID NO: 59552 - DNA, 397 bp, Triticum aestivum
  Clone ID: PAT_TA_59552
gcatttaaattagagatgacaaaaaacatgtctacaatgggtcatttcttagccttatcttaaataataactagttattcctaaaaacgtggtgagacatattgttttaagagattatctcatgtcttctcttaaataagagaagacaagcattctcttagggcatgtaaaatggttgataagacagtcttatcttaagtcttgcatgtaattagaggcgacccattaggtcatgtacaatggctcataagatagtcttatattaagtcttgcatttaatttagaaatgacaaaaaacatgtctacaatgggtcatctcttagccttatcttcaataataactagctatttctaaaaatgtggtgagacatattgttctaagagattatatcatgtc

SEQ ID NO: 59553 - DNA, 385 bp, Triticum aestivum
  Clone ID: PAT_TA_59553
gagtgaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcccccccaaaggttccaatttttttttcccttcattcgcactccaaacccctcccaatggtccccccaattttatttccagggccctttttttaaaacctttttccgggaaaaccccggggtttccccaatttaaccccttttgaaaaaacccccttttccccaagggggtttaatccaaatggcccccccccttttccccttccaaaaattttccccc

SEQ ID NO: 59554 - DNA, 378 bp, Triticum aestivum
  Clone ID: PAT_TA_59554
tgtaaccacggactgaatttcgcccacaaccggaacatgccggtaatggaccgtaattaaccgaattctggaaatgagcccaagaataaatgggcccttagaaggctgaaagttaacacgggctggaaagggtcaacggaataatggactgttaatgggtataaagccatacactattcattatgggtcagtttcaccttgggcctttagtgggcccatagttacaaaggaccttgcatgggccgaaagacgttatgggccatacatgggccgaaagttacaactgattgtaatcatattggacggtccagatgacgttgctgggcctaattcggataggccataacgggccgtgagttagcgaactgtaaatgggct

SEQ ID NO: 59555 - DNA, 213 bp, Triticum aestivum
  unsure (1)..(213): unsure at all n locations
  Clone ID: PAT_TA_59555
ctcgaaaattcccgtagtcacggggggtgtttagtgcctgaaggagcattcaggttcaacgatctggccctcgccattgagaccaacggtgtcgtcctccagtacatcctggtacgtacacatgaaaaagtgggggatcttcatggggggcaaacctgcgtggtgaccccctatccaacatctgcggacttancaaanaagaaaaaaacggat

SEQ ID NO: 59556 - DNA, 348 bp, Triticum aestivum
  Clone ID: PAT_TA_59556
gtcattgaaaagatcgacggagtgtgcacggacgctaaatctcatgtcagaacaatgtcagggacatcgccaacttcattgatgtagcactgatgatcattgaaactcacttctatattatcatgtcaggttagacccaatatagtgacccttccagtcagtcgagaattgcataaagaaggctacacccttgaggagtcctttacatgcatctagaggtttactcactacatgatacgtgctctagacttcagcatcatagtagatatgagtccccacgtttggattcaacacaatcattctgtgctttagccaccttttgagagagacacacatgattcagaactt

SEQ ID NO: 59557 - DNA, 421 bp, Triticum aestivum
  unsure (1)..(421): unsure at all n locations
  Clone ID: PAT_TA_59557
tctcgccaccaactcaacaacggccgctgcatcaacctgatttgaccagagttcatccgcgtgcctccactattcaacaactttggtgagttctcctcctctagatcttgttagggttttcacgagtttgttggtagttcatcctcgttcttcgctgtagcttgtaacttttgattcagacttagtaccctcctacgcggcggtagacatggtaatcatttttgttattagaacatctcccttgcgtaagaaaaccaatctggacacatgaactgctcacgtactgcaacttaggtctaaatattttccattctctgaagtgtcgtagatccaaaattgtagcatcaatctgtgaaatctgtntttccaacacttagcaattttcccattctcagatctgtgaaattaatatttgtgcgtg

SEQ ID NO: 59558 - DNA, 361 bp, Triticum aestivum
  Clone ID: PAT_TA_59558
ggattctattgcgatttcgttggcaaggatgaatgatctaatcgctcccagtgacagctgattgatctaggttcactaacaggacgcgagaggctatggaagtcaggtttgttcgtatggataatgtttgggagcagtgataatcgatgagacgttaatctcaatatgtacgataataattcctcaagatataagtgtaattccaaaatattattcgtaaggaacttaaaaagatgccctttgattttgagaatagtgtgaaagaatttatgatctcggacgataattttaatgcattgctagatgaacaattgcgtacagttaaagatttggataggaacgtctatatacattcgattga

SEQ ID NO: 59559 - DNA, 401 bp, Triticum aestivum
  Clone ID: PAT_TA_59559
gttgagcaaactaggaaaagaatttgaaaacgatcttggagaagacatttgactgatgataaatcattcttacgtcaaactttgaaaagaatttgcgaatacctccgggaaaataagaagagtcaggtaagatcctggaaaagacatgtgggttagggcccactcaaaagaaacaccgtagaacgattgcttgaaaagagagagagcgccggttgaattaaatggcttgaatgagataacaacctcgaaatattttgaactgatcttgaaagacgagacgagccttttgagatatcttgagcactccgggacaatagaatagcgagagatgaacgattaagaattgcaccggcatgagaaagcattgaaatacggaaaagaatatgatcacacaccgaaag

SEQ ID NO: 59560 - DNA, 116 bp, Triticum aestivum
  Clone ID: PAT_TA_59560
aggcctcctctggtcgcgtgcgtcggtgtgcagctccatggggtcgggacggagctcctgagctcatcggaagggcgaggggtggtcggtggccatgggtacggcgacgatgacgg

SEQ ID NO: 59561 - DNA, 398 bp, Triticum aestivum
  Clone ID: PAT_TA_59561
gcaagcgacatcgctgccatggaccgcgtgcttcatcagtaaatcctcatatacatcaggcgagccattcactatgattattgcaacataaccggtgttgcggaaacatagtcagtgttgcaaaaacatagctgcttcaaaaacatccctcgtgcttcaacaagaacggcagagctgcaagacaaggtaaccgctatggcgggatgtttctgaaacatggcctatgttgcagaagtccacgagaccatgagaaataaattccgcaacacaatctttgttgcaaatatttccgttacacgagctctgttgcaaagatccgcaacacaatctttgttgcaaatgtttccgcaacacaagctctgttgcaaatgcttctgcaacactacctttgttgaaaa

SEQ ID NO: 59562 - DNA, 404 bp, Triticum aestivum
  Clone ID: PAT_TA_59562
aagagacagatttgcctagggtttgtggcagtggctaagacatctgaactctgtggcgccggatagaaagaatcggtggggccgagtttgactttaggtctaggtcatatgtgtggaagtagttgagggttttggagcatatcacgaagcactgtggagcaagaaactcattaagcaacacctcatccctccttgatagtactggcttttcctatagactcaatgtgatcttggatcactaaaatgtaaaatgaagagtcttgagcttgaagcttgagccaatcccttgtccttagcatcttgaaggagttcccacatcctttagtccatgccactccattgttggacttgtctaaaatgtactaggtaaaagtgttagtccaacaagagatatgttgacatta

SEQ ID NO: 59563 - DNA, 184 bp, Triticum aestivum
  Clone ID: PAT_TA_59563
acgcgcgagacggatctcgacggggaacgccggcctccccaagccgcgcctgcttgatccagagggagggagtgggggtgggggcggcggcgcctgctcgatccagaggctgtgaggaagaagtgggaaggagggattactgctggatctggccatgagatgagcggatctgcgcaaggggggg

SEQ ID NO: 59564 - DNA, 330 bp, Triticum aestivum
  Clone ID: PAT_TA_59564
cggctaagagaagacgacagaagtgacgggcagagaaaagtcaggggccggccgagaaagaaatagctcccggctgctcccatcaagtcggctggaaaagaagtggccgagtgcccatagtcgggtgctagaaaaaaaagtcaaaggttgactggccttgaaaaaaaagtgaccgggtgagatggccggctgcccgagagtcggctggaaaaaaagaagaagaaagaaatgtgcgtctgactgtcagatgtgcgtccgaccgctggctgcctggccggctgcaaagagcgcgactgttgtgtcggggtctgcctgcccagccggctgagg

SEQ ID NO: 59565 - DNA, 411 bp, Triticum aestivum
  Clone ID: PAT_TA_59565
gacgatgacttctgtcagcacgacgacgtgatgacggttttggtgatgtgaacgccatcgccaaaaatgagccatgggtacatgctaaacacgtcacataatgtgtcttcataactgatccgatcaatcacagccgtgttgtcgtgaggagaagcaaaaggagcattgccgaaatggatggagtcgccaacgaggaagaccacgaccagtacggtgatccgatgagggaagatgatgctgatgacgatgaaacatacgtcaaaagaagaacaaagattacattacctacgaaagatcgtaatccctggagaaggaaaactcacgaccatgggctcaattattcgacaatgaacaaaagagggaagaatattagtctaaagcgtcatcgtcgcccaagctgacaaactaatc

SEQ ID NO: 59566 - DNA, 388 bp, Triticum aestivum
  Clone ID: PAT_TA_59566
cagtggaacaaggccggaggggatacctggaggtcgtcgggatgtaactaggtgagcggcggcgggcagaatctgcgagcaggtggcgtaggccctgccgcgccagagcttggtcagagagaacggcgtgtaccgcagatcgggacatgctgcctcggcaccgtcaaacggagaaacgatgcacttcctccctttcccctggcggacgggatgcggccggatcagtgaccaacgatgagagagagagaggccaccgcactccctttccctcggcggacgggatgcggccggatcagtgatcaacggtgagagagagagaggccaccgcagccttgtgtgagatactctgaagagcgacaaaccaggtaggcaggctccattgtatata

SEQ ID NO: 59567 - DNA, 187 bp, Triticum aestivum
  Clone ID: PAT_TA_59567
ggaaaatagtcgatgaaactggaaaatttctaagtcctgcttatatacacagagtattggtcccggttcgtggcaccaaccgggaccaatgcccccctttagtcccggtgtgtgccacgaaccgggaccaatactctgtgttcataagcaggacttagaaaatttccagtttcatcgaccattttcc

SEQ ID NO: 59568 - DNA, 315 bp, Triticum aestivum
  Clone ID: PAT_TA_59568
aaagttaagaaattatgtggaaggaaacttttgtgactattcccaggggggcaaatttccagcagggagacgtgcgtccaacaatctgggaattccaatcaggggataaacctgatgtattagcggcagccatggttttacaccatggtggttatggaatgacaatcctatgagcagcatagtaattcatttgaactttctcggattgcttcgaaatggattgaatcttacatgaagtgcaggacgatccagccacaaatatgttgacgattcaacatggtcatctgcacagaatacacatgctttcacaaattc

SEQ ID NO: 59569 - DNA, 373 bp, Triticum aestivum
  Clone ID: PAT_TA_59569
ccggccttggcggaggagcgggagcagcttgctgaggagcggaaggccttcctcctcgagaaagctgaggctgaagagcagcagcggctcaccggtgagaagctgtacgcgcgagaaggcgagctgactcagcggaaagtgaacctcgacagccacgaagaggagcttgccgcgcgcgaacgggcacttggcgggacgctccaagaggcaaaggatgcggctgcggctgccgaggccgccaagaaagaattggaggcaaaggtggcgcatctagaagctaatctgaaggttggtggcgaagagcttgccgcgctcaagctagagcgcgagaaggacgcccttgcccatggtgagctgcagggccgactcgccg

SEQ ID NO: 59570 - DNA, 388 bp, Triticum aestivum
  Clone ID: PAT_TA_59570
atattaaataaagtaacatgatgagattcacatgataatccaagtactagatactcaagacgtccataaccggggacacggctaaccatgattagtttatacactttgtagaggtttgcgcacttttccccacaagacttgatctcctccgttgggattttcgcactacatgatgtttgagaaacagatgaccgagacatactctttcaaaactgctagcaccttacgatcgggtagacagtaccatcctacatcccctacatctgctagtctaccactgtaagagttcgcatgacttagtcaactatgctagagaccatagtagcttgtggctgcacacggaagtttctagtatgaataatctcatgatccctttgagcctgggtgg

SEQ ID NO: 59571 - DNA, 293 bp, Triticum aestivum
  Clone ID: PAT_TA_59571
aggtggcaaagacaacgatacgatccggcaaccctgcatgcagatccagaaatgcgctgccaacagggtttggctaaatttccaaatttttgcccgtgactatctatagcgcgatcctgtcggtgtgctggaatggcacaactcagtggcaccaatatgcacaacagtagacacttacaacacatctgtgtgaccgagtagttaacttcggttgcaccaatattgaacatctacatagacgtaatgatcactgaggcaccgacaatcgacgaatcggtcacacacgataatca

SEQ ID NO: 59572 - DNA, 392 bp, Triticum aestivum
  Clone ID: PAT_TA_59572
atgtaaggcacacgtaccggcgggggttccgagctgcttggcggcgtagtagtacggtggtttgtaaggctccggccacgacgccgtctgtactgtgtgcgcgcccgtctggtggtgtccgcgatggtcgtgccgaccgcctcaaccgccatgacctccaagcccaacgccaacaacctaaccaacgaagaacaaccccttcttggacttcccctcctttggcggcctcgctttgacgcgcgaatttttcgcgtcgtcgagctgatcttcccgggcaagcgtgatgctcagatcctccggcacctccgtcggctccatctccgacacgttctccgacggttccatgcgtcggcgacggaaggaaggcgagagtgaaagaaaagagcgggaat

SEQ ID NO: 59573 - DNA, 382 bp, Triticum aestivum
  Clone ID: PAT_TA_59573
gcaggacaggcaggggattgagtcacctgtccaatgggaaggcgccgcgtggagaagcgtccacgtggcccgccgtggtgggcgtggtgcgttggaggcgtgagaggcgaggtcgtgacatgcttcgtgcgcggacaacgcaacgcaacgcaaacagtctcgccgttgccacacacgtcactgtgtacggactgtcaacggtcaacgtttgtaagagtggagatggtgcgcttttggaaaatcgagtggtgcggtgtttgttactttctccattcacagatataagatgttctattattttactttttttcgattcagacttatttaaacacattttagagcccgcttgaaatggatgtaagtttatacacctgtatttatt

SEQ ID NO: 59574 - DNA, 382 bp, Triticum aestivum
  Clone ID: PAT_TA_59574
ggattcgaggtgagacggctaatggctggtgtgatttcgcatggaggactcgactcgaggggggattacggctggagacgaatgagggctgaggatttagggtttggaggggaggggaatataaagggacaaagctgagtggtaactgggccgggcctcgctgcgtaagaaggccggagtgatttctcccgttttctttctttcgttctcttgttctccttttcggcctgcaaagaaacaattcggtcttctcaaaagaaaaagaaaaaaacaattcggccccctcaaaaggaaacatacaaatgtctcaaagacaatacaaataatttggcaacgccttttcagtgcgtcgtctgagtaggacttgccggcgctgccaact

SEQ ID NO: 59575 - DNA, 410 bp, Triticum aestivum
  Clone ID: PAT_TA_59575
aaaggaaaatgagaggcgaatggcaaataatgtaatgcgatggagaagagtttatgatgggtacgtggtatgtcttgacttggcgtagatctccccggcaacggcgccagaaatccttcttgctgtctcttgagcatacgttggttttcccttgaagaggaaaggttgatgcagcaaagcagcataagtatttccctcagttttgagaaccaaggtatcaatccagtaggagacaatgcacaagtcacctagtacctgcacaagcaatcaagaaccttgcaaccaacgcgataaaggggttgtcaatcccttcatggtcactcgcaaaagtgagatctaataaagatagtaaagtaaatattttttggtatttttgtagtatagattggaaagtaaagattgcaaaatag

SEQ ID NO: 59576 - DNA, 304 bp, Triticum aestivum
  Clone ID: PAT_TA_59576
agatgcgaatcgctacgtctccgtcggctacaaggaaatctctgttggacaggagtacaacaactccaaggacaatttcgccaagaaatgcacattagcgaaggtcaggagaatggcgaggttcatcatcgacaataagacgaccattaggatcgtcgatgtgacaacgatgatcatgacgacgattgccaagatcacaatgcagccgaccactatgataatgatgatctctctgccgtctaccatggagattgacttcactacgatgattatgactattaagaataagaggaaaattacgact

SEQ ID NO: 59577 - DNA, 369 bp, Triticum aestivum
  Clone ID: PAT_TA_59577
ctgctaagtcgtgcatgtgtgtctgtgttttttgtttgttctttgcatgctccgggcgccaagcggccgtatcggctcggctgtacgcgtctgctgacgtcacgtaggggtgtgggtatatgctatgcatcatatgcccaaaatgcccttagacatggggggtaccgaagcaaacctcattgttcaaatatgtccaggttgttgtcgaacccttatgttgggagaatatgagaactctaggccaaattagccttcgactatctatacctaatattataagacggatcctttcatagttcttcatctatcgctcttttgtatccgttgattttatgttaacaaagatattaacggccgacatttaaaact

SEQ ID NO: 59578 - DNA, 309 bp, Triticum aestivum
  Clone ID: PAT_TA_59578
tactgtcatcaggtttccagcgttctacaatgagaaaatgagatcgatgcagatgattatggtaaatggtcatacgtcgggaaatcaacctgtatatgacaatcaggcaacacgcccctatttcatatgaggcagcacgtcaggatccaagtctagttcaacgtgcatggtacgtcagaaatcatccagaggctgaagggatttcaagtcactcgatggtccttttaacacgtcattacagtgaacaccaatatctttctgtatcataatcaggaagcatatcatgactcctgcacaaactggattatt

SEQ ID NO: 59579 - DNA, 423 bp, Triticum aestivum
  Clone ID: PAT_TA_59579
accacctatggataggctatttcctcgcgggtcccaaatgtcagaatccaaatctgtcacggccatgcagcctttcctatgaaaatttatagcccatttgatgtgctggctcgaaataagtttgtgggtgctggtgggggctagtcacttggcttctgtaatgcacagtgagatcaagcagccggcgagggtgatgttatttcccttggttgggatttgttacaatatttcactcaaaattaaacaaatggcaagccatttgccttgtttcaaagaaaatatgacagtcacagccgagttgaaaagggcaggaacatctaactccaacttacaaactgtacaaaagtacgagggttaattgttcatcaggtttacaaaaaaaccagattgaaaagggcaacaacatctaactccagcactgtt

SEQ ID NO: 59580 - DNA, 408 bp, Triticum aestivum
  Clone ID: PAT_TA_59580
aaaaagaactcgaccagcagaaacagaggacgatgtgctctcggctgaggacggagctgttgcggccgctccgcgtggcgctggtgaaccggggccccgacgcggagctgctggtggcaaacccggtggaggtgtccgggaagggtaggccgctggtgttctatgacatcaccctcgcgctcaagaacctccatagacgagtcttcttggccgagatcgggaggcatgtggtggacgacagggagtgggaggtgtacagggtgcacctgggcgaggacgaccacgagctctcgtgctcggtgcggagcaagattgtcgatggcgtcaccaacatgctcatgggctgggactgactgaccgactggtcacaccatgcatcttccttgacatattcagtcttgttgcaaa

SEQ ID NO: 59581 - DNA, 414 bp, Triticum aestivum
  Clone ID: PAT_TA_59581
acgcaaatttttgatgtagaacactctctctaattccttacggtttaagagcagtttcgattttaccgaaaagcggacactctgttctgcgcgagaccaaaatcgtcgtatgtactgcatcggacagaagaacgcattgcttcagacaaacgcattgcttcagacaaaataccgcactgcatcagatgggcaagtgcactgcatggtttctttttgtttaaacgtattttttgtcggacgaggaaagaagaacgcactgcttcagacgaaataccgcacttcatcacaagagacaagtgcactgcatgattttttttgtgagatgtaaattttcccatacgagtttttgtttttgttgtctttttttcaactttcttttatgaacgagaagtggacgcaaagacaaggggaaat

SEQ ID NO: 59582 - DNA, 410 bp, Triticum aestivum
  Clone ID: PAT_TA_59582
atatctgaacacaatctctttattgcattcagtgaagaaatctgttgcagaaaataaaatacgtacgtgtgcttgcactgtcttcctaataatctggtgtaagtttgcttaatctgtccttttttaatcgacaatggatgttggcaggagcaactgacccaccacgatgctcagttcagtagaaaaaaaggatgctcagttcagtacagatctgttgtgattttgcaaggcctactgggggcaaggcacaaatgtatcaagggggtgtatgtaaaaagataactgagttgatcccctcccttgcatgcagatccaacacaccatggggtcttggagcagcgtatcatgagatggaccgtagcactagatattttcccctagctgtacaccaagcaaaatcgaccttggac

SEQ ID NO: 59583 - DNA, 412 bp, Triticum aestivum
  Clone ID: PAT_TA_59583
ggaaagcaacaagaggcaatggatatcgtttcacacttaaagttggggcgttccctaccgaaaccatcatgcttgttgtgagaagctctggtttgtgataagcatcttcccaaacctgccccaaatgggacaaaaaatttaccacggcatgatgatgcggctccattatagcatgccaagttacatgaatttcagacgagtgtcggatttactagattttataaactaggcatctcaatgtttgtggcagggtgtttgacattaattcccatttcttgcatgggacctaagcatgcacccaaggacaaaagatttgatttttcaaccaatttatatgcaccggagcatgtgcatgtagttccaatttgcattatgcacataaatgcattgaaaactcacttaatgcataaaa

SEQ ID NO: 59584 - DNA, 367 bp, Triticum aestivum
  Clone ID: PAT_TA_59584
cctcgaacgccgctggagaatcgccttcgatcgggatggccgccagccgtgaagcggcagcgacaatgttgtccattgggttagaatagtgacccggtggtgtggggacgtgcggtgccacaatgttgttctgacgaggcggatccaccaaacgtggttgaactggtgcccctgctccaggtgcctccgcccggtttaccaccggcggattactggtccctgctcctggggtgttaaagagatttctagcgtcataaaccggcggcaggtgagatcggtgcctcctcttcaggacttcgttcgacgcactctgatccagcataatccggtaagcttgtgcatccaaagcggcccgctccgcgactat

SEQ ID NO: 59585 - DNA, 373 bp, Triticum aestivum
  Clone ID: PAT_TA_59585
gaagagtatccatcagcacgatggcgtggtgacgatcttgatgttcaactgtcgtagggcttcgcctaagcaccactacaatattatcgaggattatggtggaagggggcaccgcacacgactaagaaaacgatcatgtggatcaacttgtgtgtctaggggtgccccctgcctccgtatataaaggagccaagggggggtgcggccggccctggtaggaggcgcgcaggaggagtcctactcctaccgggagtaggactcctactcctaccgggagtaggactcccctccctttccttgtccaagtaggagagggggaaggaagggagagaggaggggaaggaaaggggggcgccccccacccccggctggc

SEQ ID NO: 59586 - DNA, 389 bp, Triticum aestivum
  Clone ID: PAT_TA_59586
agtagtactgcctgcttgatgtatggtgtgtaccgctcatcgtaaggcatggcaggaccagagaccccgctgataccgagatcttcagaggttcaagcttctgcaaaaaacaagtaatgacaaatcttagggcatgtacatttcaactaaaggcaaatttgcaaaatatttagattactcattattaccttatccttcacgcgcatcatgtatgcccggtgttgcacgtcgtaaacatcatccaaaagccaaaccatccttacaatttcatacaataaacatataaaagttcatcttcatctcaaatatcggtatacactaaacatataacatgtgttcaactacaagaatctcaacatctccttctcacataatgaatatgtcatatg

SEQ ID NO: 59587 - DNA, 408 bp, Triticum aestivum
  Clone ID: PAT_TA_59587
gacacgtacgggttagcacccggttactcctaacagccgatcctgaaagggtgcttaaggggatcagaagaccaccaccaccgccggccacctccaggtccgtgccggcggcatccttcgtgtctgctacatcgcctgctgatgcccttcctcccgacgatcttctcactgctggagatgctaaggtggagccaggggctatcctgttaatggatcaagataatcacgcaatgaacattaaaaatgatgccattttgtttgacatagacgaaccttatgcaaagaactttcccacatggagagtggagatcattgtctcatgtaaggaatctcccaatgtttttctgccactaaggttgaaggatgttaatcatgatgataaggcagacattgggagagatctcaaga

SEQ ID NO: 59588 - DNA, 323 bp, Triticum aestivum
  Clone ID: PAT_TA_59588
gggtccgaggaagtactggatcatcaagaactcgtggggggcggggtggggcgaggccggctacatgcgtctgcagcgcgacgccggcatgcccaccggcctgtgcggcgtcgctctgctcgcgagctaccccgtcatgtgggtctgccattctggctggtggtgtgtgtagagtctgccattctggctggtgatgtgtgtaagtaggctaatgcagcattgtgaagtgtgacagaatacaactagtagtacaaaatatctacataagtgtgtaaatatgcgcgtggccatatttaatttacataatggcaaggttgagcagt

SEQ ID NO: 59589 - DNA, 379 bp, Triticum aestivum
  Clone ID: PAT_TA_59589
gttcggaggctgataagctcaagccccctgtggagccatgatttttgcagttgagagatggatccttcctgtgtatgtatcgctttgctaaagcctgggtggtgctcacaaacacttggcacttgtgtgattcttttgtccatggatgtactgtgtacaacaagttgatgggaatgtgatttggtatatgctttcagttgaaaaaaaaaaaaaaaaaaaaaaaaaaaaaaaaaaaaaaaaacacaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaagggggccccccaaaaggtttaaccttttttttc

SEQ ID NO: 59590 - DNA, 407 bp, Triticum aestivum
  Clone ID: PAT_TA_59590
cagtgtagtcaccttggttggactggggccttcgtcctcacttcattaaaccacgtcgaggaattcggcgtcactctgccggcctttattgctatgctatgtcaccactccggagtgccgagctcttcgatctgccacctcgggaccggcttgggggctgggacctcatcccgatgtaagctcggactgcgtcatcaatgccaaacacaagaaccagctaagtcgctcttatgctcaaagttttaaaaatttaaattttgttcggttcgaccaagcattatacttttttggcaaagagttgtttgtgaaaaacttccttgtcaaaactttgtttgtgacacacaaattcaaataccccgtttacttgggggcttcctttatgaagccttccatcttgcatatgatta

SEQ ID NO: 59591 - DNA, 423 bp, Triticum aestivum
  Clone ID: PAT_TA_59591
gtggaagtaggaaaatgtgtttgggctatcaaattttgtccctatccttttcggtagcaaacagttgtgttttgaactagagaggatacaagatgctctttgtggttcttccaagtacaagagtgcaaatggagagttccctggtattacttctgatccttgtgagcattggaagcttcaacaaactgcaatgtcaggattcctgatagagattgggtggttaataaagaagccttctccagatgaatttaaaaatttactgagtaaaacaaatgttaagagatggatatgtgtgttggagttcttgatacagaacaattttatcaatgttcttgaaatgattgtgaaatcatcggacaacatcataggctctgagattctttctaacctggaaagtgggcggttggaacatcatgtcacagc

SEQ ID NO: 59592 - DNA, 327 bp, Triticum aestivum
  Clone ID: PAT_TA_59592
gacgtgtgagatcgttagttgatcgtaagtgtcgaggaaactgatccacgaacacctatggggatcggcggaccgagccccattcagttcagaggggggcggagatcgcacgaagagcggatcgaggcaatgcacacgagcagtttacccagcttcggagctcttcggagagataacactcctactgctgcttgcttgattgtattaagttctcgctcaggagcgatgaacgctaccagaccgagcgtgagagtattcttggtgtttcgaatgagccgaaccccttctacgttgcgcatgggcctccttttatacgctcaagggggc

SEQ ID NO: 59593 - DNA, 289 bp, Triticum aestivum
  unsure (1)..(289): unsure at all n locations
  Clone ID: PAT_TA_59593
tatgcgacggagccggggtactcgggcctgatcatcgccggggtcgcgagtgttgtgagcctcgccatgaccgtctacaacatccggcagcgccctgtctttgcttagctgcggattattgagcatcttggaacctcaagagtggcgacctgaagaagggtcagacttgcccttgcctatggcagtttaatgttgctattatctgtcttctgttggatgtgttatgagtatgttgttggttaccaaggttctatatctaaaanaaaaaaaaaaataaaaataaataaaa

SEQ ID NO: 59594 - DNA, 391 bp, Triticum aestivum
  Clone ID: PAT_TA_59594
cgtacaaatcaaggtgaaatctgtccaatcaatttttgttgatatattttttattaaaaagccaaattactccggcttgtgatattgtttatgcagagcaattacttactgcaagagcggtggcgacttgcctgcgtccgtactgactctaatgacaacagtcgtctttaccgtccgcctccgcggtttggtgtatatcaacacattggagctgcactgtctgcatgagctgtttattgagtgcaagaaagtcactcctcgggtagcccggttttttcttccaacaatttgaaggctaattactatatattatcaaccaccgtctgcactagatggctcaatgagcaggtgcacaagtcgccgccactatagtttggttaacttcaaaata

SEQ ID NO: 59595 - DNA, 413 bp, Triticum aestivum
  Clone ID: PAT_TA_59595
cggcgaacagcggcatcgcggcagcggcggcttggggctggggcggctaaggtttgcccgggccggtgtccaggtcgaacatggcccgtaggtcggtgcgtgtttttttaaaataattacgcgtagaagaaaaataaaaagaaatactaaacggactccaaaaattccgaaataaattttcacgggcttctaaaatcaagccgcacaaggtgaacatttatttggcacctaaatgcaattttgaaaaacacacatttttcctaaattcaaataaaacaccaaaaaaactccgaaacaaaatcttatttgattttattattaaatcctcaatatttctttattttgggaaagtcattttattcccactctcatatttttgcaatagaaataattgatgataaaataaataaaat

SEQ ID NO: 59596 - DNA, 432 bp, Triticum aestivum
  Clone ID: PAT_TA_59596
gaatattaaattccaattgccattaaagaaaggcatggagcactttccaggaaagaaaatcaaattaccttatgaatctatcgtgcgagctccctatgaaccaagtgccaaagatggcactatttagatctatcttcgcttttatgcctagctaggggcgttaaacgatagcgctagttgggaggcaacccaattttctttatgttctttgtttttgttcctgtttggtaataaattttgtttctactttctgtttagatgtgttttcttcttttaattagtgtttgtgccaagtagaacctataggataacctatgatatgagttgatttgattctgcggaaaaacagaaactttgcactcacgaaaaaaattcaataaatcacaggaacgtgcttttgcattgattccttttgctgctgatcaataaaca

SEQ ID NO: 59597 - DNA, 392 bp, Triticum aestivum
  Clone ID: PAT_TA_59597
tcatttcatgcatgatgaattatcttcataagttgaagaggatctccacaagtacaacctgccatgtgcatttgcattccaaaagcaaattacttatatgcacatcttcagggggagcccttgccacttatgaagacaataccctatcctttacaatttcacatacttcattcccgttgaaaacttcaaccagtttgtcatcaatcaccaaaaagggggagattgtaagtgcatctagtgccacccctagttggttttggagtattgacgacaaagttggttgagggactaatgcgtttgtgagaattgcaggataactcaggtagtgtccctcattgattcggtttacctaccggagatgacccctaaaaatgtatgaagacattgacgac

SEQ ID NO: 59598 - DNA, 428 bp, Triticum aestivum
  unsure (1)..(428): unsure at all n locations
  Clone ID: PAT_TA_59598
gtctcattaatggaatgccaatgaattacaaacttgtcgtcatcctgaaacattgagaatctcggtttttaaatcccagtaaatcaaaaactcaaccaaaaaacatgaaacctggcatggtttcatgacatggcacatatatgccgtggtaaaaaaaatcgtccagtttgagaagaggcgcacacattagtagccaacaaagtcctttttgaaacaaaaatctgacatgttaatatcgcaaatggttgtattatattaaccatgtcgaaatttaaccatacttggtggtgtgcgtgcagctgtttgattagacgggacgagcccgagaagtccaccgtgcaggctcgacgggacgcgtgcgaagagtctgccgtgcaggctcgacangacgcgtgcatcctgtccgcctcgcaggctcgacgggacac

SEQ ID NO: 59599 - DNA, 428 bp, Triticum aestivum
  Clone ID: PAT_TA_59599
acaaacttgtattttaggttgcaaaatgatatattcacttaagtgagctgatcaatcccttctgtacgtgtgacgcctctcttctgaaaaaagagccttccgtaggttggtaatgaaacagtgatgagggatccactggatcaagcgcattgagccattgactcattgtggagtcatgagtctccacgaggagtccaccctttctgtcccttttccaatattttccgtatatcttccgttcaacatcaatcttacgttgctgaacattgctcttgtatgtaacaaaccaaaagtaaataataacaatatgacccaagaattccagaaagcgccacttacgcacgagacaatgccagctgtactagttgttgtacacacatgttacatttggggatggggattgggattgagcatcgcaagatcgaacc

SEQ ID NO: 59600 - DNA, 169 bp, Triticum aestivum
  Clone ID: PAT_TA_59600
tgatgctaggagctgaagacttggcatcctttacagcatttgactaattccttggcgtcttccaaagtagtcggccagaagaaaccatggcggaaggcttcggcgacaagtgatcttgaggccgcgtggtggccgcattcgccttggtggatatccttgaggattgctc

SEQ ID NO: 59601 - DNA, 278 bp, Triticum aestivum
  Clone ID: PAT_TA_59601
caggcaaccgtgtagcaacgaccatggtgaccaaatccttcgattttgtgatggcaggtgtgcatgcctctggctttgtcgcgtattgtgccatatttcgatagtgtatctagtgtcctgtgttcagtaaaccaacgctcgtctcgtctttgttgagtctagcatctgtgttgcttctgttcataatcgtaagcgaggctccagtgtcgtgtgcaactgcaaatagttttgtcctattttctactgctgctgctattggtccagatgaactttgtctc

SEQ ID NO: 59602 - DNA, 409 bp, Triticum aestivum
  Clone ID: PAT_TA_59602
cgcccaaatgatagctgcaacgatgttttcgttgttgttcagaggagaaaagttaagacttggtcaaaacattgctgaagaaaaactgtgtattgctcacacctcacaaacaggaatactagtcgagctgcttggtcccaactgtcggccgcttcttgtgcaattctcgcgtttattgacgacataggttgacaatggtgtgggaccgtgatgtcaggaaaccaggaggaagcaaaaaaattattgttttatatactaataaggaggcacttgcgtacgtgcggctatggccctggtgggtccccactgtcatcctctccaagtaaagtcatctcctcatcctcatgttcgttgaccatgttgataacgcgagacggctatgccacgacgaacgcaacaactccaaaga

SEQ ID NO: 59603 - DNA, 372 bp, Triticum aestivum
  Clone ID: PAT_TA_59603
cagagcaaaatcgaatgaaccagacgccattcctaaacgaacgacggcgaggacgagcagaatcgaatcgaatgaaccagacgcgatttctgaacgaacgacagcgaggacgagcagaatcgaaagaaccagacgcgatttctgaacgaacgatggcgaggacgagcagaaccaaataaaccaagaaccccacggacgagcgaaaccaaatctgattcttctaatccgacggacgaatcgagcggggatgagcgagatagaaccaggcgcaggaggaggcgaggcaggaaccgaggacgagccgaggcgagagggcatggcccgggcgaatacaggaggagtggcccggagccccggatgaagagaggggga

SEQ ID NO: 59604 - DNA, 384 bp, Triticum aestivum
  Clone ID: PAT_TA_59604
cggattgatccccaagtcgttgcatccttcatgtggatattcttctagtattacaaagccccccatgtagatagcttcgtcggcttgtcgaacactcgaacaccacctaaattcctactattagaggaaaaatggtactgcagatactgattaatgaaccgatctcttggttggaaagggaaataaagatgttggcctgaccggtctcttggtcgaaaaaggacagaaagtggggggtgttgggtcaacaatccaaccaagaatgagcacgtctagatttcttatggttacataggaaatttcgctgacgagaacaaaaaatgcataaatccaaacatgctttgcatgtctgccgcactcggcaacacctctgcctcaccattt

SEQ ID NO: 59605 - DNA, 386 bp, Triticum aestivum
  Clone ID: PAT_TA_59605
gacgggacgtgatggaccgctaaacctagacaaatattgaggaaaatggagcttgggggtcgagcttggagaggagaaagcttacctagtgtggctcgggcatttcatcgaacacctcatgtgtataggaggtgagctagagcaccacaaagccctcccctcgtcgtccagaaaaaatagagcaatgtggagtcctctgctggccggcgagcgggtatatataggcatctcattggtcccggttcgtggctggaaccgggactaaaggacaccctttggtcccggttcaagccaccagccgggaccaatggtggtgggccaggagcgaggcacattggtcccggttcgagcctcgaaccgggaacaaagggtacagatgaaccggg

SEQ ID NO: 59606 - DNA, 402 bp, Triticum aestivum
  Clone ID: PAT_TA_59606
tttggcaacctgctgctggagctgatcaccggccagacagcgctggagttcggaaaggcatcaaatcagaagggagccatgctggattgggtgaagaagatgcaccatgagaagaaacttgatgtactggttgacaagggtctgcggagcagctacgaccggatcgagctcgaggacatggtgcaggtggcgctcctttgcacacagtacctcccaggccaccgaccgaggatgtcggaggtggttcgcatgctggaaggcgacgggcttgcggaacggtggcaagcgtcgcaacgagccgactcacacaagttcaccgtgcctgagttcaccttcagccgctgctactccgacctgaccgacgactcgtcattgctggtgcatgccgtctagctctccggg

SEQ ID NO: 59607 - DNA, 415 bp, Triticum aestivum
  Clone ID: PAT_TA_59607
tggcctactttcagaattttataaacagccgcacataaggtaatattttaaatcaacaaagtgccatatagcgcaaacaaattcgttttcatactacaaatacgacatgagtacatttactcaaagattgtgtccttggtacattcgtcagccatgagacgagcgcctttcataatgccatcataatatttctcggggtagcggtgcaccttgccctctgggggtccatccttcaccagcttctctgcatctagcttggcccaatgcatttatgcacgggcaaaggctcggcgggcaccctcaatacaaatggatcgcttgataacttcaagccacgaataggcatttaccatccgctttataaggccggagtagctatcgggcaagggctcaccaggccacatctggactatga

SEQ ID NO: 59608 - DNA, 382 bp, Triticum aestivum
  Clone ID: PAT_TA_59608
ggcgataaagatcatcttcaggcacaaggcgccggtggctgttgctgcggcaatcggctgctgttgatttcattcacgcacgctaatcgcggacatcgatctatgatctatctttatctttgtggaggatggatgataactgtttgttgtttgacaaggtgacatctaagcagctcgtttgtgtcattttcttttgcttgtgttgctgtatatgatatgtatcactgggtcagttgatgctcctcatgttgaatcatcacagaatacctgactgcggacgaacggacacacggtcgctctaaaggatcgacgtttaactagccgttcatgctacttcagaactcttcaaaagtgtcacccaacttcacttcattgaacgtca

SEQ ID NO: 59609 - DNA, 275 bp, Triticum aestivum
  Clone ID: PAT_TA_59609
gatcgcaatgacgacggctcttgctagcagttccacatcaaaccatcaaatgtgcctgagctttagcgctcacttcagtgacatgtttatggaggaccgctttcctacattgtcatcctggtaaagggatggcaaacatcgtcttcatagccgtgaagctcaatatgaagcactgctactctaactcgaagtacaaggattactgcactgatgacaacgtcggccaatatgatgatgtcgctcacgcgcctgagtttgacatctatcgtgagatg

SEQ ID NO: 59610 - DNA, 192 bp, Triticum aestivum
  Clone ID: PAT_TA_59610
cggatgagatggaataaccagatcgtggaccaacaagaacggccgcccctccgggaaaaaccccccccttgtggtaaaaacatacgggaaatccgggaacaaaaaacattaggaaccccccgaaataaacatgaaaaattgaaaaaattgacagatactgggcaagatgtcaaacacatctggcttcctctc

SEQ ID NO: 59611 - DNA, 462 bp, Triticum aestivum
  Clone ID: PAT_TA_59611
actcactaccactagggagcatcatggaattggtgatgaaggagggctgatgatgacgatgatcgaagattcccctctccggacccccaaaccggctccacatctggcctcccgatgaagaacaggaggtggcggtggcttcgtatcgtgaaacatgatcaaacttcctctttaatttttctctccaaaagacaggtttttatagagttggaattagggttagtgaagccttgtgggacccactacccaccagggcctgctagagggggatggcgcgccctcatgcctggcgggcagccctccggtaggtcttggttccataaatcatcatttattccaacataattccccaaaaatttccttccaattccgagaacttttatttctgcacaaaacaacaccatgatagttctgctgaaaacatcgtcagtccgggttaggttcattcaagtcatgcaaact

SEQ ID NO: 59612 - DNA, 248 bp, Triticum aestivum
  unsure (1)..(248): unsure at all n locations
  Clone ID: PAT_TA_59612
tacataagggacactttccagaacgtttcagactccgaaaaaggaataggtacttggaacggtaagtaaaccgactcaaaaacatttctaagggcaattttcctccgttttgaaatatttacaaaaataggaaaataagaagcagtccgggaaagacacgaagcntccacgaaggtgggaagtgccgcctaccccctgggcgcgccccctgcctcgtgggcaactcgtgtgctcccgggactccgttt

SEQ ID NO: 59613 - DNA, 460 bp, Triticum aestivum
  unsure (1)..(460): unsure at all n locations
  Clone ID: PAT_TA_59613
cggagcttaatcttccttctgctaatgaattgattagttctcagtcaaacaatgaggcaaatgttagtgcgcgcacacatcaatttcctaactaaaatcagaaggctgtgagccatttgatttattttaattgcatgctttttccagggaaatctggaaagcacacaggaagtgcaggtgaacccaacgagcttatctcaatacagggacatccagagaaagattgttgagtttatcagaaagagataccatattctggaaaaatgcttggacattgaatatgccgtgataaaaacaaatactcctgttcctgatgatcttactgaacaaaatgttcctatgggacatagcccagctgttccagatatcagtgaagtgttgagagaacttccccctcttgtaccaatttctgccaaagaagtggcttctgatggctcaactgaccangcacacctttccc

SEQ ID NO: 59614 - DNA, 261 bp, Triticum aestivum
  Clone ID: PAT_TA_59614
aactcagtcaacacaggcgaccaaacgcaaaacattgctttcctaattcagcctggctatatatgaggcttaccaaactacatgaagaacatgatttttaccggtacgtactcagcgaggttctgtcacagatggaatgaggcaaaaaaatgatgcggtctacgaaacacgtccttaatgatttttagcattcgtgggccgacacagttacgcagggctcataatgtgggctctacaatccctaaaaaaagtgggctctac

SEQ ID NO: 59615 - DNA, 465 bp, Triticum aestivum
  Clone ID: PAT_TA_59615
cgggggccaagcaagcacaaaggccaaagcaaagcggtggataagtaccactctctcctgagccctaatgcaatttcatcagggcgggcatataaaatctaggggcctgtttgttcttggcctccccatacctctcgttccatggggatctgtggttggattggataaaagatgtcgtgtgtgtgtgtgtcttcaggtcccttgggttcccaccccaccctctttttactggggcgaggccacgcccggtgctgttgaaaactcacgcggcggcacatacccacagataaagatgcaagaatttaatcgtggagttgccattggacaagatggccagcctcctcctaccgtccagtgcctctccatctcactctctttcaacctgtcatgcactagtagcactgctgcctagacgtagtagctggatgctgcccagagtggctgaaagaaggctgctttcggcac

SEQ ID NO: 59616 - DNA, 384 bp, Triticum aestivum
  Clone ID: PAT_TA_59616
cggtacggctacgaaaagacgacagaagcgacggggaggccgggtggcccacccaggcggagcccgggcagattggcgtcggggtgcaggaggccagggacttcaacgagggcatgattcgggtgtgcagcagcggcaagggcacgccgctgatgcccaacaggacgttcgagacctacctcttctccctcttcgacgagaaccagaaaccagggccgatcgccgaaaggcactttggcctcttcaacccagacttcacgcccgtctacgacctcggactcctccgggacggcgcgtccgtggctccaaccccttcgccgaacccatcgcccaatccgagccctaagcccgcgccgtcgggaggccggaagtggtgcgtcgcca

SEQ ID NO: 59617 - DNA, 397 bp, Triticum aestivum
  Clone ID: PAT_TA_59617
tcgagtagcagctttgagccggttcataagccggttgggtgagaaggctatgccgttgtatcaaatgatgaaaaagacggatgactttgtctggagtgacgctgccaactcctcctttgaagatttgaaaagacagcttgctgagccacagtttcttgctgcccccgttgagaaggagccgctattgttatatgtggctgctaactcacgggccatcagtgtggccattgttgtggagtgcaaggaggctggcaaggaacatccggttcaacgaccggtttactacgtcaatgaggtgctcattgaatccaagcaaagatatccacattggcagaagcttgtttatggggtgttcatggcaagccggaagcttaagcattacttccagggtcatcct

SEQ ID NO: 59618 - DNA, 403 bp, Triticum aestivum
  Clone ID: PAT_TA_59618
atgtataacattccaaattgaaaatttgggatgttacagtacatggaatatgctggcaagatcacactatagagcaatgatgaataatagctatcactacatgcatatttggccggtggaggctctaagtttaatgtttgcataaagccgattttccctacaacaaaggaataacttttatttgctaccaagttgaattacccatattgagaaggtttctccaactcaatcccaaattaccaagtataaaatactaacccaacaatttcattagacagaatgatgagattaacatataatccaaataccagatactcaagatgtccataactggggacacggctaaccatgattagtttgtacactctacagaggttgcgcactttttccccacaagactcga

SEQ ID NO: 59619 - DNA, 388 bp, Triticum aestivum
  Clone ID: PAT_TA_59619
aagcagcaaccaacttaccaaaagttgattataaagcatgctaatctgaaaaaacttagtctatggggctgttctgcaatagatgccctatatgtaaattgtccagagctgagtgatctgaacctcaactcttgcataaatctgaatccagaacggttgcttcttcagtgtccaagcttgaaagatgttcatgtcactggatgccgtgacatgttgatcggagcaatcagaaaccaggttctgaatgagtttgcagcaggagagcctcgcatgccttgcaagcgccttgctgatggctcgaagcgggtgcaagtccctcagttcatgccagaacagcagtttgaggacgagaaatggtgcggcgagtcgcggcgaagccagtgcgccg

SEQ ID NO: 59620 - DNA, 408 bp, Triticum aestivum
  Clone ID: PAT_TA_59620
cacctctacaaactggggatgcatccgaggcgaaaacagtgtccagcaaattcccgtgtgggtaatatttggattcataactctagcaaagaggctatctgggtgttgtagcagtctccacccttgtttcgcaaggagggcgaggttaaacaggtgcatatccctgaaaccaatcccatccgcccgtttaggacgagtcatgtgttcccacgacatctagtggaccttcctgtgaccttcttcatcaccccaccaaaaatcccttaccattttctcatacttgtcacagaaccctttggacaggaggaagacgcccatcgtgaagcaaggaagcgcctgaaccacagatttgacgtgtacttccttggccgcataagacatgaatttttccgaatagtcacaacaact

SEQ ID NO: 59621 - DNA, 389 bp, Triticum aestivum
  Clone ID: PAT_TA_59621
gcggataactccgcatgggatatcgatagcagcccagaaaggcgcccccgagataagcccctggccaaatcatgagtattcaaagactcgacgcattcatatatcagcctctttacttcataattttaacatgttgaatcatgtacttgcacttcggctcgttccgccctcgagcgatcctcatcttcggggaactcgctggacccaaaggtgatggacaatgggtcccttccgacggcctcctctcccagggccatggatgacaccaaggtgttgtcccaaaggatcccaggctagggagagacgcatgaggccttcagggcggtgacagaaggcgagacctcgaccgcctgacacatgggggagaagatcccatggagaccggcgat

SEQ ID NO: 59622 - DNA, 367 bp, Triticum aestivum
  Clone ID: PAT_TA_59622
gatctcaatgttggttatttaccggagagtcgtctcggtcatgtatgcgtgtctcccaaacccgtagggtctacacacttaaggttcggtgacgctagggttgttgagatattagtatgtggtaacccgaaagtttttcggagtcccggatgagatcccggacatcacgaggagttccgaaatggtccagaggtgaagaattgtatataggaagtccaatttcggccaccaggaaagtttcggtggtcaccggtattgtaccaggaccacttgaagggttccggggctccaccgggtggggccacctatcccggagggccccatgggctgaagtgggaaggggaacagcccctggtgggctggtgcg

SEQ ID NO: 59623 - DNA, 442 bp, Triticum aestivum
  unsure (1)..(442): unsure at all n locations
  Clone ID: PAT_TA_59623
tggatgcaagcacttagaatcatccaatgggtccactctcctgaacttaagggtttggcaaggtacactacaagcaggagaaagaatcaagggccaaagagcaagcaagaatatggttgccatacaaaccatcaagttggaccagaatgaagatgaggttgatacactcaaatttttcaaacaacatcattgggtttttgcataaagttgaatcataagctactacccgcatcccataattttggtggaggctagaaggaagtatttaaatgagttgtagtgcaaaattgcccaatggaccagagaagaaaattgggtgtagagctcaaaatatttcatgaataaaagacatttttgcataaaagtgatttaaaaacatcacctgacatctccanattttggttggaactttaaatgaatttatcagatggttgtagttcaa

SEQ ID NO: 59624 - DNA, 392 bp, Triticum aestivum
  Clone ID: PAT_TA_59624
ctcgacgacgtccttgtccagaacaataacagtgttatctccgaccatccagcggaagagaaggcataggccctggcgttgcggtcccgatggcgaaagaccatgcacgtcaccctgaagtttgagaggctgatgcccgcgtccgcgtccgcatcctcgccgccgaggagacagcgcccaacatgttgccgctgtggaaccacgctgagcgagggatttccttgtagtgccgcacaaggggatcgcagatgaggagccgtggcgcccgcgacctgtggaagaggagcaggaggtcgccccagatatcggcgagctcccagcggcaatcggcaaattcccccagcgggaggaagttgagcgccagatttcgatcggcgatggtgcccgcccac

SEQ ID NO: 59625 - DNA, 347 bp, Triticum aestivum
  Clone ID: PAT_TA_59625
aggaagcactccgtagaggatgctctatggaaaatcatgtcacttacctcccaaaataaaaaagacagcttagtcggctacttaccaactcaactacgaatttaaacctaccggtgagaaaaggttactttacactacctcaccatatgaatgatcatcccaagcctacaaatatgccacgttgtttaaagaacaagttaaaacgtggcatgagatcaaatacacaagcgtgactttaacatcggtgattacgtctagctatacaactctcatttaaaattttttgcataccaccatcgatccaaattgtaacgtccctacataagcgacgatgtctaccgtaccgg

SEQ ID NO: 59626 - DNA, 434 bp, Triticum aestivum
  Clone ID: PAT_TA_59626
agcaaagaacttctcctatggaggggaccatagacctcagtgtcatatcatcatcagataaaataggtgtaggtagtgatctgaatgtatcgtcaaccagcaccaactcagagctaaccactgattcatagaaacgccttgctggatcgaagtcgtctttgaatatttcatcagatgtattcagctcagctgcatctgactgaacaagcattttgaagacatcctctgaagggaaatcaatgatctgtgcttcttctaaaagaactgagcaaggcaaatctgaaaaggtgccatcaggcttgagagggtacaatgctgagtttctctcaagtagaagattatcattgattctcacaagatccatctctactgcagccttaactgttattggtttatctgcttgatagtctgcacatggggcatctttggaaaca

SEQ ID NO: 59627 - DNA, 412 bp, Triticum aestivum
  Clone ID: PAT_TA_59627
gacgaccacccccttggcggccgccttctcagtcttctttgccgggcggggtcttccttccttggtttcctttaatccaccttctgcaggctcgacggcgagcttggcttcgacttcctgtgctaagcctcgcccctcatccgtatcaaccgcgatcgtgacctcctcgtccatggagtcgccgttgtcacgcacctttgcatcaggtgcttgttcctccgcctcggtgaagggcatgtcttgggtgatgtcacggttcttctcctcctttgagcaattgttattgtcatgaacgggtgctgccatgacctgctgaacattcgatcgaaaagtgagacatcaaagtgactaacatccgacatcaaaccaacaatctaccacgtactaagtccaacagcccatgttcatatgc

SEQ ID NO: 59628 - DNA, 420 bp, Triticum aestivum
  Clone ID: PAT_TA_59628
agaacgaaccggaaacccaagaagaggaagactgcatctgacatgttccagctggatgatgtttctgagtcagaggtagcccctgactcccttggccaatttccaactatcttattgacactgactattgccaggacgacacgggggccagccaggccgtggaagaagaggtaactatttcctccgactcagcccctttgccgagacaaaaacttcgaatggtaacccggaaagtaaggttttcacaccatttggcttatttggaccctcattttcttttgaaaagcagcaacatgagagtcaccgtcaggcccggactaatgatgatgatgatgaaccaccttccgaattacaaaaaactcatcaaaaatgccagaatgaggtttctttcacctttgtccttttgttttatccatgaat

SEQ ID NO: 59629 - DNA, 348 bp, Triticum aestivum
  Clone ID: PAT_TA_59629
gttgcacattcagctggctagacgcggtcggcgggaaaccgagacaaaaaagcctatcacttcgtttggttgttgatattcaagcctaggtataaatattggcacgggataccccgaattcccctgtttagatggacaaggaatcagtccaccgaattggcctcaaatattgggtggcccgcttcgaaagcccgcgtctctattcccaaattcggagggggcgagctcgattttcggtgatattcgggaaccagcccgcgacttaccgcttcgaccgctccagaaaaggaagaggtgcactcgagcgggagagaaggtgagcacaacggcggcgcatgtcagacaact

SEQ ID NO: 59630 - DNA, 288 bp, Triticum aestivum
  Clone ID: PAT_TA_59630
aagaagaacgcgcagcctatggccatcgacagcaccgcgtgacgggtctgccgcgtcctggtacagccgggtctggagtttgtatcagcgttgtaccgtggttttggttgtcttgtcctctgttctgcagcttgtgcctcgtctgtgatcggctgcgtgccttgataatgtactcataatttgctgacgtacgattctagtaaaaagagtgtctatttcgttttaaacgaaatttctagagcttttatttgaaaataaagtgaaatgtgtcaatagttcatcaactcg

SEQ ID NO: 59631 - DNA, 349 bp, Triticum aestivum
  Clone ID: PAT_TA_59631
gaacgtaatccccacggtacgccggttccaagttcagtatccgcccccgcatggccgatatcgccatccgcaatgccgcgctaagtgagcacatgcttgccgtacatacatgccgaagaactccacgccggcggtcgtggtcgcgtctgccgccatggtagcgctggctgtcgctaaccgcgtgctcgaaaagctcgcgctggtgcccctcaagtcctacgccttcttcctcgctcatctcagcatgttcgggtacctcggcctgtacgtttcaatacgctaagtgatgtaccgcgcgggggtggtgaccctggacatgctggaactgccacagatccggttcgctgtc

SEQ ID NO: 59632 - DNA, 117 bp, Triticum aestivum
  Clone ID: PAT_TA_59632
aagttataagacgaccatctagaaggagggtgtgacgtcaagcacaagcactattatcacgggaacatgctataatgatggcgccatgatcccattgagaagtcgagggcacattta

SEQ ID NO: 59633 - DNA, 195 bp, Triticum aestivum
  Clone ID: PAT_TA_59633
aacacgatcatccgcttctaaaactccgttgcagaagaatgtccttaagcaggatagcagaggtccaagacgatcgaataagcacggcctcccgtctgggagttcctaacgacacctggatctccggggtcttcaagtccttccatccatacacggtggcatctggcaccaccgatacaccatcgggctgcatca

SEQ ID NO: 59634 - DNA, 225 bp, Triticum aestivum
  Clone ID: PAT_TA_59634
gaaacacactcacaatcaatgttcgccgcgattagaggctttggaatgccgccgcgctacaggatgcaggattgcgtgcgcatgcatgctaagttcatactcttcaaaaatgtctgcgaaatgcaagtaagaggccgtcgccttatatcctaccaacggggaacaatttacgctcacctatatcaatagccatgcagcagatctcactttcgcaatctaggataa

SEQ ID NO: 59635 - DNA, 390 bp, Triticum aestivum
  Clone ID: PAT_TA_59635
tatcgtaatcgagaggagggtcgttgggcagccgctgcgatggcgccatcggacccgagccgtcgtatgaggacgccgttccagatcaggttctacacctcttctcgtcggccatcaagcacgcacgtcgccggtcgcctccatgtcgccgcctctcgagagctttgtgcgtggaagagagccgcggggtgtgagaatgagatgaaacacgttccaagggctttgctgcaaatgtatgctgtgccggttactgggtgggtcccatgggtccaggtggcaacggtctgccagtcaacgcaactgcagcgagtttgggacctgggttgtacgccttgaaaacatttgggacccaattctatacttttgaagttttaggactagattgacaca

SEQ ID NO: 59636 - DNA, 393 bp, Triticum aestivum
  Clone ID: PAT_TA_59636
aggcatcgattcgcctaggggactgcggctgctagaagagatgcagcaattgaaagatgcacaggtacttgatgagatgccactaagtcaatctgctatctcaggttatattggatggtaatttattttacaatacaactacacctttcttgaatcagattcggactgtttgcgtgaaattttgttctatagctatttttgggtggctttctttgttttgctttatgttgtatagtcagtagaaaactcaagccccatcatctaacaattctgtagtaatgactgaaactattcgaggacaaatcttggattgttgttgtcgttggaatttagagttgcatggttgacacggtcaacatggcaaagaaagtatagaagatttgccaaaccagg

SEQ ID NO: 59637 - DNA, 408 bp, Triticum aestivum
  Clone ID: PAT_TA_59637
gcacatacacatgttccttggaatattgatggatcccaatgtcgtacttcaaaatgcagcacgcaagatcctagggtcagtgaatctgcctacacttcacatgtgtaaatctgcacttgatggtctcattgcaggtctggacaaatttccagaggatcaagatatatatggtgttctgttttccattggcaacaatcatgggagcttttcagccaatatagccaaacatttagccaacgatatcaatatggcatctgatggagagctgatcttggataaacctagaatcaaagcattgttaatggcttctgtcgtggctgcttatgatgataaagacataaaactggatatacccgcagttatattatcacatgcaattcccctatttgggatgatctcgtgtgcact

SEQ ID NO: 59638 - DNA, 202 bp, Triticum aestivum
  Clone ID: PAT_TA_59638
aaaccttatcgtcaccaatggtgggagattcaccaccgactaccagcagacttgttctgagaagctccggtttgtcacagacaaatactcaaccttgcaccgaatgcgatagattttgaattacaccatgttgaaggcgctccatcatagcataccatgtatggctacatcccttcgagtattggcttaactaacttttagc

SEQ ID NO: 59639 - DNA, 418 bp, Triticum aestivum
  Clone ID: PAT_TA_59639
agaaggcaacgacagcggcagagccaacagatggcaagctgaaaccctctccggtagggctcgatcctggtgagattgagtccccggcaggggctgacgccagcacgacaggacccgcgcgaccgggtgaggaggcgtaggagaagaaaatggtgcagcacccactgtatttcgtcagcaacctcttgcagggggctaggtcgaggtactcaggtgtgcaaaagctgctctttgggctccttatggcttcgaggaagctgcgccattacttccaagcgcacgaaatcacggtggtcacccgcctcccattgcaacggatactacacaacccagatgcgatggggaggatcgtagaatgggtcctggagctgtcaagtttcggtttgaaagttttaaagtacctccatgattcagagca

SEQ ID NO: 59640 - DNA, 382 bp, Triticum aestivum
  Clone ID: PAT_TA_59640
gcagcatatgtttgtgtaaacattactatatggaacagggttttgttcttgcgtgagtagtagaagcaatgaccctagtcaagcacaccatcctgaaaccttaatcatgctgacatcagcacagtcatcctaccatttggcgatgatgtaggctccaacgggacacgacatccgtaatgccctcgttgatcatgaccttatgtcgctactttcgcctaaggattatgtgattgctttcaagcaccatatcagagagcgcaccgagatgcattagcgaaccctccccgaaagcgaacttcacaatacatgctaccagaagtcgattaagacacgatgggatatctgccacgaatgaggcaagtacatgcacgccaattcattg

SEQ ID NO: 59641 - DNA, 316 bp, Triticum aestivum
  Clone ID: PAT_TA_59641
gaaagcaagcaggagtgtggtctccactcacatatgagagcaccataagaagaggggaggcttcgcatcacacatgatcttgccagttctggccgtggctcttcacgtcattgtcaacattaggatctacggctgggcataataggtcgcataaggacacatttaatgtgtcacattttctccacatcagctgtgaacactgtgcatatcgtgtcatgctgcctgcgtttaagacggttgtaagacagcgaagtgcttgataatgtaaactgaagaagtcatgtatcagatgtacaaccgcatcaagcatggagcc

SEQ ID NO: 59642 - DNA, 328 bp, Triticum aestivum
  Clone ID: PAT_TA_59642
gacagcttgaggtacaactgatcaaagtgcatccaatgctgaagacgactatcatgaggctgacaaggacgataaaggatcaggagaactgtgatcaaggcaacagtcatagactgctacacctgatagcacaggaagatgcactatcaggatcagttgcctcctcaagggtaaaatcaagcactgtccgagcttagatcagtcatcttatgcatatacattgaacgtgcagtcctcatttgaagacactaacgacacatacgccattcacgacctggatgcatgtggattccgcatcgtgaacctgattagtcaccatgtatccgca

SEQ ID NO: 59643 - DNA, 388 bp, Triticum aestivum
  Clone ID: PAT_TA_59643
atcataatgggctgctggaacatttggatgcagcgtaatggagtgattttcaaggctattccaacttccgttctctcttggagatcttcgtttcgggcagatatgcttttgcttaagcataggatcaaggacaagtttgctgatagactttctagttggattgatcagttcttaacataattatcatgttgcctcaaggtttcactaggactggagttgggtacggtgatctcttgtttatttgggacatctgtaaatatttttattgctttaatatatttaccgtagaacgattgttctacggttttcggttcaaaaaaaaggtgcaaggctggtcatgcgtggatgcctacattccagggccaatttcatcctgtttttctggtcc

SEQ ID NO: 59644 - DNA, 151 bp, Triticum aestivum
  Clone ID: PAT_TA_59644
gtaagacagataatatcgatataggtcattcaacaatattactcaatagatccatcagctctaactaaactgcgtataaatcatgtatgtataacgtactgtgttactgacgttagaagtctaatataaagacacaaatcaacagactaca

SEQ ID NO: 59645 - DNA, 133 bp, Triticum aestivum
  Clone ID: PAT_TA_59645
aagctcatgatgctgcacaacatcaggaccaacctttgtatgaatacgacacagtgatgggataatgctcccccttttatgaacttctactactttgtcaacaacaagttgaagtagaaaaagtaagtaaaac

SEQ ID NO: 59646 - DNA, 392 bp, Triticum aestivum
  Clone ID: PAT_TA_59646
gggcatggaatattcatttggccagatgaagatgctcaaaaactgtcatatcatttggcaaagccaaactggtacttgcctcacaaacatctcctctcgacataaacttggaataattatggtgatcaaatggctcaatgaaatgatgccaaattgtgtggagagatgttttatgggtataagaatgatctgggaatttatcatgatttttgaagcaatataaaatatacttgcttcataacctaacaatattgccagaatcaatgatttgcccctgtgctcacatagataattgtatgaggctgacaatgcgtggaatatgttaatatgatcacattaacgagtgtgcaaaagttcagctaatttgggtactcctagctagtacttccttc

SEQ ID NO: 59647 - DNA, 381 bp, Triticum aestivum
  Clone ID: PAT_TA_59647
cccaagacggcaccccccaagcctgcacccggcccgccgccatacgcccgtcaaaacaccgagacctccccctagacgtacgccgacaattgccatgcatgcatgatgccagtaatatggtatgcgaattaactaaagaagaagccacatatatcatggaggtacccggatatatagatagtgctcgatccataacttatagctggatttcaacacttatatatctagatttacgcccctcaaaaaatatatttagatttatgttattacagtagaaacaatgtcatgtatgacccacggtgattgtacttatactattcatgcaatatatatgtatataggaaaaaaaaacaatagacatcaaaaaaaaaaagcggccgc

SEQ ID NO: 59648 - DNA, 315 bp, Triticum aestivum
  Clone ID: PAT_TA_59648
gtgcaccaattaaagcagatttaggcagggagagatgacacacaacagatccatctatcgtcgctcgccactgctgcaatcttcctgcacctgacggattccgccgggggaccagtgctccgccctgtttacgctgctaactccccaagacttccttcgattacccccgctcgcttcactccttcgaccgatagtgtctggtcaccttcctccagataaacattaaatctcaatattcagatgtgtgtcatttgaaaatatatcaaagatgtgcttagcctaacatggttgcgctctagtagatacatgcataca

SEQ ID NO: 59649 - DNA, 366 bp, Triticum aestivum
  Clone ID: PAT_TA_59649
gaggtctacgaggcatctcaatctattttgtgaacccatcagtcggataaagcacccactgggcaacggtgatctgacgcaccgccgcagttaagttttcatggcagccacttaaaggttctcatcatctcccatcccgatcgacttacaggcgccgctgtaaagccattatcatgatctaggaaaccacttttcaagggtgtcgcgatatccctatgtttcaccgacaacgtcttgaattatcagcttctaccggcaatcagtcccataggcgatttcggcatattaggattacagcagctcctgggagtctgcatcgcctattataacctccagatacctatgcccagattataaaagctccac

SEQ ID NO: 59650 - DNA, 391 bp, Triticum aestivum
  Clone ID: PAT_TA_59650
cagaagaaacgaatatgaaatcgcccctcgccttggtgaggtctgggccgtttacaaggactggaaggctggatggactgcacgcgattttagcagctgtgactatgagttggtggagatattctgccatactaattcgtccatacgagttcggctgctgaggaaggttgatggttacagggcagtatttacaagggagacaactgtggagaccataggcaaggatgagtacctgaagttctcccaccagatcccttgcttccatctgacaaacgaaggaggaggcaagcttcggggctgtttggagctcgatccttattccgtgccggaggagtttctcctgactgactgaccttgttcatgcatggtgaacctcctggaaggctctttt

SEQ ID NO: 59651 - DNA, 314 bp, Triticum aestivum
  Clone ID: PAT_TA_59651
catgcaataccaacagagattcgtcatgattttcaagtttgacattgcgccagaatatggctcaagggctgaattctcaggacactattatactacaagtcatcactgtcttcagccatcattctcagtcactgaaccaatcaaatcaatactatttttcatcaatgttttcttggaggtggtagttgttcattagtaaagaactaagctaaaattttgtaaacatagtctcaacataatgtgtcaatgatttcccatactaccattggacaaaatacactcaatgtggtccaatgcacagattgtctcaccat

SEQ ID NO: 59652 - DNA, 278 bp, Triticum aestivum
  Clone ID: PAT_TA_59652
gacgacctcacccgccgcctcgcagagctcaaggcccgcggctaaactgaacggccttcgcttcacttcaggtacggctcatgcaatgttcactcgcctcgccgtacgtcagttgtcaagggctgctcatatctgacagccccgtaaatattgttaacgcccatgtgggcgctctctttgtctgggatctctatgtggaactgtgatatgacgtgttattccgaatcggagtgtgatattgatattatgagtcagtaataatacatgtgcttgagaac

SEQ ID NO: 59653 - DNA, 414 bp, Triticum aestivum
  Clone ID: PAT_TA_59653
cttctaaaccggtgtgagcgcccttcggttcgcgaggtgggactaaactctgaccgctactaggaccaactctttagtctcggtttgtggtatgaaccgggactaaagggtgagcctctggtcccgattcaagccaccaactgggaccaatggtggtgggccgggagcgaggcccattggtcccggtttgtcccaccaaccgggaccaaaggggccggacgaaccgggaccaatgcccccacgaggcccggcatgcgcctggccgcacgaaccgggaacaatgctcacattagtcccggttcgtgactgaaccgggactaatgtgaatattgccctgtgaccaaagcccagttttctactagtgaattctcatggagaacgaaacatttgaccatctagggcgtgcctccttcc

SEQ ID NO: 59654 - DNA, 430 bp, Triticum aestivum
  Clone ID: PAT_TA_59654
aaactcagattttcctcattattaaaaaatggaaacaaaaagttcaaaaaataaaaaagtagaagttcaactttgaaaaatagaacgcttcaaaatttcataaaaaagattaagaaatgaaaataggaagtccatattataaaggtggagaagttcgatgattatagaaaattcagattttccttgttattaaaaaatggaaacaagaagttcaaaaatgaaataataagaatttcaacttttaaaaatagagcgcttcaaaattcataaaagaggattaagaaattcagattaaaattcataaaaaactcagatatcttcatgtaaccaagaaacgttcagattgataactaacagaagttcacgtactacgcggtgtgcattttgtattaaaaaagaaagaaaaaataaaaggttgaaatatttgttg

SEQ ID NO: 59655 - DNA, 182 bp, Triticum aestivum
  Clone ID: PAT_TA_59655
atcctcaggcatgacaaattcgtcgtcgttgaggcttgcctcgtcttcggagggaggcatataattgtcatcctcgacctctctgtctgccgctctcttatgagggctggcttctccatcctcctgcgttgaatcctgctggagggggttgtcttcggaactgtccggggtgttattgtctc

SEQ ID NO: 59656 - DNA, 416 bp, Triticum aestivum
  unsure (1)..(416): unsure at all n locations
  Clone ID: PAT_TA_59656
aaggccccacacccctggtcaaggtgcaccaagacccccgcttagaaggaataagatcataccacgaagggataagatcaagatccctaaaaaggggggataacaatcggtggggaaggaaatgatgggatttctttcctcccacctttgccaacgccccaatggacttggagggcaagaaaccagccccctccagccctatatatagtggggaggcgcatgggagcttcacccttgcccctggcgcagccctccccctctctaactccacctcctcctcggtagtgcttggcgaagccctgccggagaactgcaagctccaccaccacgtcgtcgtgctgccggagccctccctcaacttctcctctcnccttgctggatcaggaaagangagatgtcccaaggctgtacgtgtg

SEQ ID NO: 59657 - DNA, 422 bp, Triticum aestivum
  Clone ID: PAT_TA_59657
ttaccttctatgggtagttctatccttcacggaacttgtagtcttgcagacgctattgccaggcttgtagttgaacttgaaagacaattcatgcacaagcatccttgcatacaaaggattttcctagaattttctaatattgagcattcttctgttaagcgtgccgctactatctttttggctcatgagtttagattcataataaaagaggccaaagaaatatttgcgcattatagggtggacgcttgccgtcctcccatagagtctatccttttttatcaagaagaaataatgcgttttcaatctctagactatgtttctttcaatgaaaatcttagaaaaagggttccttccaatgttttagttgatagaatttctgagcttaatgatgatttgggcaattcgaaataatgaactaggat

SEQ ID NO: 59658 - DNA, 257 bp, Triticum aestivum
  Clone ID: PAT_TA_59658
cattttcattgcatatattttacgcacgtttttcctttattttgcacatatttaggtaattttagatctactacggtctactgcatagctgcgttcactctaatgagtccctgatctattttaggcgcaggctatcagcccgcgaagatctggggtgaccgacgctgaattagtggacattgttgaacttgtcaccaaatcaccgataattactgctgagtattttatgtagactaaaaaaaatactaacagcggga

SEQ ID NO: 59659 - DNA, 309 bp, Triticum aestivum
  Clone ID: PAT_TA_59659
cataagcctcattatatcttcctcaaaacagccaccatacctacctatcatggaatttccatagccattccgagatatattgccatgcaacttccatcatcatcatatacatgacttgagcattcattgtcatattgccttgcatgattgtaagatagctagcatgatgtgatgtcattgctacgctagatcattgcacatcccggtacacctccggaggcattcatatagagtcatatctttgttctagtatcgagttgtaagtaaataaaagtgtgatgatcatcattatagagcattgccccatgc

SEQ ID NO: 59660 - DNA, 417 bp, Triticum aestivum
  unsure (1)..(417): unsure at all n locations
  Clone ID: PAT_TA_59660
ctagttctcatattcctgtgtggcagaccaaattggtgtggaagccagaaatgcagtacacgtaggagatgatgaaactgcagacaaggcgggtgctaacgctattggactcaagtgctggtatgcaattttctttcatacattgtggtttcttccccgtgcagacatcgtgtttcaatagtatcgggtattattaatttatcgggacaaaaagcgaaggaaaaaaaacattattgaatatctggttcggtggctgaccggctggctaactgattgttactgatgttgtccatttttaggctgtggggagaagatgtgaagaaattttctgagatacagcaccagatcgtagcaaaaggctcacgatgagtgcagggcaatgtctctgtntgcctgatttgttcatttgattgcaaa

SEQ ID NO: 59661 - DNA, 383 bp, Triticum aestivum
  Clone ID: PAT_TA_59661
ctacaaataaggtctttgaaaaagatccaaactctagaagatagtaaaccaccttcagtgttcatagatactgctccagcacagagaatttgtaggatcgaaagtatgtctagaggggggtgattagactactcgaccaaataaaaatctagccttttcccaattttaagtcttggcagattttaacaacttagcacaagtcaagtaatcaacctacacatgcaattctaagagtatagcagtggaatgtaaaacaattgcatatgaaggtaaagggaggagtttggagggagaaaacgcaatgtagacacggagatttttggcgtggttctgataggtggtgctatcgtacatccacattgatggagacttcaacccacgaa

SEQ ID NO: 59662 - DNA, 282 bp, Triticum aestivum
  Clone ID: PAT_TA_59662
cggtaatagctctccggcatgacgatgtgcatcctcaactgcgacaagaacctgaccccgatgtgcaacaagatcttccacctggggacctgcatctgagacgtacccttgcatgcaggcgatcgctcatgggaatgccagcgctggcacatgcaacagcaccgatatgcacagaattgagtttgccattctgttctaaccaggatcattgcccacaaatctagaatgccatcatgaccggatccttttacgactttttcccgggcctgccctttgttgagt

SEQ ID NO: 59663 - DNA, 426 bp, Triticum aestivum
  unsure (1)..(426): unsure at all n locations
  Clone ID: PAT_TA_59663
cgagtgctggacagcatctttctttctctccgtgtgcatgttgcctgcctgagtttgcgagtggccgaagcgaagcaacctcttctctgctgcctgcaacttgccggacaagtctgaatctgcaatccagtgcgaaccaatcgcatcgatccgatccgatccgatcggaacggccggaccaaccaatcaatcaatgccgctgatgctgcgtgcaaggaacatccaggttagtctagcaccactgctgacagaaagatagtactccaatgggtgtgcgtgcactccaccgcgtgcgccagatagatagatagatagatagatcaatcaattatcgtggattcaatcatcacccatgcgtgtcgctcacnagacataacgtctgcattatcagttgttgttgatagcactaataactcccctgccaag

SEQ ID NO: 59664 - DNA, 392 bp, Triticum aestivum
  Clone ID: PAT_TA_59664
caatgagtcgtttaccgagcggtagaggtgaacatttgaaccatgcactctgcatgaaggtggtgatgaatataaaggtgtcgattaccagtccgtaaatgtgggtgacattgtagataacttccgtcttcaggagcagactgcttttgtttggaagcattttagctctcacataaatcactacaacagtaaccactctgcgaaacattctagggataacatagaatgttttcaagaccaatgttcaggtctgcgatacacgtaaacatctatacacagcctcacgagacacttcaatacattgttggttaaattaagcattaagatgacagggatttctccgactactgtcaggaaggatcagctgattgaacattcctgtactttgcaca

SEQ ID NO: 59665 - DNA, 390 bp, Triticum aestivum
  Clone ID: PAT_TA_59665
aggccaggcatcgcgccggccttcaggaacgccgacggcggcaacggcaccatcaaaaccggcaacggctacccgtacgccagggtggcgacacccaaacggtccaaggtacgtgcgtgcgttctctgcgcgcgcaacgggcgtgccttggtttatcgcgtgcattgacgccaccaactttttgtccgcagaagaagagctggttctcctgcaccagctgccgattctgatgccgtagctgcttgccgtcggtggtgagagagatccgatacttcgccgcgccacgaccagatgcacgtactcggcgggaggcgacggtggaacttttggcgatcgtggtgcttctgaccctgctcggtcgccgcatctcacgtgcagaacatcatccat

SEQ ID NO: 59666 - DNA, 376 bp, Triticum aestivum
  Clone ID: PAT_TA_59666
gtgaattctcgacccacaaatcactgtgagttgtgagagcttgtgatctgcctttgtaccgaaggaacattcctctgtcgccatagatccggtaggattgcctctcgcttcttcggaaatgaaattcgtgcgcagatcatcgccgatgagatcagtgatccacactggatgctgttcttgtgtatggattttatggaggtttgggtttttttcaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaagacggggctacccaataggatcaaagttaactttgccgggaagggaatgtcacacccct

SEQ ID NO: 59667 - DNA, 195 bp, Triticum aestivum
  Clone ID: PAT_TA_59667
ggtaaaaacgagcgacggcgccgagatcgacaacgtgagactcgtcagggatggtgacaacctcctccttgtctccgatcagtgggcgcctgacactaccagcgcgcataggaatcaataatgaaaccactgatacattggttgggaaattacacttcgaaaactggttgtatatacgggggatttttaataatt

SEQ ID NO: 59668 - DNA, 282 bp, Triticum aestivum
  Clone ID: PAT_TA_59668
ggaggatacgaggaatgatgagacgaggaaggacgatattaagatgcataaggaggatcagacggaggagactaacgatgacaccacggagattaagccggagaacattaaggacacgactactgagaagaccactaccaagactaatctgcttatcaatgatgataacaataataatattcactacgatgaacatgcacatcgaggaggatatttatgactgacgacatgacgatggaggatattccgatgatctcccctctccctcctctctcccctttc

SEQ ID NO: 59669 - DNA, 390 bp, Triticum aestivum
  Clone ID: PAT_TA_59669
atcaacatcatcctacgcctcccacggattgataaaccttaggtcatccacttgacggaaatttgctattgtcctacagacctctgcacttgggggcccatcaacgtctacaagattaacgttgtgtactacacatcaagcaatttctggcaccattgccggggaagttagtgcttgaaggtatatctttacatcgtgcactcgaatctttgagtttcttgttttatcaccagtttagtcaataattcaactataaaatacggcactaagggtgcctcttatgcttcatcttttactatcgttcatgaagatcatgattccaataattgtgccaaagtgttatcagaagactgcattaacatgtttggaactaaatctttgaatgatgag

SEQ ID NO: 59670 - DNA, 321 bp, Triticum aestivum
  Clone ID: PAT_TA_59670
agactaaggtcagatcccatctgcatcgtccagtcttggacagtcgtcgcagctaatccagacagggacaatgaactcaggtggccatattgtgctatgcttcacgatatatctggccgtcatgaggaaattcttttgcatccacttttttttgactttctcagcaatgccgtttgtcacactctggttgatattacagtgtgacctgtgtgttaagaagggatgtttgtcgcatctatagcttccggaaccagctgctgtacattctttcatatgtcgttgaccaatctgctcaccgcagtttgccatttacaaatcata

SEQ ID NO: 59671 - DNA, 385 bp, Triticum aestivum
  Clone ID: PAT_TA_59671
agataacgcaactctggcaatggcgaggtcatgccttggagggtgcctgtaggtaatccggcacgtctgaacgatcgctactggcatctggtgcgccacgtacggtctatgcagggagtgggcatgtatgttccggcatgagtccacgctcacattagtagaatcaaagagccacacacactatggccgattgcattctgtaggaatactgccacgtcgtgctaacggccggagcagttggttgcaacctgaacggatggactcaactgttgatggaggttacgaacgtcaggactctaataatgcatttagcaaacaagtagtggctgaagggcctagtgaataggcgaaccggcggagcaattcatgcatatccgtgcttgca

SEQ ID NO: 59672 - DNA, 392 bp, Triticum aestivum
  Clone ID: PAT_TA_59672
aagcaaacgtactgcagagacgccatggtgagaagactccccaacaccatttggccaaacggggcctttgtggagactgtcaaggtgtggcaataggagtggttctacatcactgaaccccgcaaggccaaatgggcggccagtcctgatttaacatacgatgccccctaagtgaatcacctcatggaccgccaatggtctggactatggatccgcagccaatctattgatgctgcaaaaatgcatcacaaacatgattaagaagaacacctgtctcactaacatgattcaggtgatgctcttctgccggattcttccctgccaactccgatcctcccacatgtgggagttcaatctggaatatcctccgacactaaagcacttcttcggca

SEQ ID NO: 59673 - DNA, 381 bp, Triticum aestivum
  Clone ID: PAT_TA_59673
gcacaactggccggaggacctagtgttatagtttcctttttagcaaggttagtcattcttccatgaggaaattgtaagacttactatataagttgttcctgatgaatcctttgagtagccaaagtccgaccttgctcgaaaaccatgtcaatgctacctcgaagcatgtttgtggtactccgatgatcaatagttacatttgaagcataacgcaaaatgttctttactaattaccccaaacaccgtttgtatgggtaatgacatgatatttctctcacctttcctaaagggttttctacgttataccttgtcgtagagataatgttctgcttgtccttgggaaggatatacccctgaaatatgtgtttaaacacattttcc

SEQ ID NO: 59674 - DNA, 380 bp, Triticum aestivum
  Clone ID: PAT_TA_59674
gaacaacagaagatttgcctgatgacctcgtagaactttataagacagatcctgaagagaattatcatcagcgcaagacacggatccaacggattcgacgatattgggctgaacaatggttcaaatgcaagttcgtgacccaggaatatgctgagaagaatgctataaaaagtccttggggtgatattctctatcgaggccttcatcccaagaacagagctgaagctattgcacagggtttctatcactgtatggtccatggacctcagcctgaaaatgcctactcaacatcattgctctggtgtcgtgacgacaatctcttcaagcgtaactttcagcatgcaaaggcatcggccaaagaatacaagaagtcattggga

SEQ ID NO: 59675 - DNA, 265 bp, Triticum aestivum
  Clone ID: PAT_TA_59675
gtgccagttctgggatatgaacaacaatgtcaggatcaagcaagtgccggagatgaagccggtgctgcgggggacgaggaggtcgatgccgaagcgggtaaagatcatacatcggccttgtcccacctctgatcttgccaccagccatgtggaattagctataccatcttggtcatgatcgctgcactaatagattcatgaattatctgccctagatgaaaaacaatcagtcacacacagttcatttgtaaatcctttgaagaag

SEQ ID NO: 59676 - DNA, 384 bp, Triticum aestivum
  Clone ID: PAT_TA_59676
agacaggacacctttgcctctatcaaacccacaacttggaaagttttgaaagctgtaatgagacagcaatttttcctccttactatcgtcgtgaattgcgtcgcaaattggagaaattaaaacacggcagtaacactgttcatgcttactaccaagagttcaaatcttatatgcatcattgtgacatagaagaatccgaggatgatacaatgaatagattttttggtggtttgaaccatgatattcatgcaagatttcagtatattcctcgttgcattactgatatgtatgtccgtgcttgtacctttgagagacatatacaggaggatgcattgggtgactacaacaactattattccagttcatgctcaccaccgccggttg

SEQ ID NO: 59677 - DNA, 388 bp, Triticum aestivum
  Clone ID: PAT_TA_59677
accacaaggggaaggggctgtttcagtggcaccatcacgactcgcacaccacactctcgctccacctgaggtggccatacgtcgccaacatggccatggctagatttgcaatgacctaattgttcctgtccaccactggaagaaacttgtcctggacgttgatccgtttgtcgtcaatgacgacgaacaccatcacgccccgactacatcgtcatttctccgcaaagtacaccgcttaaggacacaaccataaaacaacctttatgtaccagtcgcgggactctcacattatactttagtcccattcttcatattacactgttattcagcccttaacgacaagtcgtctcgactagtcatttttcacagtagacctccctctctctaa

SEQ ID NO: 59678 - DNA, 395 bp, Triticum aestivum
  Clone ID: PAT_TA_59678
aggtcattgcttgtgcctaaccaactgttatttcttctacagagtgtatgtataatctcacaaacggactgtacaaacagcttctcagcacgaaccacaccagtaagcacacaagtccaactgatcatatttatataaaaacactataatcggctgaaaatgacaccatgcatgcacgaatcctggtttttattttatcacttattaaaaacatgtagtactcctagtaacccatgatttggaccagtctatggatctcaggaggaatttaattggttaacaacagaacataggaccaaagaccaccagaaaataatgcaaagcgacattaacgacagagacagtagtgcatgccctaatagtatttttttttgcatgcaaatcagctgggcccc

SEQ ID NO: 59679 - DNA, 136 bp, Triticum aestivum
  Clone ID: PAT_TA_59679
aagacagcggcatagcatagacttccaaatgtatgaagttgtatgcactaaaaagcggcgcagtcgcatcaacagtatagggcatctgcacactgcatgtcaaatcacaagttcacacgctgtcatgtagaacaaa

SEQ ID NO: 59680 - DNA, 378 bp, Triticum aestivum
  Clone ID: PAT_TA_59680
ctccaatagagcaagatcctgcatggaagtctccacatgcttagacagtggattacattgagcgaagactaatgatcaacatttaacttgataatgcatatgtccaggtgaacctccttggagtccccgtgcaccgcatcggcgggtaaaggatgccatgggttttccaagtccacattggcgggatagtcccagctccccggagtccaagtccgttcaatgaggccggtgtcgccgcccacgcgacccggaggggtagtaacaccgaccacgcacccgtacataggcctcgtgtcagtgtcagtgtcagtggcgtcgcccctgacgcacattacagagacggggtggcggcctgcgcgagcctcgccggtgcccacg

SEQ ID NO: 59681 - DNA, 377 bp, Triticum aestivum
  Clone ID: PAT_TA_59681
gatctacggtgataggatcacgacgagaacgactacttcaaccctgttcttttgaacgcttccgctcgcgatctacaaagtggtatgtagatgcatctcccatgactcgttgcttagatgaactcatagatggatcttggtgaaaccgtagaattttttttaattttctgcaacattccccaacagcttaacccccacatggtcaacacggatcatgacgcatgtgttgtgtgaccatgatagctatttccctagcaagctatatatatatatattctccactagttccattcagtatgtggacatgaattgaatcaatgatgcaccctcctgaccactgaagctaagaataggagcagaagttagagcgagaaaga

SEQ ID NO: 59682 - DNA, 378 bp, Triticum aestivum
  Clone ID: PAT_TA_59682
attaaatccatcactttatatgaaggagtcgccatcttctaattatctgcgtcataacccggctgatacttggtgagcttggtctcttcggcaatgattgtagcatgagggcgaatctccttgacacaagcagcaaagtcttgttgatcaaaaagagttccatcttccttgagactgggatacccactggctatgtccgccggatctaactctggtacctaggctttggcacggctcaaagctgtcacagttccggctctagcacaggatcgcttgatttcttggaacctagtgggcaagatggacaacttcttcaagacatcacttaataagtttggttcttgatttgcgggggagatagtggcaagagtccgctga

SEQ ID NO: 59683 - DNA, 353 bp, Triticum aestivum
  Clone ID: PAT_TA_59683
tctgatttggttgtgtttttgtgtttaattagtgcttgtgccaagtataaccgttgggaagacttggggaaaatctttttaatctcgccgtatcaaaacagaaactttagcgctcacgataactgcagccatttttatttcgaaagtgatacatagttaattattcttgcatataattagtaaatacattcctcacatccagcaatttattttagaattgttggggttccatatcttgcgttagcaacagattactacaaactgttctatttttgacagattcggtatttcgtgtgttgtctgcctaatttgatgaatctatgtctagtacaatactttagaaaccatacata

SEQ ID NO: 59684 - DNA, 378 bp, Triticum aestivum
  Clone ID: PAT_TA_59684
acaacaaatccccacatggtacctgctcgtcctcatgtctgcatatatacctccccatttttactcaagcagaagcatcggcttctactagttggaacagtctaccgcacatttaaatatgtgggcaatgaagaaaaaggggaaatatttctgagagacagtagatgatcatcaaaagaatgtgaaatgtataagagaattagaggcaccgggaagaactgcatcgttgctatgtagaccatgcatcaagctcaattttatcattcacaatggactccctttacctgccactagtgtcattcttttttttcggaaaaacttccaatctattcatcttcaatcatggcagtacaacgaatgccagaaataaaaattaca

SEQ ID NO: 59685 - DNA, 396 bp, Triticum aestivum
  Clone ID: PAT_TA_59685
ggctactgagcgaggcacggagacacaattgagatgaaccaattgacagattgcgatcagattgagttatcacccttctactgtcattgttgggtggggggaagggggagggagagaaaggcgtatcgagagtgtgcgcagtaggcatagaggcacaactagcgactgtgtgtgtatgtgtgtgtgtgtttgaaagaggagtagatagattactatcaagatcgaggtgccaccctactccttcggtgtcaggtaatgtgtgtgtgtttgagagagaagccatgtcgatagattagtatcaagatcgaggtgtcgccctactccttcggtgttgggaagtgtgtgtgtgtggttgtgtgtgtcggggggaagggggcagtgacacttacatatctc

SEQ ID NO: 59686 - DNA, 272 bp, Triticum aestivum
  Clone ID: PAT_TA_59686
gaatgaatgataatatcgatataggttattctacaagattactctatagatccatcagctctaagtaaactgcgtataaatcatgtatgtataaggtatgtgttactgatgttagaagttgattcaaaaaaaaaaaaaaaaaaaaaaaaaaaaaagaaaaaacaaaagaatataaaaaaaaaataaacgtgtaaacaaaagaatatatctttacaatcgtgtctaaaagtcacatcacagtgcgtctctttaaaaaacattgagtgtgaaaa

SEQ ID NO: 59687 - DNA, 338 bp, Triticum aestivum
  Clone ID: PAT_TA_59687
atggcttaaaaggaagcgctgccagggaaacaacccggaagttttagagagtcatttatttctgttgtctgcttttatatagtttaaaaacaaaaaaataaggaggggaacccaaaactttttcaaaaagaaaagtgaaagtgagatagacgagcattgtgaaagtgggggacgtccttgaactttgttcatgcccatggaaactttgtgaatcttaattacagaaacttttcaaaaaaaataattatccccttgtacaattccattgtattataaaaataatgtgccaaggtttgcctttaggatgtttacaatgcttgttgggttgtgccggtgta

SEQ ID NO: 59688 - DNA, 146 bp, Triticum aestivum
  Clone ID: PAT_TA_59688
agaggccaggagatgatcaggaagcgtcaaggacgaccaacgttcgcaaggtcgacgtaacggacgaacccgtgcaaacgacctgaaccggaatgcccgatcgatttcgcccaggacgacgacctcgccgtcgacgacttcaagga

SEQ ID NO: 59689 - DNA, 429 bp, Triticum aestivum
  Clone ID: PAT_TA_59689
gatgtcaatggatggtatctggctgattatttatatcctcacctatataaatatatgcagtgcaatattcttcagcggtagatagggtccctgctgtcatgtgcattctacttgacactgggtttttttcatttctgcacgggcagacctaaccctgtttcactgaatgttgcaagtaatacagaccaaagtttacaaccaatggcagaagaatgcgttttgacacttgagaaggcacataaatcttaaacacaaatacatctcctggaggcatatgtggcttgcttcggaacaaacaatgtaggtgcttcacagggttgggtcgctgcaaaaattacttaggtgtgcatgacagacttaatatatatcttaaaccaaaaaaagggaaaactgttccaaagctaaatggcgttgttgttcacaaaatga

SEQ ID NO: 59690 - DNA, 227 bp, Triticum aestivum
  Clone ID: PAT_TA_59690
ataacaatgcggattattgcgcgctgtctgctcctcgatgtagagcatgtgccgaccatttagaccacggtgaagagcggtgctctctcttttgcagtatcagcgacagatcaaggaaacgaaggccggcattgtactaaatttgtagccacttcggaaagtgtacattgattgtagcgcatgatactgtgaaatctgagatgtcctttcaccactcggtgacaagt

SEQ ID NO: 59691 - DNA, 427 bp, Triticum aestivum
  Clone ID: PAT_TA_59691
tcatcttatcttgatacattactctgtttatcatgagcttaatactttgagatgcatgctagatatcggtctttaggggcggagccaggatttgacgataggggggcgaagtattcaataaacatatagaagtttttttttcctaacaatgaccattctatgaggaatacaagataatatggattttgctattagaaaatggtagattttcattagtttgaatgtggttcttatgcctaaaactcacaggacaaaatgtataatcttatatggaattctaacaataacaatctctcagtttgtgaaattctaacaataataataacttgcgatgatgtagacatgagccgatgatataccttagatctgaagtgagtcctgttgagtagtgctaagggcaaattctgaaactaagatgatagaatca

SEQ ID NO: 59692 - DNA, 386 bp, Triticum aestivum
  Clone ID: PAT_TA_59692
atacatcaattttgaaaaaaaaatcatcggttttgaaaagagttcattgattttgaaaaacagttcatcgattttgaaaagagtttttcaattttgaaaagagttcatcgattccgaaaagagttcatcgattttgagaaacaaagttcatcaattttgaaaaagagttcatcgatttgaaaaatagttcattgattttgaaaaaagttcgtcgatttttaaaaaagttcatcgattttgaaaaaaagttcgtcgatttggagaaaaaaatatttcttttgtaaaagagttcatcaattttgaaaaaatagttcacgaattttaaaaggttcattggattttgataaaaaaaaattcagcaaattgaaagagttcacgtatttaac

SEQ ID NO: 59693 - DNA, 424 bp, Triticum aestivum
  Clone ID: PAT_TA_59693
catccccagcttgcaacaaaaaatcgagcgcccagggagatgcccagtgctgcaacctacgacgaaaaaagcttcaaccagctacgggaaaagtttcaaatcgtatgacagaaacctatgaacgaccaaagaaaagttacaaccggtgacaaaaaaaaacttcatctgacgacgaaaaaagcttcatccgacaatgaaaaaagcttcaactgtgaagccgtaagccatggacgacaaacgaaaaagctacaaccggccgttgcaaaagctacaaccgcattgaaaatgtcacacagtcatagcaaaatgttgttacaattgaagcatttctgttagcggttgcaacttttctaatttgcatggtgtctagttgtagctttctctctcaatggttggagctttttccaactacagttgaagcttt

SEQ ID NO: 59694 - DNA, 427 bp, Triticum aestivum
  unsure (1)..(427): unsure at all n locations
  Clone ID: PAT_TA_59694
aaggtaaagaggattaacgctgtcgccgtcggcgagggagggaatccactaccggtgcagctgttcactttcacccagcggcggcgcgggaaggcctccgagcccttcttcttcgccgccgtcccgtcgcccaccgaaccacgcaccaagaaccttaaggtataatttacttattccacatgcattgctctagttgcatgtataccatgaatctaggacgtggttcaaagaggaaaggagtgggggaaagtagtgggaaaagttgtatagcatgaatctaggacgtggttcaaagaggaaaggaagggggaaagttgtatagcatgaatctaggacgtggttcaaagaggaaaggaatgggggaaagtagtggggaaagttgtatcacataaatctaggacgtggttcanagaggaaaggaaagggc

SEQ ID NO: 59695 - DNA, 200 bp, Triticum aestivum
  Clone ID: PAT_TA_59695
gtaaactttgaacgggataggtcatcacagtgtatgtgtgagtgaaatggaattgccggatttcttgtcgacgcgagtgtcttcgctcaaatggttgttgcaatcatgatatacactagacgggaaggtatgaatcttacaggaatcaggtagatatagtttcattcaaactattgatctctcaagcatcagttaaagca

SEQ ID NO: 59696 - DNA, 348 bp, Triticum aestivum
  Clone ID: PAT_TA_59696
aaagggcactcggcggttcaagcggatctacaacgggtacgcattattgtctaacacggggaagagggccatgtacgattcctggctcgctgcttgcctatacgactacaaccaggatttctcgaacctcatgcatgagatgctgtcgatgatatataccgtgacgaacgattcgtcggacacgcttcaggacctggaaacaatgctgcatgagataatcaaaggcaaggggcgtagctgatccactgcttctgctagttctaccgcaaggagtcgtagaagttgcagtggtccagtgaatcgaaatgtaccagtatttgtcatgtcgcaccgtatccggaaccgtca

SEQ ID NO: 59697 - DNA, 438 bp, Triticum aestivum
  Clone ID: PAT_TA_59697
ccatacaattgcaataatgtcatgacccgcatcatctcacttacacgcaatcgcaaaatggagttgactttcatggcgctgcactcggctatacaggccaatgtgtatgtcaaccttgatttcatatcttccaatgccactaggacgggcaccatctactatgtttatggtgaaatcaccgcacaccatcaactctataacggtcagagtgttttgctcttttctcgcggagaagagaacaaagcagaggtcattgatggtgaacttccactgttacggaagtgtgcagttgttcctatttacttggagccgctcctgatactcaagttcgacctgcatgttccaattaattgtgatcacgatgatggtggttgtaccatcgccttccgagactatgttacattttaccgttgacagtatgaagaataaataatctgc

SEQ ID NO: 59698 - DNA, 416 bp, Triticum aestivum
  Clone ID: PAT_TA_59698
tcggtgtacgtcaggatacatacttgatccttttctgcttcggggtggtgagaaaaatcgtcttgcgagcacagtcgatgtttccttcaaacttggtcaaccaatccatgcctagaattacatccaaactctgggattccaatactatgaggtctgcggaaaaatcatggtttccgatgctgagggtcgaatgacagcctaagcctgccgtcatccctccccctgggggaaataactgaaaccgggttctaagggttctagtgggcaacccgtacttttccacaactacccttgatatgaatgaatgcgttgcaccggaatcaaagagtaccaatactggatgtgaatttaataaaaacttaccaaccacagtgtctggctgatcatagacgtcttccacgtcaaggtgattcacc

SEQ ID NO: 59699 - DNA, 186 bp, Triticum aestivum
  Clone ID: PAT_TA_59699
tagctcaagacgctcacccagttcgtcggcagtcaagtcgaggcaaggatgaagatctacgccgtctcaacgaggcattatttcgccttcggtgccctagtctctgaggaacactcctacgtcatcaatgcgttgcctaaactccgttgggttcgtccagaatcccatgtgaatgtcaaattgcca

SEQ ID NO: 59700 - DNA, 212 bp, Triticum aestivum
  Clone ID: PAT_TA_59700
aagctgaaacaagagtcgtatggcaggcccatcaagctgaacggcacttgtctacttcaccggatatcagatccccaagaatactactgtgcatcttttcacgggtggtacttacctggcctcagcaactgacgatgcacatagtcatggtaataagcactgtaccatttcacatcatgagtgctccaactgtgcaaggagtccaaatacat

SEQ ID NO: 59701 - DNA, 288 bp, Triticum aestivum
  Clone ID: PAT_TA_59701
cacattcacgactaacggttctaggatagagactgcctcaagtgccatctagttgcaagtgtcacactatgctcgcgaatgagaattcgatctatggagtgctccacagcaggtcgcaattttaggatctcttcatgaggagaggtaccttccacaacatcttcgaaggcactctcaccgctttcaagaccggcaggactattgcaaatgataatgctattgatttctcgagcccatttgctgacgtcattgagcaattttttggatgccacatgacaatcaaaccaa

SEQ ID NO: 59702 - DNA, 402 bp, Triticum aestivum
  unsure (1)..(402): unsure at all n locations
  Clone ID: PAT_TA_59702
atagattatacctgcctcaaggagctttagtatctcctttcttaccacttctttcattttagggttcagccatcgtcgatgatcacaaactagtttagcatcttcttccaaattaattttatgttgacataaagtgggactaatgcccttaagatcatcaagagtatacccaataacaacacggtgcttcttcacagttttcaataatctctcttcctcatgctctaaaaggttagcactaataataacatggtatatctttttctcatcaaaataagcatatttaagagtatcaggcaacggtttaagctcaaacacgggatcacccttgggtggangaggatcccctaaggtttcaacaggcaaattgtgtttcagaataggttcctgtttaaagaatac

SEQ ID NO: 59703 - DNA, 424 bp, Triticum aestivum
  Clone ID: PAT_TA_59703
tcggcgtcatggaggcagctctgcctcggcttcagctgctaagtccttgagggtgttgcggttgcggttgcattggacgacgacgtcagggtaccggctccggcgtgatggaggagggcggcggtggattgggcgcgacggcgatggagacaccgacgaggacgacgagctgccgtcgttcgacacccacatgaccatcctcggccactgagaggagccaagcctgacttctagcgcatggttgtagtatcttcttgcatttgcgttgcttgtgtagttgtgttgctgcccagaagaaacagtctggcaaaacataaaagaagaagaagaaagaaacagaatcaggaaagagatgagagagcgagcgtgtcacgatgatccccgctagctgatgacgaaatttgccggttgctcttgtttcttg

SEQ ID NO: 59704 - DNA, 299 bp, Triticum aestivum
  Clone ID: PAT_TA_59704
gtaccctaacgtgactcaaagaacctgtaccatagtggacgccgatcgaagtaactagatcttgcacctatcctgccatgcggtctcggcatccacgattttatatgtgtgtccccagtgaatttgcgtcaataggggaatatcttgctgtctgcacttcaggacagatcttgctaacgcccgctacatcgatgacattttcaaaggtcgactattgctggctgagccattcaaggtccgacttcgggagtcggacatggcaataatgttcctcatgctacacacatccacgctagacg

SEQ ID NO: 59705 - DNA, 435 bp, Triticum aestivum
  Clone ID: PAT_TA_59705
ggtgttattctagtatgaattctagggcagtttgtgacacttataggaatagcccaacggattgactggaaagaacactactaggaaaagggctatagatggaattgacactaatggcgcaccagacatgtggtgcaccattactatatactaatggcgcaccatgtgttggtgctccattagtgtgcaaatactaatggcgcaccacgtccacggtgcgccattagtaattttttttaattttttcaaaattactaatggcgcaccgtggacgtggtgcgccattagtatttgcacactaatggagcaccaacacatggtgcgccattagtatatagtaatggtgcaccacatgtctggtgcgccattagtgtcaattccatctatagcccttttcctagtagtgttctttccagtcaatccgttgggctattc

SEQ ID NO: 59706 - DNA, 414 bp, Triticum aestivum
  Clone ID: PAT_TA_59706
gaagtccacatgttgctgtttgaaaacagaaagtttaccgctgttgcaataattccctagaaaagtcagaatgtgataaaatgtcgaaaccttttgtatattaagatctgataaatttactacagtgggaattttatttcataatttttggagctagggaagtatggatgttgcagtattctttacagactatcctgtttaggcagattgctgttatgtttgcattgtttgcatatgtttgcttctttaatgattcgatttgaggataggactattaaatatgcagaggcatttagtatgcaatgttgaataacaattttagtgatttgctacagtagagtatgataaggtttttgcaatagtttatactaacttatctcacgtgtcctggttgagttttgtgtggatgaagct

SEQ ID NO: 59707 - DNA, 337 bp, Triticum aestivum
  Clone ID: PAT_TA_59707
atcattacccggcagccgatcgataagatccaggctcacgtgctcctgcattggacctcatatctcgtctatactgtatgctagattcatgtcactgtcattactttgagaagttactaacggtaaataccctgtagattataaatgtaacatctttgcaccacattccgctttcgtcaacgagtatacgagcgtgaatgcgagcacgggtctcacttgacaagagttgcgatccctctataggtaatcctacgctcctagtagccgtccactgttagctgatggtgtagcgataaggcacgtcgtgaccacctaagatacatgtgcgctagcgcct

SEQ ID NO: 59708 - DNA, 312 bp, Triticum aestivum
  Clone ID: PAT_TA_59708
tctggtattatgaaacgcttcatcattggcatattggatgcatgatcatagacttgacatcgtatttgtcgcagagccatcggttcatagtcatcatacatgtcacgaatgcatcattgcacatcccggtacagcgcgggacgcattcacatagcagcacatgttgttctaactagtgcagttgtattcttgagttgtaaataaattaaagtgtggatgtcatcaatgatacagcattgtctcacgtgaagacagaatgatgaatactatgatttccccacaagtctggattcaactcccgttgatttacaa

SEQ ID NO: 59709 - DNA, 318 bp, Triticum aestivum
  Clone ID: PAT_TA_59709
agaaggtcacatatgtgtaccaggaaaaagtttgcggtttgaaggaggactgaagttcagagtgatgtggctgtgaaggttcagagatgtttttttagtatattcagacatgtttttcctctcttattcttcattttttaacttcttcataattgattagataacttttaaggcaacatgttgttgtctgaaaagcttagggactcttgtgtgtacgtgaaacactttgatcaatagactctttagtttagaaaatgatgaaaaaatatttaaaaaaattccttcagcgaaaatagggagaatataattttcatgggc

SEQ ID NO: 59710 - DNA, 413 bp, Triticum aestivum
  Clone ID: PAT_TA_59710
acaaagaaatattacactcacagttctaaatatacgtctcaaagaagtcacggacacccgggttctaaaaagcctgtctcatcatataaggatgatcacaagcacacttttcgtctacaagtttaattcactactgagtcactcagcaatgtaggacccacttgcatgacaaacagagaaagaaaacaatcagtttaggagggacatgaatcttagatctactcgattctagaaacgatggcaccgcaacattagaagcagcaaatggaccaacacaatcgactacaccgtgaggagattagcaacaccaatgctggatctgtgatgcatcgaggaaagatgggcagggaatgaacgaaaaaggtaaccaaaaggaagactcactgtgctttgttctagaaccttcctactgg

SEQ ID NO: 59711 - DNA, 287 bp, Triticum aestivum
  Clone ID: PAT_TA_59711
ctgcatagaggggggaagagttggtgataaaggcgtgaaattgttggtgaagattgcggtgatgatgatggcccccggcggtgttccggcgccaccggaagcaaagaggagagagcccccttcttcttcgtcttccctgacctcctccctagatgggagaaaggtttcccctatgattcttggctcccaatggttgggaagggcgagagcccctccgagattggatctaactctctgtctctctctgtccctctccgtttctgcttccctgattctgcccttcaacg

SEQ ID NO: 59712 - DNA, 410 bp, Triticum aestivum
  unsure (1)..(410): unsure at all n locations
  Clone ID: PAT_TA_59712
ggcaagggtggtatttctcctcaggaatttgattgatatcctggaacagctcagaatgttggtgatgatcacgacacatttgtcgagagatttcatgcagatgtaatcgatcggcaatgacatcaagtcaaaggaatgatggagcgaaaggttattggaatcatgggtacaacacaaactcgaaatcaagcttgctgttcaaggcgaaaagtgataagacaaggaagatcgatgtaagcttaacgcattgttggaagttgtgctccgggaagaaggaccacgtagcatagttaaaatttagcatggtaatgatatagccgatcaggctangaatgactataaggattattaaactcgtaagcaacaaacattacctagagttatagaatcggagtgtggaatcgattcac

SEQ ID NO: 59713 - DNA, 428 bp, Triticum aestivum
  Clone ID: PAT_TA_59713
cccttagccgacgtctcggtgcccgaaggtggttgtgttggtggaaacaaggcaatcagatatacgagctttataactttcacttagtcataggagcttaaagttgggaggcgagcaagtagccccctgcttagtgtttggcgacagccaaggtcaagccgtaaacacttcggccaatgttatgaacggcccgtcatttaatatagccatcggatcactgaccggtttatgctttattatggcagtcagttttcggctttctccaccgaggtgcttaaccatgcgagctggaagcacaatcgcagtggttatccttttgcacacctaaccgaacaaagcggaatgtaggaggcaagcacaggagccgggcaacccaactatcgaccgaagacacaatttgaaaccgatgcatatttagcaatatccaa

SEQ ID NO: 59714 - DNA, 428 bp, Triticum aestivum
  Clone ID: PAT_TA_59714
gctaacaccatggaatgttcggtgagtcagtctacagaatatgcctgtgcaaattgagctataacatgccatccatcttacaacataattaaggatatgtgagtacctatttatactactctatgagtatctccaagagatgcacacaaccgtcgcgatgtgacgtaccagcaagtcaaactcaacataagctaaagtgtggaatactgatgatgcaacacctcctactgaagaatgtaaagcctcaatgataacgacatacataaagcaaccaagtaaccctcttgtgaattgtatagccagagccccggctaaacctgcattcaggaataatgttattattcaaacaagcaagattgaagcaagaatatcctgaactatcactaacagaattctatcatcattaaggagtatacatttcaaccttt

SEQ ID NO: 59715 - DNA, 417 bp, Triticum aestivum
  Clone ID: PAT_TA_59715
tatccaccgtggcgaacttgtagtcagtgctgttgacaaaccagttgaaacggtcgcaaggctctgtggccatgcagtactggtagatgaggacatgatggcgcacgcacaattgagcgacggcaaccttctaatctatgccgggacgaccggcggtgtactgaaggtcgatgccgaccaccttgtacttgtctccagcaagcaactgctcaatgcggttgatgtagtcatccaccatggccgagtcgatggtgtatagaaaaaatgaaaatgtttttgaaaacaaaggataaaataaaaacgaaaaaggataaataaaaggaaagaaatagaagcagaaacagaaaaaagcacaacaaaaaagaaaaaggaaaacggagaaaaccagaaaaccggcaaaaggaaaaaaattaaaaa

SEQ ID NO: 59716 - DNA, 350 bp, Triticum aestivum
  Clone ID: PAT_TA_59716
cacaggaaaaaggtggaacactatgtgatctctgtttactcaccattagtcacaagaacgtcacacacctgttgcgtaacacgataatttatcactacacattcttagacggatcctcctacgcgcatgcactcagtgttcactgaaatctatctctatgaactattgctcgaactgtggtcaagaaatatgttgaactcgctccatcttcatcagacatctgtacactatacgatcctgtctcgatagttgcagtcatcatgccacgtatatcctcagtctcatgacttctctactgcctgtactcatatactgtcatcatcatatctcaatttctctctctccgttcg

SEQ ID NO: 59717 - DNA, 339 bp, Triticum aestivum
  Clone ID: PAT_TA_59717
catgatatcactgtggcggactatgagatcgttgctcatgcactagaggatacggtcacggagcacaccatccgcgtaacacgctccacactaaagaggcgtgctaccacagatgcgggagcgtgaaaccccactgcaaaccaatgttttactgcctcaagtaatcgtcgctctcacgtgctgagtcattctcacattgtcccgtagtcatatgtcgagtgcattcgttagtaacccgtatcaatagttgaactcctcattcatcgcagcgtcctctctaaaggattcaatcctacatgcacgtacacacgtcgtcctagctatacgaaattctctctc

SEQ ID NO: 59718 - DNA, 430 bp, Triticum aestivum
  Clone ID: PAT_TA_59718
agtcaattaaatgtgtttgtccaacggtcccagaggataggcttgtcaactgtagacctttccacctcctgtgtgccactgtggcaacccctttttcctataaaaggaggcccgaggtgaccaggagggggattcggctcttttgggcaaagttgcaccccgtagctagctcaagaacacaagaacactcgaatacatccaccaaagcaggactacggtattacgcatctttgtggcccgaacctgggtaaacgatatgtgtgcttcctgtagacccgctcttcgcacaacctcgcacccgccaaccataaaagggatcccagtgaccccataggtgtcgtttccacttacttctctggcgcgccaggtagggcgcgcaattgtgagaatctggtctggtcggggcagcgacttcattatggctgtcatt

SEQ ID NO: 59719 - DNA, 189 bp, Triticum aestivum
  Clone ID: PAT_TA_59719
cgatcatcaacaccaacaccaacgttgccggcagcatcatacccaagcgatgacgtcatcgtcaccgcaaacatttgaccccacatcagtataaggtacatttgactacgggagtcgatcgaacactgacactaactacaggttggtcaaaggttcaaagaaattctcctttaaattaggccaatgcta

SEQ ID NO: 59720 - DNA, 442 bp, Triticum aestivum
  Clone ID: PAT_TA_59720
aatgtatcgcgctgaggcagacgaggaccatcaaacttgttatgataattggacgggctagaatcagatgctttgcccgaagagaaatcttccagagcttgaatggtgtctcgaactggtgggataaagctcttgtgtgctaccttggccagataggtagtcttcagagaatgatcaatgacttgttggatccaaggagcaaagaatttcaggcacattgggtgatgcgcagaatccttcagaatgcggaggaataagtcttcgacatcgaagacaaatcgatgagaaatagcatatattgtgttccgaagaacatccgagattgatccatcagtattcataccgtccagaggacaaatagtatatgtgagcagatgataaatggtttgattctcgaaggtcaaatgcttaagcatcggagggccatcataatccttaatct

SEQ ID NO: 59721 - DNA, 290 bp, Triticum aestivum
  Clone ID: PAT_TA_59721
aaaccttcgacagcacgatcacctaccggctctcaccataacacgacggtcacttggatccttctccacagaggtgcttaatcatgctcgtccattgcagaggcggagggcatcgcacagggctaacttaatgtctgttatggtatctaaggtgccacctgatgcgaacatggcagaccaaggtggtgaaacaggacatgattcggagccgatgcatatagtactatctattcggtgtgacccaactgtgacagtgttccgacttaacagaccatactttgtggtaccta

SEQ ID NO: 59722 - DNA, 537 bp, Triticum aestivum
  Clone ID: PAT_TA_59722
gccggccgggtccggattgcctcgatctctaactgtgtccaatctcgtcaacaccatgaaggggggcagcatggtgtatacaattgctcttttgttcatcgggtgcctagtcatggttggacaatgtcgtcctgagcccgagagcacatacgaagatggccatcgcaacgtggctacggtggtctcatcattagatgacaacaaacttaccttgcaatggtgtgtcgcaagggattgtgtaaccaaaggtgaaccgcatgccaatcattgcttttgctgcctcaatgcgccgggagcaccttgttttaattccagattggattgtcagagtcaatgcccaactatgcctccaggaaaataagggtgtgcatagtaggaaataggtttaatttgtcattatctatgcaatttgagtcatgggcgagtattaaattatgttgagaattaaacattttatttgatgattatgagagtggtgattcctcaagaccaccttttatgtggcttattgaaaaaaaaaaaaaaaaaaggccccta

SEQ ID NO: 59723 - DNA, 371 bp, Triticum aestivum
  unsure (1)..(371): unsure at all n locations
  Clone ID: PAT_TA_59723
cagaaagagcagcggcggcgnccggcggcgccgcggcgagcgcgaaggaggacagggacgagcggcaggncggcgaccagcagcaccccgccccccnccgggggcgacacccccccaggacggaaggacgaggaagggacgacagccccagacgcaggggaacacgaacgagacgaagagcgaaaggaagaccaacaccaagacgaccaaggagaaccacaccggcaaagcgcaccacccgagggagaagcgcgcacacggcacaaagccaggggcagagcgccaagcccacacgccgacaccagcaggaagcgccggaggagaaccaagacacccaacgcccgcgcacgccagccaaggagacaagcaca

SEQ ID NO: 59724 - DNA, 749 bp, Triticum aestivum
  Clone ID: PAT_TA_59724
gccggccgggttcggagccacacaagtcttctcctctaatcccttcttccagcgcgggcacatagccgccgccgctatttgctctcctcacaccgacgccggtgaagccaccgaggaccgcgccttcctggcttcctgcgagctccaccatcgagcgcatccagcgggcaccacagtcgcctatggatgagctgacgagccggccatccggctgcttccggagccgcggtcgtcgacgacgaagaggctctgtagcagcatctttgcgctccatcgtcgtacaatcgggaggagcgtctcatcgctcgtagcttcgccgtgcggccgtgctgggatcaccaaccagccgtgctggaacggacgagcggagaagttgcaagccggcaggcgcccatgctggaactgccgggcggcgatttgtgctggaacccgacgatagactctgctgcaaccagccagccattttgctggaaccggcatcggtaattgctacaatcgaccacgcgatgtgctggaaccggacgcgccattgccgccgagccttttttttgctggaactaatgtatttttttgctggaactacctgatttttttgctacaatcgaccattgggagttctttcctgctgagttgttttgctgtaaatggacgcgccctcgccgctgaggttttcttttgctggaacactatatatttttgctggaagtacctgaatttttgctacaaaaaaaaaaaaaaaaaggccccta

SEQ ID NO: 59725 - DNA, 557 bp, Triticum aestivum
  Clone ID: PAT_TA_59725
gccggccgggttgggaaaggccccttcggcctatccaccctcatcgtcggcttcgatccgtacacggacaagcccgccctgtaccagaccgacccctccggcaccttctccgcctggaaggccaacgccacggggaggaactccaactccatgcgggagttcctgtgagaagaactacaaggacacctccggcaaggagaccatcaagctcaccatccgcgctctgctagaggttgtcgagagtggtgggaagaacatagagattgcagtgatgacaaagaaggatggccttcggcaactcgaggagactgaaatcgatgaatatgttgccgagatcgaggcagagaaggccgcggcagaggcggcaaagaagagtggcccgaaggatacctaattactggatgtgctatatcttcagtctgtcagccgaaaccttttagtgtgtcacctgttacgctacacaactttctttaaactgctttaacaagatattgaagtcgttcgtaaatgaattgccttgttttcttgatgaaaaaaaaaaaaaaaaaaggccccta

SEQ ID NO: 59726 - DNA, 502 bp, Triticum aestivum
  unsure (1)..(502): unsure at all n locations
  Clone ID: PAT_TA_59726
gccggccggctcccaaaagagagcaaggagatcggatcgacagagaacagagcagagcggataaactcgagggcagtagatcatcaccaaccatgtcgtgctgcggaggcaactgcgggtgcggatccggntgcaagtgcggnaacggctgcggagggtgcaagatgtaccctgagatggacgagggggtgaccaccacctcccagaccctcatcatgggcgacaccccctccaagggcaccccgtcgttcgaggccgccgccgagaccggagccgacaacggcgggtgcaagtgcggctccaactgcacctgcaacccgtgcacctgcaagtgatccatcaaatcaagacaaggagatggcatggcatggatggacctaatgaaggagcactaaaagtagttatgcatggagtgtgcgtttgcgttctctttttaatcgcccgcccgagaataaaacgagatctatcttatccgcatcgtattatatcgacctagttcatg

SEQ ID NO: 59727 - DNA, 699 bp, Triticum aestivum
  Clone ID: PAT_TA_59727
gccggccgggttcatacaggcgcgtacggttcctagcgtttccccaaatcgaatcgcccgtggcggcggcggcggcggcggcctgaatcgcccctggcggcgaccgacgcattcctatggttttttttcatcggagcgggcggcggaaggcggagggcgcatcggagaggggcctcttcctcgcggcggcagcggcaacggcgggcttgttcctcgcggcggcagcggcgggcttgtcccttgcggcggtggtggcggcgcggctgcgtgggggaagggaagcagctgcggcaatggccgcgtgggcgaagagaagcggcttcggtagcagaggggcgcaaggtctgctgccgcaacagacgcctagggttccaccttctcaaccctaaccagctctgccgcagccaacgagatctcgctctcaccgtcaacaccagcaaaggcttcaacccttaagattgatctcccctctgtccttacctccatccacgtgtccctccattaatttgcttggagttcttgatggctagatgtgcacttcaagtgtttgtggaaatgtggaagtaaaatatacttgtagcattcgatctgtgatctgaaaaatggctgggcctacgatgtagcatttcggtttgtgatttgaataaaatatgcatgtggtaaaattatacttcaaaaataataaaaaaaaataagaaa

SEQ ID NO: 59728 - DNA, 285 bp, Triticum aestivum
  unsure (1)..(285): unsure at all n locations
  Clone ID: PAT_TA_59728
ccgcgccgcgccgccgccgccgccnccgagccccncgaaggccaccacgcagacaaggcgcagcagaccgacaagcccnnccgcaagaagacaaagggggaccacagaacgaagaaggaagacaaggcaacgaggcccggcaaggccggcaaccgccacaggaagagagacgccccagggcacaagaacccaagggaagcgaacgacggaaccaacaacgaccagaagcgcccaaacacaggaacggccgccaccagggccggcaaaaaagcgggaacccgccac

SEQ ID NO: 59729 - DNA, 523 bp, Triticum aestivum
  Clone ID: PAT_TA_59729
gccggccgggtcgggacacaagagaactgcaagccctcctcccgcgatacgaggccaccatccgtcatgagaactctccaggtctcggcgagtcgggctatatggaggcgtcctggcccctccatgagaaccgccgcgctcctcgtcgccgcggaggcggcgcatgccctgctccagtcggagctgtcggacatcgccctggccgcgcggaagatcatgcatgcacaccatcgacctctcgctgtgcctcggcatacggccgtaacttcatcacatgcttcatccttcatcgcctgccgcatacctgcttgttcattacaaccgacaaactggaagacctacatgcgtgacctcactctcgtctccttacatatccctcaccctgcctgcggaggtgctatacctcctgacgaccaaggccggtgcctgtactgcttccaggaaaagattactgaggccacttcctccccatactatgccactgattagccatcaaattgacggggcgctgctactactatct

SEQ ID NO: 59730 - DNA, 510 bp, Triticum aestivum
  Clone ID: PAT_TA_59730
gccggccgggtcgggaaggaaatcaatcaccgacctctcatgcacgcatgtcttttccccattctgcggaggcggaatctatggcagccggtgcacggaaagggccgggctccgacggatgttctccatcgccgacttctagacgacgaatacgcgtatgatctccatctcgggcttcgcgtcgccgatgaacgactacgctctccgcccgaaggccagagaacctactaccaactctcctgcgcgcacctgcggctgagccggtacacaaccaatgacgtacttaaagagaattgtgccatcatcgaggaactcagaacactccctcatgaggcacggatcgcaacaactggaatatacaaatggtcgggctcagcatcgaatgcatcatgtagatattccacctcctcaacagaacgaatgcaagccaaatcatcggatgcatgatcaattatagcggaacatgctagaatgctaccccgattgagacggctggtgtaactacgaagc

SEQ ID NO: 59731 - DNA, 537 bp, Triticum aestivum
  Clone ID: PAT_TA_59731
gccggccggttttcacaaccgcacgacattttcgccaccctacccggcaaatcgccaatcgccatcgtcttctttgtctcctccagcgagccacaggaatcctctccgaccaagaagagaagagagaagagatgggagggttccagcggcaggtgaaggagcggaccatggaggtgaaggtggcggtgctcaagggcgtcagggtcgtcggcgacttcggcaagaagacgtggaacaaggtcaaggccatcaagcgctgatcgatccatccatcgcatcaccccggccgtctgcttcccttcgctccagtccactagttgcttcatgtagtactgcctgataggatagccgtctggccttgtgctctcttttttttctctggttgtggttgtgatttggtttgttggatctgtttttgagtcaacttttgatgtgaagaatcgcctgtcagtataggcttatatttagccttcttatattcccttgtttaatattattattattccttcacaaaaaaaaaaaaaaaaaaggccccta

SEQ ID NO: 59732 - DNA, 816 bp, Triticum aestivum
  Clone ID: PAT_TA_59732
ctgtgcggcgctcaggcggcgggttggattcccccaccctagcacagaacaccacctatcataatcaacatgtcgggagctgcagatcgcgaggctgtcttcccaacccggcagtcgctgggtatcatgaaggcaaagctcaagggcgcagagataggtcacagtctgttgaaaaggaagagcgaggccctgacgaaacgattccgagagatcaccaaacgaatcgatgaagcgaaacgaaagatgggaagagtaatgcagattgcagctttctccttggcagaggtcacctatgccgttggtggtgatattggctatcaagtacaggagtccgccaagtctgctcgatttcgagttcgcacaaaacaagacaacgtctcgggtgccttgcttccggcgttcgaaagctatcttaccgaaggcaataacgatttcggcctgacaggtctgggcaagggtggacagcaggttcaacgctgcagagagacatatgcccgtgccgtagaagcactcgttgagcttgctagcttacagactgcatttgtgatccttgatgaggtcatcaaggtagtgaataggcgcgttaacgcgatcgaacatgttatcataccaagaaccgagaacaccatcaagtacatcaactctgagctagacgaactcgatcgcgaggaattctacagattgaagaaggtcgcaaacaagaaacagcgcgacacagctgcagcagacgccgagatgaaggcgcgccgcgagaaaggagctgcggcgcaaagcggacaaacatctcagaaagacgatgatgctccctacagacgt

SEQ ID NO: 59733 - DNA, 542 bp, Triticum aestivum
  unsure (1)..(542): unsure at all n locations
  Clone ID: PAT_TA_59733
ctgtgcggcgctcaggcggctggttcgatcagcacacgacagcttaagcttctgagccttccagtgccggaacagagcagcatataagaatggcatccctgaaggccgtgaagccaaccggacttgaagggcaggccaaggagcctaccaaggttagtgccaccaaggggcctgcaaagctcagtgccacggcgaccaagccagcagccgccaagggcggcatcaagaaggctgagtcaaagccacgggagcctaagaagaggcaggtgaagagctccaagccagcagcagcaaaaaactgacaacggcagcagaagaaatggagcttgcatgctatcttcatggtgctatgaattatatatgaatcccgcctttcccttcctctgtctcccatgatgtcgatcatgcctcgacaggcgctgacagtgtgtgtgcaatccatgggacgaatattacaaataagacgtgtagttctgccatctgcttcatcttanaaaaaaaaaaaaaaaaaaaaagaaaaaaaaaaaaaaaaaaggccccta

SEQ ID NO: 59734 - DNA, 356 bp, Triticum aestivum
  Clone ID: PAT_TA_59734
gccggccgggctgcgtttcattctgctgctggttgagttgtttttttagtacgtctagtctagtattgtatttgaagaggtgttaccatgaagatgaagttctgcatgcatatgacggatgatgctgagagttggcaaaggcaccaaacagatgcatgtaacgaactaagtttattttatcaagtttttgtcacctgaaactctgtttttattctggctggctggctggcttgttacttgtatttatttatttattattaaaaatggttgtatactgcttaatttttatatatgcatgcacatataaagtagcaacacaacattggttctaaaaaaaaaaaaaaaaaaggccccta

SEQ ID NO: 59735 - DNA, 178 bp, Triticum aestivum
  Clone ID: PAT_TA_59735
gccggccgttaacggattcaggtctcctcctcaactcaatagatctgagctgagagatggctcttcttcctcctctgcttctgtcctgcatcttggtgctggctctcccagggccggcggtggtgacggtagggggcgtcacgttccacgtaactaacaagtgcccgttcccggtgtg

SEQ ID NO: 59736 - DNA, 772 bp, Triticum aestivum
  unsure (1)..(772): unsure at all n locations
  Clone ID: PAT_TA_59736
gggagacaaacaaaaaaaactaataaccggccgagccagggggatactatgnncccgggancggcggcatggcccaatgctgagactaataataatataatcattgctttatctctgtaaataagtgatttgatcacaagatttaattccagttcattttgttcttgggatcatgctctctttaggaacctttggcacaatcatcatttgaacttgttgatcccacttttatcattgtaaaagtttaaaatgattgagtctactagtatcctactgctttgaagcactcctgaccattgattttcactagcaaagttcaaagcatgctttgtttggagatctacttcacttggcattctctagtcagctcactgttcacaatcttgctcttgtcatatttctttgcttgaggacaagcaaagatttaagtgtgggggaacttgatagagtatttcctcatataatatttttagccttcttgcatcaaattgtaatcatattttcacattatttactcgaaagatattcaaatactcatattatgtcacatttacaacactactccatcttttgcagaaaagggcgataaggcccaaatccttctatattggagtgtctaagaggttgcggttgctgcattttgcagagggactcgagtgtgcagaagaattaacctacaggggctagctggaaaaaaaggggaccacttgggaagaaagaaaaaaacaaagagggctaaacaaggaaaatgacacctgatccaaaggggaaa

SEQ ID NO: 59737 - DNA, 310 bp, Triticum aestivum
  unsure (1)..(310): unsure at all n locations
  Clone ID: PAT_TA_59737
gccggccggngtgcaagacctcttctcaattacattatcttcgcaagttctattacgaatgatgatgtaatgtgtagaacagattagagtcaacactatgatgttacacttgtatctactgttttatttagtccaatgtgatacattagtttgttcctggatcctgtgtttgcttggttgcttgttagaattgtgcttacctggtggagagcacagtttgtgaaaaaaaaaaaaaaaaaaaaaaaaaaaaaaaaaaaaaaaaaaaaaatcttgctttttcttccaaaaaaaaaaaaaaaaaaggccccta

SEQ ID NO: 59738 - DNA, 533 bp, Triticum aestivum
  unsure (1)..(533): unsure at all n locations
  Clone ID: PAT_TA_59738
ttggatgtagattatttttcgcttgaggnaagacttctgaagtgaggaaggtttgcacgagcaaggggaaattcttccatgctgaacatgttcactggtactttggatacccgccgccgctgtcaaaaccgagtgtatgaagaggactgatgaactcgctttgcttctggtgtctctttttgggccatgcatctggagcatttgaggagaaatggaggatggggaaaaaagatggtgccgcaaatagtgcttgagaattggtattatttacggagattcattggaacttgagcattggtattagtatttgaatcaatgtactttgctacatatgttgatgttaagcgagaacaagaaagaaatgaaggggaaaggagaattttgaccgaatgtttgaatgtaaaatgcttgttgctgagtgtgtttggcaaaaaaaaaaaaaaaaaaacaaaattcaattgtgatcatcctccctccctcgaccccagagctctccttcttcacccttgaaatcctttttagggatcatcaaa

SEQ ID NO: 59739 - DNA, 407 bp, Triticum aestivum
  unsure (1)..(407): unsure at all n locations
  Clone ID: PAT_TA_59739
cccaccgnagagaggggagaagcgcggaggatgncgggccgcggcaagggaggcaaggggctgggcaagggcggcgcgaagcgccaccggaaggggcgccgcgacaacanccagggcancaccaagccggcganccggcggcgggcgcgcaggggcggcgcgaagcgcaccccggggcccacccacgaggagacccgcggcgngcncaagannccccncgagaacgccacccgcgacgccgncaccnacaccgagcacgcccgccgcaagaccggcaccgccagggacgncgncnacgcgcccgaggggcagggccgcaccccccacggcnacggaggccaggccgagggcccaccgacccagcccgcgacgccgccgaccgaccgagagcagcagcgcaacccacc

SEQ ID NO: 59740 - DNA, 706 bp, Triticum aestivum
  Clone ID: PAT_TA_59740
gccggccgggctccagaaagggaaaaaaaaactagcgccttaccagacggcaggtaagggaggaggaggaggagagcggcggcgaagatggtgtcgccgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagctccggcagcagcggcaccaa

SEQ ID NO: 59741 - DNA, 598 bp, Triticum aestivum
  unsure (1)..(598): unsure at all n locations
  Clone ID: PAT_TA_59741
gccggccggttttcgaaaaaagggaaaaaaaaaaaaaaaaaattaaaaaaaaaaaaaaaaaaaaaaaatttatgaacacgatgaacacctcgaccgtacggatcgagagaacgtgggtcaacattgatgatgactgtttctctccaaagcccaacagctctgatctttatgtcaacactatgtattgtaacggtacacacggccagtctatgggatccctgggacaatacaagggtgaagtttccaacgttcacgatgtgcatatcgaaaacgtttggatgttgaatggagactattccggtgctcgcatcaaggtctgggcaggaaatgaaactggcacgggatttgtgaacaatgtgacgttcaagtgggtatgaatcaaatctggccaagcctagctactgatatctagccaggaacttctgggtggcacgtatggattacggcattttcctcgattcttgctacttcaacaaatcagccgatgagtgcaacgcccacccctcaggcatgcaaatcaccaatatacacttcgagaacttcaaaaaaaaaaaaaaaaaaanaaaaaaatgaaaaaaaaaaaaaaaaaaggccccta

SEQ ID NO: 59742 - DNA, 500 bp, Triticum aestivum
  unsure (1)..(500): unsure at all n locations
  Clone ID: PAT_TA_59742
gccggccggataccgactagactcggccattccccacattcgcagctcatcgcgtccccgccgcggccgcacaccctaaccctagcgccgccccgccgtcgccgtccccctgaccgccgcctccatcacaccctcgccctcgctcctccgccactcccacgagaccagcgctgtcccgagtcggtgctcgccgtcgcccgcccttgtctcgagggctataaatggcagggagacagcgcataggtcgccagtactatgaggaaccacgaggatttcgtgatggccctcctcctcgtcttgcacgagaaaggtccatctctccacgacgcatcgagggagagctgtctaggcgccggggtgagatacgcagaatccatgatgacaaccaacatctggnggatgaaattgttggactccgaaaagaaatgtctcgattgaaagaagatatacattcctcaagtcagggtatacctaagctacggggagaaaaagaaattgaa

SEQ ID NO: 59743 - DNA, 380 bp, Triticum aestivum
  Clone ID: PAT_TA_59743
gccggccggttttcaaacaagcaagtaagcagatatcattttctgcaaaaactataacagaaagagatctccaagaacgcagagatatgtcaactccggcgatgaaaatggggccgagatggaggaccagaagggaatcactgtgacgttaatgctctcaatccggccaaaaagattgtgagaatccacatttggagcactgattcctcatgtaaaggggccaggggagtcatcaagggaatctcgtatagctatcttgacatggcagggtaactaatcccgtcggggcaatggggctcccagatgggtaaaccccaggtgatgaacattgatgaagaggagtgcctgaacaatgaataaggaagaagagatggaaaata

SEQ ID NO: 59744 - DNA, 714 bp, Triticum aestivum
  Clone ID: PAT_TA_59744
gccggccgggtcgggatcatcatggtgtataaaacgtcactcctgcttggtcttgccgccatcgcctttgctcttcctacagacaaggatagcaagcagggtctcgtggccggtaaattcattgtcgcactcaagccaactgccaacgtcgatcttgatttacactctcgatgggtgtcggatgtgcacggacaggctctcgcccgccgcggcgttgagtctggtggaattgacaagacgtttagtttccctggtttccagggctactcaggatcgtttgatgaagacaccatcgagatcatcaaggctaattccagcgtcctacttgtagaaccggaacaagtctttactattgcctcgccagtcacgcagcaaagtcctccctggggtctctctgcaatttccaatgccaaccccccatcgtcgaaggcctcgtacacctacgattcgacagctggtgcaggaacatttgtctatgttctagacagcggcatctacctcgaacatgacgagtttcaaggccgtgctgttttcggtgcagacacgtcagctgtctccagcaagaagcagcacggcacacttgtcgccgccatcgtcaatggtgccacatacggtgttgccaaaaaggctaccgttgtggatgtccaagttttgggcgatgatggcggttcatccagtggtgttctggctgggcttagctggacgggcaacgac

SEQ ID NO: 59745 - DNA, 617 bp, Triticum aestivum
  Clone ID: PAT_TA_59745
cctgtgcggcgctcgaggcggcggctcggacatctgctctgcaattacccaccatctcctccatatcctccggcgaaacccagccccagtccaccccaccgtccgcatccatggcgcccaaggccgagaagaagccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtttcgtagttagctgttcgggtgggattgg

SEQ ID NO: 59746 - DNA, 687 bp, Triticum aestivum
  unsure (1)..(687): unsure at all n locations
  Clone ID: PAT_TA_59746
aaaaaaannaaaaaaaaaaaaaaaaaaaaaaaaaaaannannnnacactgtgcgggcggtcgaggncaggccggttttccaaattcaattcaattgtgatcatcatcatccccgataccaaagctcatcttcttctccttgaaatctttttgggttacacagatttggaggatgtattgcaactgtggatccggttgcaggtgcggatcagactgcaagtgcgggaagatgtaccctgatctgacggagcagggcagcgccgccgcccaggtcgccgccgaggtcgacctcggagtggagcctgagaacaaggaggaggagttcgaggcggacgccgggtagtccggngagggatgtagatgcggagacaactgcaagtgaaacccctgaaactgataagatgcatgcactcgtacgtacgtgtgttggtgtgagagtatacgtgaataatgagagtatgatatgatggagtcgagccagggtgcgtgtgcgtgtgcgtgtggtttgcttgctcgatctcccatgctctgcccatggtgtcccttgtgtgtatgtgttgagtgtatgtgtccctgataattgcttaatccatacccactatggatggagggatgaatatgtaagaatgaaagattttcctttaaataataattataaaagggccccagggtttcggaccgatctaaa

SEQ ID NO: 59747 - DNA, 781 bp, Triticum aestivum
  unsure (1)..(781): unsure at all n locations
  Clone ID: PAT_TA_59747
gccggccgggtccggacgtgactacntactttctggcgataatcgaattgcctttattctcaacacatactaaattgaattgattgactagaatctcatcacatgccaccatgtcggctctaacagaaatctccctgccaagctttcaaaagattgcctccggcaaagtgcgcgaccttttcgagctccctgataagagcactcttctctttgtggcctctgatcgagtctcagcctacgatgctgtcctcaagaacgcaattcccgacaagggcaagatcttgaccctcctttcagcacactggttccaggttttgacggagcgcattcctgacctgcgtacccatttcattagcctcaatgtccctgagggtgttagtgcggaggaggcccagaccatcaagaacagatccatggtcgtcaagaagctttctgtcatcaagatcgaatccattgtgcgaggttatctgactggttctgcttacaaagagtacaagaagaacggcaccgttcatggcatcaccgttgagtctggcatggaggaggcccaaaagttcaagcaacccctgtggacacctagcaccaaggccgatgccggagagcatgacgagaacatccaccctgacgacgcttggaaggaagtcggcgaccgcgagactgcggaccgcgtcaaggagctgtccctcaagatctatgacgaggcctccaagtacgccgaagagcacggcatccttctggctgacaccaagtttgagtttgccaaggatcaggagggcacatc

SEQ ID NO: 59748 - DNA, 451 bp, Triticum aestivum
  Clone ID: PAT_TA_59748
gccggccaggtcgctgtcggagaccgtcagcgcagcggctgccgcgatcaccgcggacccaaacttcacagtggcgctcgccgcggccatctcgtcgatcatggccggccagcacgccgccggcaacagcaacgcgaacaacagcaacaacaacaccagtaacaacaacgtgacgacgactagtaacaacacgacgagcaacaacaccaacagcgagacccaatgaacgacctggtcaagttcgaaaagagttgagaaaccagatactagctaggttgcaagttatacacggatggtgttccattcttctttggtcaggattagcttgtcgagacgtgtctttggttttgataccaagcatgatatacgatcaccctttttctttaaaaaaaaaaaaaaaaaaaaaaaaaaaaaaaaaaaaaagcaaaaaaaaaaaaaaaaaaggccccta

SEQ ID NO: 59749 - DNA, 791 bp, Triticum aestivum
  Clone ID: PAT_TA_59749
gccggccggttcgggactccccttttcccctccccgagctccgccaccagccggcagcgcccccttcgtcccctccgtcggcttccccggcgagctaccaagaaggaggaatggttcgtcccttggaagtgcggttcgttcccttgtccggctttgcacctggaggggatccaccacaaggtcctagagcaaagaaagtatctaaggctgcacctgtgtttgaagtccctgggttatggacacccgatgtacctctagagaatgcctatcgtgactgtattaacatgactgtcgtataccttgatttgcacttgccaaggaaaatgaagcctaagctttctctgagagagaccttctatatgatatatggtggcaatacaatcaaagaacttgcggagcttgtatgcggtcgtctgaatcttgaggtggggcatccaatgaagttcaccattgatgggactcttctgccggaagattgtgtactctcgtcagtttacaacaagtatatttgggacgggagcattctgacactctgctgctgtgttgataatgtgaagaaaatcttcaacgtggacctgtcagtgaaagttcctgtgataccaccagtgcatgtgattgaagatgaagtcccattacccactctgaggatctgctctgtccgggacgcaaggagggcgtctatgatgagcaaggttggaacctactcgcctgaggatggtgctcccagctgtgctggtgcacggcccctatgggggaggccgggtcactagttttcctataggttctgtcgc

SEQ ID NO: 59750 - DNA, 687 bp, Triticum aestivum
  Clone ID: PAT_TA_59750
gccggccgggtccggaaacaactgcgaagcttctctccaccacattctcccccatcacagccctcacaatgtttgcgcgaacagtagcatcgtccctccgacaagccgcccggcccatggccgtccgctcaacggcctctgccttccgcacccccatcgctcctctatcccccttccaaatccgcctcctctccgaccaaacccgctccgccatcgacaaagccgtgtcctccgcccccgtcgtactcttcatgaagggaacccccgagacaccccagtgcggcttttcgcgcgccgccatccagatcctcggtctgcaaggcgtcaaccccgacaagttcgccgctttcaacgtcctcgaggaccctgagctgcgcgagggcatcaaggagtactccgactggcccacgattcctcagctctacgtcgagaaggactttatcggtggtacggatattctggtgtctatgcaccagaatggtgacttggctaagctcttcgacgagaagaaggttattcttgagggagagcctgagcagaaggaatagaggataaataattgggagtgtatgaatattcatgatgtaatatgggatggataccactgtatggcagattacggattgtacagcaaaaagcaatagaaaggtgcgattaaaaaaaaaaaaaaaaaaaggcccctagggc

SEQ ID NO: 59751 - DNA, 550 bp, Triticum aestivum
  Clone ID: PAT_TA_59751
gccggccgggtccgaggtcttcgtcttcgtcttcgtcttcttccccgcgcgctcctcccccctccccggcgaccaaccccgtcctcctcctccgccggcccatctccgccgccaacccaaggtgaaccatggcgaagatcaagccaaaggcactgctggcacagagcaaacagaagaagggccccacgcagatcggcctggtgaggatcatcacctacatcgtgcttggagccctagctgtgtcctccgtttactatgcctatcagtactggcagagcaaaggagcggccgttgcggcagcagcaggagtagcagaaggcgtcgtggggaactaagccccaggaatgtagttgcttttgctgctgctgttgttgtattgtcttgtcggttattttggttgtcgcagtccggtaaatttgtggaacattgacagatcatgcgacgcttagttgtatccccttgtaaattgccttaacatttatgcttatatttctttctgtgacaacaaaaaaaaaaaaacaaagaaaaaaaaaaaaaaaaaaggccccta

SEQ ID NO: 59752 - DNA, 233 bp, Triticum aestivum
  unsure (1)..(233): unsure at all n locations
  Clone ID: PAT_TA_59752
gccggccgggctgcgtcaccataagctcacgcaaacacaactatcccccagtggncagcaactctgaacctcccggaccaagttagcaatggnaaagcgcctcgccgtcgcgctcctgctgntggtcctgctcgngtccagngangccggtggtggtggccgngctgntangggggttggngagaagaaggatctggtggccggtgtggacatccctctccctggattatttg

SEQ ID NO: 59753 - DNA, 620 bp, Triticum aestivum
  unsure (1)..(620): unsure at all n locations
  Clone ID: PAT_TA_59753
gccggccggtttcgaataccgcccgcattcgcgtcgctctcctcactcctctcctctctcctgcggacggatctcgccgccccgtcgcctaccaagcacgtcgccggtgcgcatcctcaccgcgcagagagatgggcttgtggatgctgctggagggttttttgcttcttgcaaattctttggcgatcctgaatgaagaccgctttcttggtcccaggggatggagcatgtctgaagtttcaggaaatgggcaaacaaagtcgttgaaggggcagatcgtggggctcatctacgccacacagtttttgcggatgcccttgatagcgcttaatgttcttatcattgttgtgaaaatggtgtcaggctgaggctctctgctgttgggttgaactgatttcaataccagcattatgtaaaagctaatcatgttcaaaagttgctgcaagatgttcacgctgacttgaatgtggcctgttggctttgttgctgtaaatccctctgctctgagggtaatctttcctcctgtatgacttctgaatcatgcatgcatctgttgctattggtgtgggagtaaaaannnnnnnnnnnnnnnngaanannaaaaaaaaaaaaggccccta

SEQ ID NO: 59754 - DNA, 255 bp, Triticum aestivum
  Clone ID: PAT_TA_59754
gccggccggtttcaaaaaagaaggagcatacgaccacctctgctgatctgtttcgccgcgtgcggagatggagatcgatcgtcgatgttttttttttctgtttgagatccatgctttcgtagctagtagctgaactagtagtgattgtcaacattatatcgtccagggtgataccaacatgaacccatgtactgattgtcaactttatgtcctagatcagtttcagtagaaaaaaaaaaaaaaaaaaggccccta

SEQ ID NO: 59755 - DNA, 745 bp, Triticum aestivum
  Clone ID: PAT_TA_59755
tgcctcctcctagcatctctatacctacatagtacagccatggcccccaccgtgatggcctcgtcggccatctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggtaaggcctaaacagctcactcacgacaggtcatatataaagtgccattgcagatttgtcaactcagacattgctttgggatttccttctccatttatctttcttatttgttcctaagaatatgtgtatggccatgttcatggacaaacatggctcgagaaagaatgctcgtatgtgaatgctatcggg

SEQ ID NO: 59756 - DNA, 756 bp, Triticum aestivum
  unsure (1)..(756): unsure at all n locations
  Clone ID: PAT_TA_59756
aagatggngntggactcctcctcctccgncgncaccgncgtngnggngttctccagtaatgggntggncggngncnggaggtnnttcntcggngntgnnggnangggggnggaggnatcangagcgaaacttcgacgtgggagacgcggngtccgagaggntcatttgattccccgaggaaactcctcccccgtggntcgaaagaaatcttcttgaaaacttcaaatttaatccttgagttattggatactaacnnaataaattgttnttgaaaagtgaaagnntaattaaaaaantanaggnggtaaaagatgaaaatagnaatnatntttaanatgaaatttgtgaaaaaaaaatataatctataaaaacacccttataggaaacaaaccgaaataagtaaagaataaaaatcaccctaaaaaaaaacaaatcatataaaaaaaaacaaaaataacaaataagaagaaanaaaaaaaaanaaaaaaataataaaaaaaaaaaaacaaaaaaataaaaaaaaaaaaaaacaaaaattcaaaaaaaaaaaataaaaaaaaaaacaaaaaaaaaaaataaangtataacaataaaataaaaaaaacataaaaaaataataaaaataacaccacaaaaacaaaaataaaataaaaatataaacaataaaatataaataaatataataaactnaaaaaaatataaaaataaaaaaaaaatatatataaaatataaaaaagaaaaaaaaaaaaaaacata

SEQ ID NO: 59757 - DNA, 216 bp, Triticum aestivum
  unsure (1)..(216): unsure at all n locations
  Clone ID: PAT_TA_59757
aaagtagnnagnaagggtngcagnnatgtngggncgtggtaagggaggnaagggnctgggaaagggnggggngaagnggnaaggaagggggtgngnngaaacatnnaggggatcacgaagtcggngattcggnggntggcgcggnggggcggngtgaagcgcatctccgggntcatntacgaggaagaccgtggngtgttcaagatctttctngag

SEQ ID NO: 59758 - DNA, 825 bp, Triticum aestivum
  unsure (1)..(825): unsure at all n locations
  Clone ID: PAT_TA_59758
ctcgaggccggccgggtcccggccagcaaattcgaagcattcccatcttccgccgccgccgcagccgcccgccgcattccgagcggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggcgtgctccccaacatcaaccccgtgctgctccccaagaaggccctcgagaaggccgagaaggagtcccagtcgcccaagtcgcccaagaggaaggnccccgctcccgcccccgccgccaagaagacccccaagaagaaggccgccgacaagaagaccgccgccgccgacaagaagaccgccgccgctgacaagaagaaggccgccgccgacgccgaggaagaggcccggcgccgacgagtaaaacgggccaagttgcgtcgcgtagttctgcatctgagaggggagagaagaaagagatcatgtgatcctgaatggaatggctgctccggagtccaactgggaacatcctgtaaggtcgattgacttgaatcacggctgaaaagaacatggtagcttgattcgc

SEQ ID NO: 59759 - DNA, 663 bp, Triticum aestivum
  Clone ID: PAT_TA_59759
gccggccgggttccgaaaaagtaaactcgccaccgctcccatgaacggaaccaacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccagaaggagtccacccttcacctggtgctccgcctccgtggtggccagtaattgccctctcactcgacctgctgctgctgctgtaccctgtgtcgtcctgtgggtgcgcctttgttcaagtgctgtctc

SEQ ID NO: 59760 - DNA, 789 bp, Triticum aestivum
  unsure (1)..(789): unsure at all n locations
  Clone ID: PAT_TA_59760
gccggccgggctgggacggacgcctaggaaaaaagatcaccacctacgtcgacatcccacttcggttcgatttgtccacgctcgctccgaatacataagtcttacaatgtcgaacaacaactggcaagaggaggccatgcgccgtctccgacagatgcagcaggcccgaggtggtggaggaggaggccctcagatgccccgagcagccggtggcgcccttgctggtggtcttttgcttgccggtggtgctctgttcctgtctaactcgcttttcaacgtcgatggtggtcaacgagccatcaagtaccagagattaactggtgtcagcaaggaaatctacaacgaaggaacacacatcaatattccttggtttgagactcctattgtgtacgatgtccgagcgaagccacgcaacgttgcgtccttgactggcaccaaggatttgcagatggtcaacatcacctgccgtgtgctttcccgccctcagatcgatgctctgccccagatctaccgaacactaggcaccgactacgatgagcgtgtgttgccttctattgttaacgaggttctcaagagtgttgttgcccagttcaatgccagtcagctcatcacacagcgagagaacgtcgctagactggtgcgagagaaccttgctcgacgagctgcccgattcaacattctttctggacgatgtctctctaactcaccttgccttctctcccgattcacagccgccgttgangccaagcaggttgcccagcaagaagcccagcgagcttgccttcgttg

SEQ ID NO: 59761 - DNA, 713 bp, Triticum aestivum
  Clone ID: PAT_TA_59761
gccggccgggtccggccgctgtgtaaatctgtctgggatgggctgtagcgcgggggtgatctcggtggggctcgctgccggcctacttcgtgcagcgccccacggtgttgctgctgctcacgctctggtcgtgtccacggagaccatcacgcccaacctgtacctcggcagggagcgctccatgctgctgtccaacatgctctttcgggtgggcggcgccgccgtgctgctgtccacgtccaaggacagggcgcggtttcgactcgcccacctcgtgcggacgatcaccggcggcgagcaggacagctcctaccggtgcatcttccaggaggaggacgacgaaggcaacttgggggtcaaactttccagggacctcatgtgcgtcgccggtgccgcgctcgaggccaacatcacaggccttggcccgctggtgctccccttcttcgagcagctgcgcttcgtcgccgacaaactgctgctcaagctgggccggcgaggcggcgtgaaggtgaagccttacgtccccgacttgtgcaaggcgttccatcacgtgtgcatccatgcaggggggcgtgcggtcgtcgacgaggtccagtctagcctcgggctgtcggaggagcacgtggagccgtctcgcatggcgcttcaccggatcggcaacacgtcgagaagctcggtgtggtacgagatggcgtaccttgaggccaatggcc

SEQ ID NO: 59762 - DNA, 767 bp, Triticum aestivum
  unsure (1)..(767): unsure at all n locations
  Clone ID: PAT_TA_59762
gccggccgggttcgggatccacgatacgattcaaccctggggagaggaagaccgaattctcgaatacctgacacagcgtccgaccacgacaatggctccccaaaaatcattgctgcagtatatctgcagcttcctgctgctcatcagctccgttagcgctctcaagttcgaccttatcgcaggatccaaggagcgctgtgttcgcaactttgtcggcaaggacaccctcgtcgtggtgacagcgactgtcgatggctacaagggcgatggcatggtggtgaacctctacattcgcgatgctgttggcaacgagtacggtcgccccagggatgttgttggagagtcaagaaccgtctttacttctcacgccgatgctgctttcgatgtttgcttcgagaatgttccttctggctcccagcgactcaacagccctacccgtcacattgaactcgatatcgatattggtgccgatgccaaggattggtccgctatccaggccaccgagaagctcaagcctgtcgaggctgagctccgccgtgttgaggagatcaccagcgagcttgttactgagatggagtacctccgcgcccgagagcagaagctccgagataccaacgagagcaccaacaaccgtgtcaaatggttcggtattgctaccacttggcttctcgttggtctctgggcttggcaatcatgtacctccgcgcctacttccgantccagcatcttatctanaagagtgtttttacatgcgcgntgtctacgac

SEQ ID NO: 59763 - DNA, 621 bp, Triticum aestivum
  unsure (1)..(621): unsure at all n locations
  Clone ID: PAT_TA_59763
taaaaggangagaaggcttcaagcgacggccagataagaagcaagctcctccgtccattgctccccccagccgcgcatcatccatccatccgttccactgcaccatggcgctcatgctcagcccggccgcgaccttcctccccgtcgtcgccggcaagcccaccaccgccatgcggaacctcctcttcggcaccaccaccagcaccaccagcggtcaccggagcactcgcaaggtggtggcgatggcggacatcctgggcgacttcggcgcgcgggacccgttcccggaggagatcgcgagcaacttcggggagaagacgctgggcaacgtggacacgctgcaccgcatcctcatccccacgctctccgtgctctccctctcccgcgtcccgctcgacgccgacccggccccgctctccgaggaggacgcccgcaggctgctcttcaaggtgggcggctggcggctcctcttccccagcaagggcgactccgacgtgctcaagctcgagtgcgtctggaaggtccgcgaccaggcctgcggcgacgagctcgtcgccaggatcaaccagggcgctcgacggtgccggtcacgaccccgccgtgctccggttcgaggggcca

SEQ ID NO: 59764 - DNA, 543 bp, Triticum aestivum
  Clone ID: PAT_TA_59764
gccggccgggtccggaaccccaagacaccagcctcctctctcctcacagtcgcagcatcctctcagtcctcaccttcctcccctcgccaccacccaccaaggaaaggaggatgtcttgctgcggcggcaactgcggatgcggcgccggctgcaagtgcggcaacggcgccggcgaccagccgcggccgctccggcaagaccgacaccggcggcacggtggcggcggcctaacctgacggcgcacgagaggcaggcacgctatcatcttccgaagctacctgccggccagtagctctggaagctctcgcttctcaccgcccgctacgcatgtattactctcgtacgtagtacgtacgaacgcctccaatatgaatcgctggtaatctgtgcaggccgtcagccaccgctggtcgatcgatcgaccatcgcctcagtacaactgcatagctttttatcaattgtatgtacacttggagctcgaatccgtttatgagatcgttccttcctacggtcctccaaaaaaaaaaaaaaaaaaggccccta

SEQ ID NO: 59765 - DNA, 638 bp, Triticum aestivum
  Clone ID: PAT_TA_59765
gccggccggtttcgaaaaagatcagaacacatactgctctcacatagacgacacacgcacgtgcgcagctgcggcgtatttcttcttcacctccttcccggtcaaaagagagaaagaatggcggccaggctcagagagggagcaccggcgggcgctctcctcgtggtggcgtgcctggttcttgcgacggcggcggccgtgagtggcgccaggccgctcgcggtgcgggaggaaggcggcactccgcgtgcggtgacggtggaatcgccggcaggcgatgctatccagacggtggcgagggccgtcgagcgcaggttattggtcgacgtcggcatgctcctcgggatcaaggactccgggcccagccccggcgccgggcattaagcgccggacatgccatcccatgccacggctgccattggaactcgggaggaggcgtaggatgattcatggtttcatgattgtttctttagttctttattcatgtacgtacacgagtaacggagtaagcaccatagtttagtgtcttataagtgtctgattttgcagtgcaatttaaagcatttttttatatcagatgtactagacatggaacactttctttgagtcagcaagttatgatgatgaaacttatcctt

SEQ ID NO: 59766 - DNA, 598 bp, Triticum aestivum
  Clone ID: PAT_TA_59766
gccgtcctggcacgcccgacgccgggcaacgtccagtgcttcggcaggaagaagaccgccgttgccgtggcccactgcaagcccggccgcggcctcatcaaggccctggagccgatcctgctcgccgggaagtcccgcttcaagggcatcgacatgaggatctgcgtcagcggcggcggcaaggtgagccaggtctactcgatccgccaggccatcgccagggcgctcgtcgcctacaaccagaagtacgtcgacgaggcggccaagaaggaggtcaaggagatcctcggccgctacgaccgcacgctgctcgtcgccgacccgcgctgctgcgagcccaagaagttcggcggccgcggcgcccgcgcacgcttccagaagtcgtaccgttgagctcccctgtcggacgagacccctcgtctttttgcgtattatgctatcttaggttaatgatgagatcggatgtcctgataggttttgttacttgtttcgacctgtttgagcttgatttttagttgaacacaagatagatgatgaatctttatataatccagtgatgtgatattccaatcgaaaaaaaaaaaaaaaaaggccccta

SEQ ID NO: 59767 - DNA, 725 bp, Triticum aestivum
  Clone ID: PAT_TA_59767
gccggccgggtcgacacaacgcagatcagagcgcattcctatcccgcaccgccgcccacgcatctcgagtggtttccagttcgccggagaagcagcaagtgagatggccggaaggaagggcggcgacaggaagaaggcggtgacccgctccgtcaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaagaagtctcccgccgctgccgagaaggaggccaagtcgcccaagaagaagacctccaccaagtcccccaagaagaaggtcgccgccaaggagtagccgccaccatagactactatcatgacattgcttagatccatagcagggagaggaagatgaggtttggttgattggatcatctatgtaattgcctagtctgtagtgactttttcattggtttgatgaacgggccacttgaggctggattctatctctaaaaaaaaaaaaaaaaaagccccta

SEQ ID NO: 59768 - DNA, 623 bp, Triticum aestivum
  Clone ID: PAT_TA_59768
gccggccgggttccgaaccacacggccgcaacagccaccatcagaccagcagcgcacacaccagccaagccaagcgaagctcgccggagagagaatcgtcggagatgtccggccgcggcaagggagggaaggggctgggcaagggcggcgccaagcgccaccggaaggtgctgcgcgacaacatccagggcatcaccaagccggcgatccgtcgtctggcgcggcgtggcggcgtgaagcgcatctcggggctcatctacgaggagacccgcggcgtgctcaagattttcctggagaacgtcatccgcgacgccgtgacctacaccgagcatgcccgccgcaagaccgtcaccgccatggacgtcgtctatgcgctcaagcgccagggccgcaccctctatggcttcggcggctaggccgcgccggcgcagtcgaatccacctccacctcgcgccgccagattcgtagcatagctagctatggttgttcagtgttcatcgtcttcattgtaatggccgcatgtcgctgctgttgttcagtgttcggtgtttggatgtgccatgatagaatggaaatcgcagcattttaccctcgaagaaaaaaaaaaaaaaaaaaggccccta

SEQ ID NO: 59769 - DNA, 593 bp, Triticum aestivum
  Clone ID: PAT_TA_59769
gccggccggtgtcgggacgacaagatcaagaagcacagagcatgaacttccccactccaatcactatcctcgacaaaaatccccctatcccaaccatagcccctacgatcccgtcaagatcgtcaaccacagggtgttcttcatagctcacctgcgacatgggccacatccgcgcactgctcgacgcacatgaacatggacatccttttgagtactgtgatagaattaccactacaactgaccagtctctacggggaccgaggagaggcatgatctttgacactaaaagggcatatcgctgcaaagaatgatcacccagttcatgctgcatatgactatcatcacaaaatcaaatttgaccggttcccatcgcttctacgtggacatcaccaccaacaaaaagctggccttgaagctcgcctgaaccgaaatcctactcctggacacaacggctaccaacaccaagtcatggccaacgttgatgtcgaccggaaaacagctaatgagtcaacgttacgagatggtgatccatggaactgaccaacatcttgtactatgtcatcacatccacaaggcgtgattgcgaaacagga

SEQ ID NO: 59770 - DNA, 593 bp, Triticum aestivum
  Clone ID: PAT_TA_59770
gccggccgggatgcaaataccattgttctagtcattggtgttctcgattgcgatattatggtgttttgaagcaaaaaaaaaaaaaaaaaaaaaaaaaaaattataacaaaaaaaaaaaaaaaaaaaaaaaaaaaaaaaaaaaaaaaaaaaaaaaaagaaaaaaaaaaaaaaaaggggcccctgggggcgggggcgctaaaaaaataggggacccccgggggtgggagaattctatataaagtttatcaaccccggacacctcggggggggcccggacaccaaattccccatatagagaggcataatacgcgcgctctgggggcggctttaaaaaacggcgagagggaaaattttttggcgacccccaacaaaagcgttgtggaacatacccctttttccacaggtggtaaaatagaaaagaggcccacacagatcccctttcaaaacagttgcacacccaaagtggaaagggaaaattgaaagcgtaaatattttgaaaaaatccgcgaaaaatttgtgaaaaaacaccttatttttaaaaaaaagagggcaaacgcggaaaaaccccttataactcaaaaaaataccccgaa

SEQ ID NO: 59771 - DNA, 697 bp, Triticum aestivum
  Clone ID: PAT_TA_59771
gccggccgggttccgcacgcacgaacttccatccatccgtctcctcgccacgcgcgccaggccacagccgcaacacgctcgctactactagcagttacgcgcccctatccccccacctctcccttccactttccccacctcgcaggccaagcaaacgcacgccaggcgaggcagcacaaagaagcagcgaggcagccatgtcgtactacgaccggcgcggggagtcgtcggtgctggaggcgttcacgctgtcgccgctgccgtacccggtgatcctgatcctgatgatggtgacgctgctgctgggggcgtcgtggttcttctcctacgaggagttcatggaggaggcgtcggagcagttcagctggttcctgctgggcgtgcccatcgcgctcgtcctcctcatccgctggatctcctccgtcgacaccttcgagggctacttcggcttctaccccaccgagagccgctggcggggctacccggccgcgccctccgagggcagctccccctggggcgtcgccatggtcgtcctcctcctcctcgtcctcgccagcttccactccaccttccaggacatgtggaaggcttgatggaatgatcggttctccgatccatacctcgtacgtatgtgtgtatgtatgtgattccatcgggtcgatctgtagtacgcctatgaatgattgattggtgcttc

SEQ ID NO: 59772 - DNA, 522 bp, Triticum aestivum
  unsure (1)..(522): unsure at all n locations
  Clone ID: PAT_TA_59772
gccggcctggccgggcgagtaatttggaacggagggagtactacgaacgcagctggagccatacctggaaatgatagcggatcggaaggacagggaggagaagatggggatgatggacccaaggggcgccagaggcaaggncagngtgtactatagctacgtgggctccctcaccaccccgccctgctcggaaggggtcatctggaccatcgtnaagagggtgggcactgtgtcgaggnaccagttggagcttctcagggaggacgttnangacgaaatggagaagaacgngaggncgagtaaggaggtgaacagnagaaatatcagaatgttncggncttttgagnaaaatagaaattgattaatagtgttgatgttctgggtaattaatttggtggttnagttattttttatgtacatgtttatattatttattcttactaataagtaatttccatcccactttaaaacttttgtataaagttactgaataataaaggaacaataaccagatcatgtcct

SEQ ID NO: 59773 - DNA, 724 bp, Triticum aestivum
  unsure (1)..(724): unsure at all n locations
  Clone ID: PAT_TA_59773
gccggccgggtcgggagttcgtgtgcgcgcaataaatcagaacgtgcaaactatcttcaagtgtagtaggaagccagatcagccccgaacaattcttctttcttatccacaattccacattcccaattcattcacgcatcgctacacaagtggcctcttttgccaccggtccccttacgggcacccgacgcacggcgagcaatggcgatttaatttaattacaggcaggggatcgaccggccggcggtgcccggccgggctcagatgtctcgccggcagagcgggcaggaggcgtgcctgacgagccagcggtcgatgcagggcgcgtggaagacgtgccggcagccgggcagtcgcctcgccgactcgcccacctcaaggtcctgcaggcacaccgagcagcagagcgcctccccggcctcgtcgaccgcggtgtccgcgccgaccttgatcgccggcagccgccggagcgcgtgcgccggcagccctctcgcgccgccggtctcgaacaggtcgctgggctccgtgaacggcgagctgatggcgcttatctgcatgccaatgtatgcgcggttaattaattattaatgctgacactgacggtgaaaatgtgaaacaactattgacatcatattatctttttgacttgtgttgacaannaaaaaaaaaaaaaaaaaaaaaaaaaaaaaaaaataaaatatatataaataataattaaataatt

SEQ ID NO: 59774 - DNA, 627 bp, Triticum aestivum
  unsure (1)..(627): unsure at all n locations
  Clone ID: PAT_TA_59774
gccggccgggtccggatcgtctggactcacggaacagatctgctctctctcagactctctgcagcggccatccgtcgtacaatccaccctccggacgcacggcagccatggccgaggcggcgcagggcggggggctacgcggccgcggcgctctgctgggcggcgtccaggacgcgccggcggggcgggagaacgacctcgagaccatcgagctcgcgcgcttcgccgtcgccgagcacaacaccaaggccaacgcgctgctggagttcgagaggctggtgaaggtgaggcagcaggtggtggccgggtgcatgcactacttcaccatcgaggtcaaggaaggcggcgccaagaagctctacgaggccaaggtgtgggagaaggcctgggagaacttcaagcagctccaggacttcaagccggccgcctgaaaagatgtaaataaatatgttatgtgagctgaaccgctcaagcttgtggatggggcctatccaacacgccagcctcactggatactggtgtaatatgatgaaataaacctgcttcctgccaananaaaanaaaataaaaaaaaaaaaaaaaaaaaaaaaaaaaaaaaaggaaaaaaaaaaaaaaaaaaggccccta

SEQ ID NO: 59775 - DNA, 862 bp, Triticum aestivum
  unsure (1)..(862): unsure at all n locations
  Clone ID: PAT_TA_59775
gccggccgggttggggcgtgtgcccgacaagacttggaccctgtgcggacacctgattacttagcccccgaagtggtctctaataagggttacaacaaatctgtggattggtggtcgttgggtattctgatatacgaaatgctttgtggttacacgccattctgggacagtggatctccgatgaagatctacgaaaacattctcaagggcaaggtcaaatatcccgcatacgttaacgcagacgcccagaatctcctggagcgtctgatcacagccgatttgacgaagcgattgggcaacttgtacggaggcccagcagatgtgaagaaccacccttggtttgccgaagtcacctgggaccgactagccaggaaggacatagatgctccgtatacgccaccggtcaaagcaggtgctggtgacgccagccagttcgatcgttatcctgaggaccctgaaaaatatggaatggttggaggaacagatgagtacggacacatgttcacagagttttaaggacatccatgatggaggaaagatcgaggcttttgtatgattaggatgaggccagacctcacttgatgcgaacaaccgtgggtgggacgtcaatgatggtgaaatgatgggtacacttttgttcttgacatgacggttctagtggttcatttttgcgagcaattgtggggttgggttgtaggaaaagatgagctgttggagacaactcagctcgaaagagcggcgctggtgggcatgcgaaagggagcttggatattncctttttacagtaaggttacagaaataaaccttgtatcagtaggggtacagacacagcttcatcgagtacgactgcatcctttttgcg

SEQ ID NO: 59776 - DNA, 678 bp, Triticum aestivum
  Clone ID: PAT_TA_59776
gccggccgggctccggtcaatcaagcagtagtgccaataggcttgtgaccattttgatgtatctttctgatatcaagcaaggtggtgaaactgttttccccagatctgaggatactcaagccaaggaaggaacaccttctgagtgtgctggttatgcagtgaaacctgtcaagggcaacgcagttctgctgttcaactcaaggcctgacggagtcgccgacaaggacagtcagcacgagttctgtcctgtcgtcgaaggggagaaatggcttgccataaaacatatgtatgcaagcaagatcgataaatcaaaaccttcgccggcatccgaggatgatgattgcaccgatgaagatggtaactgtgtcagttgggccgctgccggcgaatgcgacaagaatcctgtgtttatgattggcagttcagactactatggcacttgcaggaagagctgccatgcgtgctagatgttttttttgttttcgtgcattgcccttggggatgtctcttagcattttcgttgtttaatacaggcattggtgttgtaagtggaaaatgattcagcaaactgtgcaatgcccgcagataatctttactcttgtcaggaatgtagtaagtacataggtattggattggctactcttataaagttatgaaaaatgattctgacctcaaaaa

SEQ ID NO: 59777 - DNA, 644 bp, Triticum aestivum
  Clone ID: PAT_TA_59777
gccggccgggtctcgatcgcccctgtctctctactactcagccaaacttcgaagaagcagcagtcgccgcagcatccatggcccccaaggctgccgagaagaagccggtggagaagacccccgcgggcaagaagcccaaggcggagaagaaggtgccggcgtccaaggagggtggcgacaagaaggggaagaagaaggccaagaagagtgtggagacgtacaagatctacatcttcaaggtgctcaagcaggttcaccccgacatcggcatctcctccaaggccatgtccatcatgaactccttcatcaacgacatcttcgagaagctcgctggcgagtccgccaagctcgcgaggtacaacaagaagcccaccatcacttcccgcgagatccagacctccgtccgcctcgtcctccccggcgagctcgccaagcacgccgtctccgagggcactaaggctgtcaccaagttcacctcgtcctaggctcctcctgcattagttctagtgtttatttcctctccctcgtctgatgaattctgtagctagctgtgtgtgttctgacagcgtcatcctgtaacaatggtgctgcctgaataaatagtcatgttgctgcttgaaaaaaaaaaaaaaaaaaggccccta

SEQ ID NO: 59778 - DNA, 616 bp, Triticum aestivum
  unsure (1)..(616): unsure at all n locations
  Clone ID: PAT_TA_59778
gccggccgggtcgggcgaacaaaccttctgcaccccgatccggttcggtttagttcgctggcgtctccacccgatcgactccactgcaatatgctatagcccgtggagcctggggcgttggttgtacggnagtagattcccgcgggatctgccggggcgcccggagccggagaaggcgacgatgtcaacccctgcaaggaagaggctgatgagggatttcaaacgactgatgcaggatcctcctgcgggcataagtggcacacctcaggataacaatataatgctgtggaatgctgtaatttttggtcctgatgatactccctgggatggtggtacgttcaagttgacacttcagtttactgaagattatcctaataagccacctacagtgcggtttgtttctcgaatgtttcatcccaatacttatgcagatggaagcatatgtttagatattctccaaaaccagtggagcccgatatatgatgtagctgctatattgacatccattcagccactgctttgcgaccccaaccccaaattcacctgccaactcagaagcggcccgccctattaagcgagaacaagcgggagtacaaccgtaaaagtacgtgaggtc

SEQ ID NO: 59779 - DNA, 617 bp, Triticum aestivum
  Clone ID: PAT_TA_59779
gccggccgggttccgatctctttgtcatcccgaagacggttcgcagcacccgatattgagcaggagccggtggtagcctaaaccacatgacggcgacctaaacctagctcgtgaccatggctaggggtctgaataatgatcgtgaacaggctctactgccccgctgtcactgcatgcttgacaaacttgctcgcagctgtttagccccctcgccatcatctgtcccacaccaagccaaatcacgccttcctctgatcctcatcctgaggaaagactgaaatatgttctcacctaccgggaaaagatcataatccttatgcactcatgtatcatgtccgatgaaaagctcctgactgaccatacctaccctgctcgtactacatggacgttacttctactgccaagacgggagataactaaactctactgtctcactgcaatggacgctttcaccttcactctgtctcgcctgacgacgtgaaatgactcctctgcaaggtcttgacatgtccagttcagaacaaaaagacatcccctatctgaaccgctatgatgtccgctccatacagatatcacaacctctcatcacttgcaatgacactatctactctcacctg

SEQ ID NO: 59780 - DNA, 250 bp, Triticum aestivum
  Clone ID: PAT_TA_59780
gtgcggcgctcaggcggcgggtcgggaccgtcttgacagtatcgttattttggatgttaccaacgtggtggcgagtggcagacgcccccggtcggcaaccagaacagccaggcgctgaacacatgctctgatggtcaactgcttacaaaccggggcaccaatcgacaaaacacaggttgggtgcaggaagggatgagtatgacgacaaagaaaacatcaaaggtaattcgggagaaagacctcgtcgctc

SEQ ID NO: 59781 - DNA, 725 bp, Triticum aestivum
  Clone ID: PAT_TA_59781
gccggccgggctgcggattagccagcttatcacctgctccactgttgcccgtcgccttccgctttgtttctctcctctgtctgtcaccgtccactccacagagagagcagcgagctcgtcgatccgggggagatcaggatgagcgaccccaagtacgcctacccctaccccgcgcaaggttactaccagggagggccataccaggggcagggcggcccgtaccaggggccgccggtgatggcgccgccgcagtacgccgcgccgccgccgcgcgcccagcccagcttcctcgaaggctgtttggctgcgctttgctgctgctgcctgatcgacgagtgctgctgcgacccctccatcatcttcgtcggctagatcagctggccagaccagggcacccggcctggcatgctgtcaactgtacaaacagatggcctcatcaaggatatttaccacgttgttgccacgctatatatgatgatctctctctatatatatatatatatatgtatgtatggatttgcttattgttatctcttctcaccaacggtgctgcctgcctgtgtaactcgaatccatccatcagtaacagaggctttatgatcttaccatcttccatccgtctccatttcctctggttgtaactctgtatactcttgcacgtgttgctcgttcattctgctcagtagtgatgatttgtgattaattctattattgtggttgggtgg

SEQ ID NO: 59782 - DNA, 851 bp, Triticum aestivum
  unsure (1)..(851): unsure at all n locations
  Clone ID: PAT_TA_59782
ctgtgcggcgctcgaggcggccgggttccatgaatgtctgcccgctggttcgatctgcctctcgaatcaaaaatgaaagttgtttggacgacaccagaagccaaccgaggctactcagctcctggtagagagaaagtcagtcagctcactgacctggccgacgttgagaagatgcgtgctgctttgccagatataaaagagagtctcgagattggccgtgaaaacgaagctggacacccgaattattggcttgaagagagtggcgaacttgtaggtttccgaaaggacatgcttgggtttttcgagcagtgtcgccagttgcacgttgaggtgatgaaagccatcgctgttggcatgggccttgacgatggtttctttgacggtttcgttgacgttggggataacacgctgcgtttgttgcactacccgtcagtccagtctaatgtcttcaagatgaacccaggaactgtcagagctggagagcacagtgactatggttcaatcactctcctgtttcaagatgttcggggtggactacaagtcaaaagcccgacgggccaattcgtcgatgcaacgcctattgaaggtactgtggtcgtcaacgctggcgatttactcgctagatggagtaacgatatgatcaagagtactattcacagagttgtcgaaccaccacagaaagaggcagaatcttatccccctcgttacagcattgcatacttttgcaaccccaacttcaagagtttcatcgaggctattccggggacttttgagacggagaagggatagaagtatgatggtatccacagtgggtgattaccttgntcagagattgactgctacttactgat

SEQ ID NO: 59783 - DNA, 783 bp, Triticum aestivum
  Clone ID: PAT_TA_59783
gccggccgggtcgggatcctttacacctcggtgttggtgctaagcgcaccgacctcaagtacgtgtttgagggctctgaggacttccaggtccttcccactttcggtgttattcctcctttcaacaccgagatgcctttcgactttgacaacatcgtgcccaacttctctcccatgatgttgctccacggagagcaatacctcgagatccgcaagttccctatccccaccaacgcccgccttgttagccgaggtcgcctcctcgaggtcgttgacaagggcaatgcttctattgcccgaagctccaccactactgttgacgccaacaccggtgaggatgtcttctacaacgaagccagcgtcttcctccgcggtactggtggttggggcggtcccaagcgtggtgctgaccgcggttctgccactgctgccaacaagccccctgctcgcgctcccgacgttgtcgtcgagtcccccacaaatgacgaccaggctgctatctaccgcctgagcggcgactacaaccctctccatatcgatcccgagtttgccaaggttggtggcttcaaggcccccatcctccacggcctctgcagcttcggtgttgccggaaaggctgtctacgagcgcttcggtgctttcaagaacatcaagctccgccttcgccggtgtttgtatccccggtcagaccattgtcaccgagatgtggcgcgagggcaaacagatcttcttccagtccagggtcaaggagactggcaagcccgccatcgacggtgctgctgct

SEQ ID NO: 59784 - DNA, 368 bp, Triticum aestivum
  Clone ID: PAT_TA_59784
gccggccgggttccgatagagcagtcatgatcagtgagaaagatttgtggagaagttcatatgccctcacaaggaagttgcaccacaccttgctgaagactatgcagcagcttgcagaggggaagtgccttccagtttcagatttacataaaccaagagcgggctatgagaattggtaactgtgtatgacgcagcagagtttatgctctgtgcagtcagctagtaatttctgtttcggtgttatttgcctaattggatgtttgttgtctgctctagtatgtctggtacatgtcaatttagtgtcgctaattccatatgaaattgataatttgattgtgacttaaaaaaaaaaaaaaaaaaggccccta

SEQ ID NO: 59785 - DNA, 776 bp, Triticum aestivum
  Clone ID: PAT_TA_59785
ccggccgggttgcgaaattacacaagcataaagccagtgttaatggcaaacaaagtgttgaagctgtggaggcccatctgattgatccgcaagaaaaggtcgaagaaagtgctagtgtagataccaagaagagcttattcaagaattggccattgatgtcttccataattgtttattgcatcttctcctatcatgacatggcctatacagaggaggatgcccgtgctgaccaggaggacacccttctgcacctcggccaccacacaaggttaacacctggagaggctcgagctatgagcagtgagctgttgctgctgctgccggatgctccagtggcgaaacctccatcgattccctccacggccactaccactaccctagctactgctgccgacggaaccaccaccatatcctggctcggccaagaccagctccttgagatcttcctccgcctgccgagcctgccggccctcgtccgtgccaagctcacttgccgctcgtggctccgctccttccgcaacctctttcgcgccctccacccaggcgcccctcatcaggatcttcctcgatgtcgacgaaggcaatgtcccgcttgtttgccccccttcagccgctcagatcccgacgtcaataaggacattacactggtagattaacgcaatttttccttttcctttttcttattattggagggaggatgttagaatgaggaactgtatgatagtaaatacggcaacagtgtaatagtataaccagaaatatggacattccatcac

SEQ ID NO: 59786 - DNA, 480 bp, Triticum aestivum
  Clone ID: PAT_TA_59786
gccggccgggtcgggttcagggtgagccggagcgcgtgtgcacccatcagggctacctgcagatggccaagcctcctcctgctgctgctgctgcccatgataatgaggatgatgaggatgaccatgaggaggagggcaagaacacaccatcatcgtcttgttagacagacagacgggcgccttcatgtggtggcttggcttggctgctgtgtgacgatggtgactgcactctgtaggaaggaaggaaggaaggagatagtagtagtgccggatctcggtcgtcgtaatcatcagtaacttgtatgtatgtatgtatgtattgccgcctccgcctccgcctgtggttcaaggggtaaataatgaagagaagggacgcgcctcacttgtaatgtaatgtaatgtaatgcaatacgagcaaagaagagagcagacgtgaaggcagctatgtgttgacaaaaaaaaaaaaaaaaaaggccccta

SEQ ID NO: 59787 - DNA, 808 bp, Triticum aestivum
  Clone ID: PAT_TA_59787
gccggccgggccgggaaaagcaaggaccggcccagcgacgagatgcttgaggcgattcgtcaatacgttgctatgagtcgtgatgagcacaaaactgtcagaaatgccagcgaggagcacgctcagtccatcatcacggctatttttaatggatctaacccggcactggcgactcaactcgatgatcagaagcacgcacagtgccttgaatactattctgcccttctctcggttcgcgaccgcgagggcataacgacagccttctgtcgccagccccccgatcttttcactgcaacaatcaaggatttattcgcggcatatgagcccatgatccgtaccatgcattcgcaaatagatctacgcgagcatatggagtcggcacaactgttcattgacgaatttataaagaccagcaagccaaacgagtctggcagcctgccaactgtcgatgactatgttggtctgttcatgagaaaccgagagctcatgtacaggtgggtccacgcatttgcgaaatcatgccctgatgtctggaaggagatgaagaattggacccaagatgctgttctcaagttccgtcaagagcggaatcctgtgagcgtgaccaaaggtgaagattcggacaagacgaacaatggtacggcagacatgagtgtcatggatgaaaagctcaacaagctcttccagtctatccctgagaagtctcagaaggatgtactcaacgctttggataacatgccgcataccttgcgcaggtcgaagctctttccctctgccgtctccacgtctcatcgactctgacgactcg

SEQ ID NO: 59788 - DNA, 718 bp, Triticum aestivum
  unsure (1)..(718): unsure at all n locations
  Clone ID: PAT_TA_59788
gccggccgggctgcgnaaaaaaacctccccaattccatccctattccccaaaattttccccaccggcgacgacgccctccccaaatccgatccgccgccgccgccgttgacgccagccatggccgccgccgcccgccgcgccctgctgctcctcctcgccgccgccgcggtggtcctcctcgcggcgcccccggcgtccgccgcccgcccctgcggccgcgcgcagacgctgctcatctccttctcctccttctcccgccccaacccggacccggctgacccctcgccgctcaccaccaccgtcgtcaccgtcctccgcgtccgccgcctcggcccgcaccgcttccacgcccacgaccagaaccacctccagatccgccgccccgccgagtccctccccgccgtcggcacccccgagaccgacgccgacgccgcctcctccttccaggagcgcgccaaggacatcctcgtcgtcgtctcgggcctgctcttcggcttcggctgcggcgccctcaccgccgcctccatgtacctcgtctggtccctcgtcgcctccaccggcgccgccagcccctacgaggagctctaccgcgacgacgacgacgaggacgtctccgacgacggagcccgagagccccaagaaggccggctacgtcatcatccacggtgcccaaggacgtcgttggcggtaagaactaaataggaatcgggctttgca

SEQ ID NO: 59789 - DNA, 720 bp, Triticum aestivum
  Clone ID: PAT_TA_59789
gccggccggtccgggctcctcagtcgtcttcgcatctgctcccgcccgcagcccatgtaagataagctcgagaggttgtgctgagattgtcagatggctccccttgctctgatgacagtaatgcttatgacaaggaccaagctgtcaaggatgctcaggttgtgaagtgcggatctatcacgaaaaccgcgaagaatatccgcacgtctgtgacatttcaccgcccccagaccctgtccaaggcctccgtatcccctcgtaccccaggatcagcacccctgccataaacacgctacagctctaccacatactcaagcacccgcttaccactgatcctgctatgaataatattgaccaccacacactccacttgtcttcactcgtccacctgtcaggcctatcaaagaaaagatctacgctgcctcgctgaacatgtactaactccagcccgacagggataacaccctgatcacgcctgatggtcagaataaggcgcatccgaatttgacaccatactatgatgctcttgacgtgcgcaacaatatcgccatcatatcagtcagacggactgacctgcagataggcacttgtgtcgtgaatacttatggtatagtagcgttgtagttgtgacttatcagagcatctcagtggctccattgcctaccatatcgacgcgcactatcatgcatttgatgcaatcgaaatgacttgtgttgatgc

SEQ ID NO: 59790 - DNA, 511 bp, Triticum aestivum
  Clone ID: PAT_TA_59790
gccggccgggtccggcccttttcgtgacccttcctcttcgccatctatgtcgcggccgctccccccgatgctctccgtgccggagaagaagacggccgccgccgagctctttcgcgaccgccacttcttcaactcccccgtcttcaccgatctccgcgacgcccgcgcctccgtctctgccccgaacccccaaacccagcccccctcctccagccgcgccctcctcctccgctaccaccggctcctctcctccgcgcgggacgacccctgcgccttcgacgacaacctagccttcacctggcacgatgccttcaggcccaacctcaagcacacctccgcgtccctccggttcgagaaggccgccgtcgtgttcaacgtcggcgcggcctcctcgaggatcgctgcggccgtggaccgggcggcggagggaggggtcaaggaggcttgcggggagttccagcgcgcggagggggcgttccgtgaggaggggcagatgatggaggggggggag

SEQ ID NO: 59791 - DNA, 418 bp, Triticum aestivum
  Clone ID: PAT_TA_59791
gccggccggttccgaaagacctcgcccactccccttcgcctcgctcgcgccgtggctctgacacctccctcctcttcctctccttccatccgactcacgaacgttctagtccctgacagccatgatgagaactgctggagatgcctcgagaaaggtgaccctcaaggaacaggcatataaaggaggatcaccatcgacgaccgcctaacgacctgaagatgccagttatggatggtgagctacgcctacggtttgcagctccaactgaatcaacatcataaatcgtgaaattcctgattaacaatgtcctgctcacgccattacacatcttcgacatcgaaaacctccacaacaacatcccttgctccttgctaccctaccagaggggcactgaactatatttggcgcagcttgccat

SEQ ID NO: 59792 - DNA, 591 bp, Triticum aestivum
  Clone ID: PAT_TA_59792
gccggccgggttcgggtcgagtatcaaggaagtctcgtgaaacgctcgtacccctatgcaatgggatgcaagcccaaacgcaggcttcaccactgctgatgccaacccgtggatgcgcgtcaacgacaactataccgacatcaacgctgcttcacagacatcagattccaactctgtgtacagctgttatcgtcaagtacttgggaagcgcaaggagtacaaggatatctttgtctatggtaacttccaactcgtggacgagtccaacgacaagatctttgcgtactcacgacgggctgatagcggggagacggctctcgtcgtgtgcaacttctcagtggattccgttgcatggaagttacctggcgaggctcgagaggtgctgactagtccagcgggaaggacactcaatgacttgaacagtggtgagatcaagctagcaccctgtgaggctttcgccctcctgaaatgaggaaagtcagtctgtagccatatgatatgtagttatactgcggggaaacattggtacatagaagaattagtagaaccaaagaatatgttctgcaaaaaaaaaaaaaaaaaaggccccta

SEQ ID NO: 59793 - DNA, 852 bp, Triticum aestivum
  unsure (1)..(852): unsure at all n locations
  Clone ID: PAT_TA_59793
gccggccgggccgggagacctgccccgcgaccccttcagcaccccgacatttcaatcagatttaactcagataccgaattcccctcgacacttgcattgagctcgctatacgattttccatcaccactcgattcaacatggcggctgctactgcgaccactacaatgtccagcgcgacacatcctctcgtcacaaagtggtcttctcgataccgtggggctactgttgaggacctcgaccccccagccgccctctctctcaacccctccgatgccatttctctcgctctcctctccgctttcgagcgcgactacacccacttgaccatcgttgattccgataaccgcgctctcttgggctacatttccatcccacatttgcagtcgctgctcgactcgggcaaggtcaagcccaacgatcctctctcaaccgccatgacacgtttccagcgcaagggccgcacctacaaggtcattaccatggagaccaccctcgaagaactcgaagacttttaccgcggaggtgtgcccgaaggaccttgggagcaggaatttgccgtcattacggatgagaagaggaggtttgtcctgggcgttgcgacagtgcaggatctcgaggagtttgtgaagcggagacccgagtagatcgtcaacttttcgttttggaatcaatggaatcagttttgaagagtataggtcatagggagggcggcaacaggaagggcagagcatcttgaatgggcgttggggaaatatgatctanacatcataagattgtgatgggctcgctgcagcctgtcaagcaggaaagctgctttcacatagcgcaataccctgnggatgataaccttga

SEQ ID NO: 59794 - DNA, 837 bp, Triticum aestivum
  unsure (1)..(837): unsure at all n locations
  Clone ID: PAT_TA_59794
gccggccgggtcgggaccctagcgccacaccagacgggaggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaaaggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggaggagagattggcccagggcccgagagatcatgcaccagcaccagcggctgcagctccagctgcggcaccaaagaaggccaagaagtgaagttctgacatgaagctttagctntctggtactatgaagggttagcctaattttggaacatcagaagttcagaactgtttccctgtccatatctttgttgtgtcagcgtgtcagatacctanatatcatatcgtggttgttctggtggatgcag

SEQ ID NO: 59795 - DNA, 812 bp, Triticum aestivum
  unsure (1)..(812): unsure at all n locations
  Clone ID: PAT_TA_59795
gccggccgggtccgggtatcccatcattacatctacagccgtcaatatgcgcgagattgttcaccttcagaccggtcagtgcggtaaccaaatcggtgctgctttctggcagaccatctctggcgagcacggtctcgacagcaatggtgtttacaacggcacctctgagctccagctcgagcgcatgagcgtttacttcaacgaggcctccggtaacaagtatgttccccgtgccgtcctcgtcgatctcgagcccggtaccatggacgccgtccgtgctggtcccttcggacagcttttccgacccgacaacttcgttttcggtcaatccggcgccggaaacaactgggccaagggtcattacaccgagggtgctgaacttgtcgaccaagttctcgatgtcgtccgccgtgaggccgagggctgtgactgcctccagggtttccaaatcacccactctcttggtggtggtaccggcgccggtatgggtaccctgttgatctccaagatccgtgaggaattccccgaccgtatgatggcaactttctccgtcgttccttcccccaaggtctccgacaccgttgtcgagccctacaacgccaccctctccgtccatcaattggtcgagaactccgacgaaactttttgtatcgacaatgaggccctctacgacatctgcatgcgcaccctcaagctgtccaacccctcttacggcgacctgaactaccttgtctctgncgtcatgtccggcgtcactacctgtctccgtttccccggtcagctgaactctgacctccgaaagctcgccgtca

SEQ ID NO: 59796 - DNA, 526 bp, Triticum aestivum
  unsure (1)..(526): unsure at all n locations
  Clone ID: PAT_TA_59796
ggcagcacacaatttcccnccacccccagcaanccacccccaggcccctccccggcgcgacacccgcccctccagagcaacgaggaacggcacagagcagccacccgcgaacaggngacccaggcacgacatggaagaatgaggaancgcagaagcncaagnaccaacgaggaagcaccgcgncacaaaacccacagagcncggagaaccacgaaggaggccaccaggcgcaccaaacgggaaagagccgcgaggacaccaaaagaagacaccaccaagaccgcncccgggagaacgacagccggagacgcggagcccacacaccagacgaacaccaccccgcgacgacgaagccaaagagcaacgaaccgaccacgagccaccggcccccgagacaccgccaaggncgaggagccaagaagacggacgcgaagccaccaaccgagaagaccaacgaggacccaggcacggcaacccagacgcgagacagcacggccaccgaacccccagccgaaaaccacgcccc

SEQ ID NO: 59797 - DNA, 443 bp, Triticum aestivum
  unsure (1)..(443): unsure at all n locations
  Clone ID: PAT_TA_59797
ataaanccaagtnnggatcgccttcctcctccccaantactcctcctcgcctccgngnatngnaccgnaccgggggtnacctgaggtagatnacataaacaatggtgaaggntgtggttgtgcttaccggaagagagggtgtcaagggcaccatcttcttcacccaggagggagatggtccgaccaccgtgacgggaagtgtcactggactcaaggaagggctccacggattccatgtggacgctcttggtgacaccaccaatggatgaatgtcaactggaccacacttcaaccccgttggtcatgtgtatggggaacccgaagatgaaatccgccatgttggtgatcttggaaatgtgacagctggagcggacatcggtgtttgctaccatacaatgctactgaatgcacaataatccccctcaccggaccacaaatcaaac

SEQ ID NO: 59798 - DNA, 507 bp, Triticum aestivum
  Clone ID: PAT_TA_59798
gccggccgggttccaaaatatgagactgatgagagataatatgcccatcttctgattgaggtattaatacagatcgttatcattcattgcttgccaactataatgcatcttttgtccaaaatttcttttgcattctaaaatcacgtgctgctggctgtttacttgtagcgcatactgaaggaaggcctgaagataagaacctgcagcaggatgatggtctcattcacaaagacgacgatagcggtctcatctgctaattgctagtgcaatgaattcccattgattactttagataattattaagacatgatttctctgattagggcatacgccagcgtggattatctctgctgagtactctatcttctagatagctagagatgtaatattgactatgcgtttgttctttcgagatatgactatgatcagtgtatgtaatggcggcgagaaaatgatgggtgaggagaaaattgccgactgaaggaaacgaaaaaaggcccataacga

SEQ ID NO: 59799 - DNA, 329 bp, Triticum aestivum
  unsure (1)..(329): unsure at all n locations
  Clone ID: PAT_TA_59799
gncggncgggtcgggaaccgnaaccgncgtcgcctctccactttcgtctctctcactcactctccccctccgccgccggcgcagngtcctccccgcgactccgatggncagnaagtgggtcagggccgaggtgtacccgttgttngcggngacgggggtggncatcggnatctgcgccttcagnctcctccgtaacatcaccggnaacccagaagtnagggtnaanaagatggggagggtagtaggagtggttgagaatcatgaggagggtaggtttctaaaatgagtaaggactcatagtctatgtgaangataagaactcntaaatc

SEQ ID NO: 59800 - DNA, 388 bp, Triticum aestivum
  Clone ID: PAT_TA_59800
ggccgtcacgtgtgtatctgcatttgtctccaccgctagcttatccaatcgtctcccccgagacgcatctgcatccagctccttacttctctcgttccatccctctttctcatccctgtgcttccactgatatgcagctctggatgtgaagcttccaaagtcgctggtgccccccgttccgccggagccagcgccgccaccggatcccgtcccctcccctcccatcctctctgtgtgtgcatgtttctctcatttcctcatatcgttctatgcttccaggtcgtcggcgcatgcccggccatggcgcggtcgcgtcagaccttgagctggatccgctccccgtacagcttgcacgccagcgtcctcttatagtccttggccttggagg

SEQ ID NO: 59801 - DNA, 718 bp, Triticum aestivum
  unsure (1)..(718): unsure at all n locations
  Clone ID: PAT_TA_59801
gagagaggganggagaggcaagngagaanaacgggnaaanagtgtaaaggggnaaggaanggnatcaagaagnnnaagngnnagagnaaggcctccatcaaggggatggacccaaagttcatgaggaacctgaggtactcaaggaaanacaatgtctaggntggtgagggagaggatgagaagtaagatgaacgagtttatggtggtngatatgtttcatgtatctttaagatataatgttttgaacttattccagagttttgtatgancagagaatttgtatgatgtttattaaaaaaaaaaaaaatataaaaaaaaaaaaaaaaaaaaataaaatacccctcctcacccctctatcttccctccgccctccacccccctctcccttcccctcaccaatacctacccccacccccccccctcccccccccccccccccctcactccccttcctcccgtccccctcaccatcctcctcacaccttccctccccaccccccactatcctcccccctctcccaataccaccccccccaccacccccccctgcccccccccccttccccccttcccccgtctgccgccctccccccccccccccccccccccctcccctcccgctttccccccacccctcccctccaacccctcctcccagcctactacctcccccaccacttccccccccctctcctcccccctcccctccccactctct

SEQ ID NO: 59802 - DNA, 332 bp, Triticum aestivum
  unsure (1)..(332): unsure at all n locations
  Clone ID: PAT_TA_59802
cttttcgatattgcttccctncactacaaaattatactctctagatcttgcgcttatcgtcatcatgtctctgtcatcatcccgatcttgtnatgtgtnggaagnaggttggnatngncatcggncgtctctgngacaagtggganggaaaatgcccagtctgngattcctacgttngacctacgattcttgtgggnatttgngatgagtggagtttcggaaactaccagaanaagtgtgttgtatgtggnggtgagggtatctcggangntttttattgtttntaatggttggtgtttagaaggattgngatngttgtttttttattatta

SEQ ID NO: 59803 - DNA, 360 bp, Triticum aestivum
  unsure (1)..(360): unsure at all n locations
  Clone ID: PAT_TA_59803
gccgggcgtgtcggagtgtggtgtccgncgtggccctggngtcggtgaagttaatgatgggcttaaggaaagcgacgacactgtggtgggggcaggtgacactcttagttcgtatagtgagtgtnttacgtgnaggtgatggngccctcgattagnaaggagtggttgtccaatgtgtgggggttgaattgtttgtccccttgnagtccttaccgctttatagagttgtggtgntttggaagagtcgtgttnggattgaattttctaattatgtntaaagnttgaatggtgaatggaaattgtntgtgtttttatttttttttaatttttttgtnntttttgttntattatgttnttttt

SEQ ID NO: 59804 - DNA, 381 bp, Triticum aestivum
  unsure (1)..(381): unsure at all n locations
  Clone ID: PAT_TA_59804
cggcgctcgaggcggccggttcgggacaaactccacagcgactccaaatctctcgtggtagacagcttccatctcatctccggcgatgcctgggcgtggcaagggcggcaaggggctcggnaagggcggcgccaagcgccaccggaaggtgctccgggacaacatccagggcatcaccaagccggcgatccggaggctggccaggaggggcggtgtgaagcgcatctcggggctcatctacgaggagacccgcggtgttctctagatcttcctctagaacttcattcgcgactccgtcacctacaccagacacgcccgccgcaagaccgtcaccgnnatggacgtcgtgtacccccttaagcgccagggccgcaccctcta

SEQ ID NO: 59805 - DNA, 829 bp, Triticum aestivum
  Clone ID: PAT_TA_59805
gccggccggttcggaacaaagccgacccaatccccacctatgcatctcggaccgatcgaagccagggctctctcgtcctcctccccaagatctttgtgaacaccctcaccggcaagaccatcacccttgaggttgagtcgtcggacaccatcgacaatgtgaaggcgaagatctaggacaaggaggacatctccctggaccagcagcgcctcatctttgccggcaagcagctcgaggatggctgtacatttgctgactacaacatccagaaggagtccacccttcacctggtgctccgccttcgtggtggtatgcagatcttcgtcaagaccctgacgggcaagaccatcacactggaggtggagtcctcggacaccatcgacaacgtgaaggcaaagatccaggacaaggagggcatccccccggaccagcagcgcctcatctttgctggcaagcagcttgaggatggtggcactcttgctgactacaacatccagaaggagtccacccttcacctggtgctccgccttcgtggtggtatgcagatcttcgtcaagaccctgacaggcaagaccatcatgttggaggtggagtccttggacaccatcgacaacgtgaaggcgaagatccaggacacagagggcatccccctagaccagcagcatctcatctttgctggtaagcagcctgaggatggtcgcactctggcggactacaacatccagaaggagtctacccttcacttggtgcttgagttaattgcagggaagtataccacttgcagttgtaacggatcagtaccattatttcaattttttttacaagtcag

SEQ ID NO: 59806 - DNA, 679 bp, Triticum aestivum
  unsure (1)..(679): unsure at all n locations
  Clone ID: PAT_TA_59806
gctgcgcgaggagctgcgtgccgacgaccgccacggccgcgcgccccgcgcgcccaacatccggtggaaggagctgctcggcttcaagaaggcgaacaagaaggccgccgccgccgcagccgccgacgctgctggcgccggcacgtcgtcggccgaggcccatacggatcccggaggccaaggcggcacgagacagtgaagcagcgagctcgcgctcattcagcaagcgaaatggggacatgattaggcgagtagtctgtgagattgggtggtgatttgagcttccagctttgatgtccatcatctgcccgttgaggatcgatcggcaggcagcccaacatccaccagcgcttcattggagaagcaggcaaacacaagctgtagctctggaggccatgcatgcgctcatgtgcacttcctttttcttaaattttggtgtggtaaaaggggatttttgctctttagctagctcttgggtctggtctggtcgtcggcgggtgggtgtcaaggatggtttcgcatgtcgtagcagtagcggtcaaagtaactcctctctagtctctagcctagatgtggctctgaatgttttgtatcggaaggngccagttaaatgcactggtactagtattttttttttcaaaaaaaaaanaaaaggaaaaaaaanaaaaaaaggccccta

SEQ ID NO: 59807 - DNA, 364 bp, Triticum aestivum
  Clone ID: PAT_TA_59807
caaaccccccaaagtgcaagagaagattgttgcggcggcggatcggagtgagaagaatcaatggcttccgacggcgtggtggccctgtacggcaacaacaaggcggtggtggagccctccgccaagcctgccgccgccaccttctccgtcaaggtgggcctcgcccagatgctgcgcggcggcgtcatcatggacgtggtcaccgccgagcaggcgcgcctcgccgaggaggccggcgcctgcgccgtcctggcgctggagcgcgtgcccgctgacttccgcgcccagggccgcgcggcccgcctgtccgacgcggccctcatccgccgcctcccccgcgccgtcaccctccccccgacggcca

SEQ ID NO: 59808 - DNA, 356 bp, Triticum aestivum
  Clone ID: PAT_TA_59808
gccggccgggccgacacacagcgtgccgttctcggagatcaacaaggcgttcgacctcatggcgaagggcgagggcatccgctgcatcatccgcatggagaactaggccgcctaacgcgcttccgatcgctccgatgtaataagcgctggggtgcggtttctgaaccagatcatcgtctgtggtttcgccttccttggcaaagtagcggagtgttagttcaagtatatctgtaattacgtaccggacaagtggctgtactacgaacgagctctcttttggcagcaatatatgctgctgctgctactactatggccatgagtttcagttgaaaaaaaaaaaaaaaaaaaggccccta

SEQ ID NO: 59809 - DNA, 278 bp, Triticum aestivum
  unsure (1)..(278): unsure at all n locations
  Clone ID: PAT_TA_59809
gncggccggttcgggcaagaaaccaatatcgncctgccccttcttcttcctcgtcgacgcgcaggccccagggaaaaagaaaaacttctccgttggaggaaagtcgggtgccgtctcgcccacagnccgttggnagnaatggnacaagagagttggaaggagtntgaggagactgtccaaanacctgaggaaccaatattgagtgtaaacaactgaggattcttaggtagaagtatgacgaataanatgtgntccaagtgttaaagggaattaattaa

SEQ ID NO: 59810 - DNA, 488 bp, Triticum aestivum
  Clone ID: PAT_TA_59810
gccggccgggtttcgaatacaatccatccattgactagtgctatagctagtcgtatacgttatttgcttcataatttatcatcgctcttgctagttgctaaacttgcatatttctctctgtgtgtgtggtagtaccgtttgtaccacgtactgcttgtcatcgaactggttacggtactctatggaccatggatccagttctcagccacatatgatctcatgcgtgtaccgctggctgctattatatttccttcaaaaagaggttgctcctccacaattgtagtaaagtaattaatatcatatgtcaactgtctctgtgtgatctttagcatttgctaattgattcgattaaaattctgtgcgcctttgaaaaaaaaaaaaaaaaaaaaaaaaaaaaaaaaaaaaaaaaaaaaaaaaataaaaaaaaaaaaaaaaaaaaaaaaaataaacaaaattataaaaaaaaaaaaaaaagccccaagaggccc

SEQ ID NO: 59811 - DNA, 412 bp, Triticum aestivum
  Clone ID: PAT_TA_59811
gccggccgggtcgggaggcaatggcaaatactagcatcctccaagtcttcattgtttttatcattgcgcaagtctgcttactcatgatgatggcaacaccgatagcgcaggcagccggcaggcttatgggatacaatccagtttgctgccctagggacatctactgttgtgggtttggcggtgtgatggccaatggaactgcatcctccaccaagccttgataggtggtttcattctcctccgagctataagttgtgttgtttttcatatatgtaattgtgttactattttcaagaaatattatgtacaagctattgtgttactattttcaagaaatattatgtacaagctatttttctaataaaagtgggaggagatttttatagaaaaaaaaaaaaaaaaaaggccccta

SEQ ID NO: 59812 - DNA, 533 bp, Triticum aestivum
  Clone ID: PAT_TA_59812
gccggccggttcgggagaagaaaggcccagctgctcgttaacaaggcgaggagggcgcggtgcctggtccagatctcgtggccgccatggcggagaagttcgcggagtcagcgaacaatgtaatcatcgaagaggtgaacaagggcctgaaccctggaatgatagtcctgcttgtggttgctaccaccctgctgcttttctttgttgggaactatgcgctgtacctgtatgcgcagaagacgctccctccgaagaagaagaagccagtctccaagaagaagctcaagagggaaaagctgaagcaaggggtttctgcaccaggggagtgaagagatccatcgatttcgcgtgtcgattgctttatgctgggctcctctttacctgataaaaaatatataccagctggagctgcggtgttgagctactgtttatgtagaaaccttgtcttgagtggtacatcgtcggtattggacaccttatttaagcgaactgataaaccttagtcggaaaaaaaaaaaaaaaaaaggccccta

SEQ ID NO: 59813 - DNA, 432 bp, Triticum aestivum
  Clone ID: PAT_TA_59813
gccggccgtttcgccattgaaatctcacccccaaggtcgatccgccgccgccgtcgatcaggcgaaccagccggcgtgtcactggtaaccaagtctcccgagcgagccctccgagatcaaccccccgttcaccggacgcgaatggactacggtttcaacagggctctccagctgcccccgctgatcaggttccaccccacagacaaagagctgtggatgtactacctgtgccgaaagtgaggcgaccttgtccatagccgggactgcgatcgccgaggtcgacctgcacaatatcgagccgtggaggctgtacggagaacgtgacgctaggcgggccgtactccaaggagtggtacttcttctcgacgtgggaccgcaagtaccccaacggctcgcgaccgaaccgcgccgacgggaccggaatactggaga

SEQ ID NO: 59814 - DNA, 767 bp, Triticum aestivum
  unsure (1)..(767): unsure at all n locations
  Clone ID: PAT_TA_59814
gccggccgggttgggaacttatatttccaccgagctcaatacacaatcctcgacttattacgaacncactctttcggaagactccacataacctcttggcccaccgaatccccggctccgatccacggcattcagctccagaatcccccccaatcagcgccttgacttcttccaggtctgataaagccgtcaacaattcaaagatcatggcaacgcaactcattactctgccggccgtagaacgtctcagtcctacttgcatacgcatactgggtggcaatccaggcaaattcactctccagggcacaaacacttacctgcttggcacaggccgaagtcgacttctcatcgacacgggcgaggggcgcaaggcttggatcacttcggttcgcgaaacactgcagcgggaaaatgcaattatcgacactgcattgatcacgcactggcaccatgaccatattggtggtatcaaagatctcctcagcacctcgcctaagacgagagtctacaagcacactcccgaggagggacagctagacataaagcatggccagcgttttgaagtcgagggtgcaaccttgacagctgcatatacgccaggacacaccaaggatcatgttgtgttcgtgcttgaggaggaagatgcaatgtttactgctgacaatgtcctcggccagngcacagctgtttttgaggatctggtcatatacctacagagtcttgaagagatgaaacctctgtntcaaggccgagcgtatcccgggcat

SEQ ID NO: 59815 - DNA, 779 bp, Triticum aestivum
  Clone ID: PAT_TA_59815
ggccgctttcgaggccggcccgggtctgggaaaaaaaaaaaaaaaaaaaaaacagagtccgaagccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggttgg

SEQ ID NO: 59816 - DNA, 562 bp, Triticum aestivum
  Clone ID: PAT_TA_59816
gccggccgggccggtttctgataattgatctgctcaattatgttattgctgaataatggaactattgttgctgcaacttttattcttaaaatttcaggtcaggcatacctaaccatctctagggaccatggcctcctctgctggaatctgcccagacaattgatccacacgttatccaactatgcatgaagaaggagcttgggcctacctaattgatgaatttgcggagtacctaaacgagaatgaatgtgttcaacgtaacaacggacctgatcgaggctgccttctgacttggataccatgagatgcggtcacaaagatgattcatgcccatcaatagaatatttatctttggatgccgggattgccaccgctaccctgtcacaaaacaaatggcgtcactggacggaatctactcgcgcaagggtgatttcactggataccactcgcaactatcaatctaggttgtattttgtgatgcccctatctgctacctaataccccataaagctattggaccactgccgacatggtgcgatggcgctatagtccatgcatgccc

SEQ ID NO: 59817 - DNA, 269 bp, Triticum aestivum
  unsure (1)..(269): unsure at all n locations
  Clone ID: PAT_TA_59817
agtactgtccccagatgaccatggngatcatgatccccttcttccagcagntgaagggnatcaatttcatcatgttctacgcgncggtggtgttngagacgntggggttnaagggngacgngtcgcttatgtnggncgtnatntcgggtctggtgaacgtgttcgccaagctggtgtacgtcttcaccgtggaacgattggggaggtggaagaatgttcttgtatgtnggttcgcatatgttggtgagacagttggtggtgggtactct

SEQ ID NO: 59818 - DNA, 865 bp, Triticum aestivum
  unsure (1)..(865): unsure at all n locations
  Clone ID: PAT_TA_59818
gccggccgggtcgggaatcgaatcagtacctgctgttgcccgctctcttcttgctctcagtgaatcatctctgctctcccctccctcttttacttttttccattattctgccgcctgccacctgcctgcacccgcacctgccttgttcgtatttaacttgcgacacgttgacagaccatttcctcctcctacatctacaaaacccccctccccctccatgaattttctacgacgcttcactccgcttcgatcattctctcgaacattcacaacaacacgcgccatcatgtctaagctttacgttggaaacctgtcctggaacaccaccgatgagactctccgccagaccttcagcgagttcggcgaggtcaccgactctatcatcatgcgcgaccgtgataccggccgtgcccgtggtttcggtttcgttaccttcagcaccgaggagcaggctaccgctgctgtcgatgccctgaacgagcaggagcttgacggtcgtcgcatccgtgtcaacgtcgccaacgcccgtcctgccggcggtaacggcggcggcttcggtggtggccgaggtggcggctacggtggtggccgaggtggttacggcggcggtgaccgcagctacggtggtggtgaccgcagctacggcggtggtgaccgtggtggttactaagagacttgacttggcttttgacttcttcacttgacttccggatcaccagacgcgngttgacatgtatcgtcgaccccaacgaaaaataatgaatggatgatgggtttggccgctaaaacccagtcgcttgagattgacgtggagagggacttttcaagatacccatagacacagacgactctgacttttctcatc

SEQ ID NO: 59819 - DNA, 668 bp, Triticum aestivum
  Clone ID: PAT_TA_59819
cgctcgaggccggccgggtttcaaacactataaaggaaaccaacaacgtatcgcttccccaccaccactcccaccacttcgagcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggcattccaggtagccgggcgaacaactactaccgtgcagatggtcataacacgggcaacttccttacggaccgtccttcaaccaaggttcatgctgctcccggcggtggctcgtccctgggctacttgtttggcgggaagtgatctctgttaatgatgctgcgatgaattggcctgtatctctgttatccatgtggtgaaaactggaagtgtttggtttcagcagtttaccacctgcgtcgatgtactctgtccgtatggttcattgtgtccaggatgacctcctgcttggaagccagcttgcctaaaacctgtcccttttcaaactaatcgtcttcatcttcaaagttggtgtgtcc

SEQ ID NO: 59820 - DNA, 826 bp, Triticum aestivum
  Clone ID: PAT_TA_59820
gccggccgggtccgggctcaagccagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtgggaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcaactatatac

SEQ ID NO: 59821 - DNA, 489 bp, Triticum aestivum
  unsure (1)..(489): unsure at all n locations
  Clone ID: PAT_TA_59821
gccggccgggctcgggaacccgcactactncccctggtcatggggctcccccacctcccgacccagccccggccaccaaccaccccacgccgcccgccgccggccaccaccccgcaccgcccgctacccgcccacttcctccacaccttcttcttcgccaccggctgccgagctggccgccgcgcccaccccctactactaccttcttcccccttgagcacaagcccacccctaccgcttcctacccgtggcgagccgcgtgtcgaccaccgttccccatcttctccctcatcccttcttccttccaggcggctacatgatggcgaggtcgccagatccgctcctcctcggccgctggtgccgcgccgcacctccccaggcccccgccgagacgacccaccctatgaacatatcgtgactgtcatctgaaataattacaaagaacaaataaaccaaatatattaaaaaaataaaanaaaaaaaaaaata

SEQ ID NO: 59822 - DNA, 685 bp, Triticum aestivum
  Clone ID: PAT_TA_59822
ctgtgcggcgctcaggcggcgggttcgatacattcccctcgcccgccggcgacgcctcctcatcctcctctcggctccttctccttccttccaggttcagacatgggtatggagaagactcacatcaacatcgaggtcattgggcatgtggactctgaggaggcgaccaccactggccatctgatctacgagcttggaggtatccaccagtgcgtgatcgagaggttcgagaacgaagccgctgagatgaacaagaggaccttcgagtacgtctgggtgcttgacaagttgaaggccgagcgcgagaggggtatcaccattgatattgccctgtggaagtttgagagctccgactactactgcaccgtcgttgatgcccctgggcaccgggacttcatcaagaacatgatcaccgggacctcccaggctgactgtgctgtgatcatcatcgactccgccactggtgtttttgaggctggtatctcgaaggacggccagacccgtgagcacgccctccttgctttcactcttgcagcgaaggacatgatctgctggtgcgacgagatggatgccaccactcccaatgactcgaaggcccggtatgaggaagtcgatgaggaagtctcttcgtatctgcagagagtcggctacaaccctgagccggttcccttcgttccaatctctg

SEQ ID NO: 59823 - DNA, 598 bp, Triticum aestivum
  Clone ID: PAT_TA_59823
gccggccgggttccggactgactgggagggaaagcagactagcggagtctgcgtccacgcggcgaccaagggaggtcgacggcggcctgaggcccgcgcgtggctcctccattggcccccgtcaaggtaacagccatgaaggtcaaaattcttcagtggcatgcggtggcttcttggacatgggacgcacaggatgagacatgtggcatatgcaggatggcttttgacggctgctgccctgattgtaagttccctggtgatgattgcccaatcatttggggtgcctgcaaccatgctttccatcttcactgcatactcaagtgggtcaattctcaaacatcaatccccctttgccccatgtgtcgtagggagtggcaattcaagggctaaggacatctcaaactatgtcagtaccaggagttttcatatctcctcgtaggaaactagaatgaatgtgtaactggaatgtagttgggttatcttgtaagtgccctttcatactttctggaaatcaggatggtcggtatctttcaagtaaagctgtgagacccttgagccacagctattgtgtcaaaaaaaaaaaaaaaaaaggccccta

SEQ ID NO: 59824 - DNA, 564 bp, Triticum aestivum
  Clone ID: PAT_TA_59824
tgtgcggcgctcgggccggccgggtccggactcttgtcttcagctttttatcaatctgacatttcccactcatcaataaaaaaatgggctcttcatgtcctccagcgacgattgtcgcattacaaccaccgctcagacaacagcagcaaccgccatgcgcatcatcaatacatcccgcctttttcacagacagatttcgacgagcgccagcgactttggcagtgggatcggtggttaatcctgttacgctgggttatgtttatcaggagactgagaggaggaaaccaaagttgtgaatgatgggaccggagacaaatccgatgtcttgcgttcacgccgatgcttgatgaaatacgacacagcgaatgaaatggattgaacctgggagggtgacgaaggcggaaactacgacaatttctttttcacgattacgacagcaagagaaacgatgatggtattcggggtatcagttttttattgataaaaagaggaccttgttgcttaattataccctttttgcctgggtttcacgttcccgaaaaaaaaaaaaaaaaaaggccccta

SEQ ID NO: 59825 - DNA, 762 bp, Triticum aestivum
  Clone ID: PAT_TA_59825
gccggccgggtcgggatcaatcaaatcaatccaatcccctctccgtgatctctccgggaaattcctcgaccgattgaaagtcaaggccctctcgtcctccttcaagatgcagatcttcgtgaagaccctcaccggcaagaccatcaccctcgaggtcgagtcgtctgacactatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcatgcttcgtggaggcatgcagattttcgtcaagaccctcaccgggaagaccatcaccttggaggtggagtcctcggacaccatcgacaacgtgaaggcagagatccaggataaggagggcatccctccggaccagcagcgcctcatcttcgctggcaagcagcttgaggatggccgcaccctggctgactacaacatccataaggagtccaccctccacctggtgctcatgcttcgtggaggcatgcagatttttgtcaagacgctcaccggctagaccatcaccctggaggtggagtcctcggacaccaccgacaatgtgaaggacaagatccaggataatgacggcattcccccggaccagcagcgtctcatcttcgctggcaagcagctggaggatggccgcaccctggcagactacatcatccagaaggagtctaccct

SEQ ID NO: 59826 - DNA, 573 bp, Triticum aestivum
  unsure (1)..(573): unsure at all n locations
  Clone ID: PAT_TA_59826
gccggccgggtccggaagcagcaagaagcacacaagaagttcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgtggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactannnannaaaannaaaaaaaaaaaaaaaagaaaaaaaaaaaaaaaaaaggccccta

SEQ ID NO: 59827 - DNA, 286 bp, Triticum aestivum
  unsure (1)..(286): unsure at all n locations
  Clone ID: PAT_TA_59827
gggtcggaaacccttcgncaaatgcagatcttcgtcaagaccctcacggggaagaccatcaccctcgaggttgagagcagngataccatcgacaatgtcaagggcaagatccaggacaaggaggggatnccgncggaccagcagcggttgatcttcgccggnaagcagttggaggacggccgcacncttgccgactacaacatccagaaaggagcncaccctccatctcctcctcaggcttccgcggaggaataatccanccctccttgnagggcctttgcccccc

SEQ ID NO: 59828 - DNA, 699 bp, Triticum aestivum
  Clone ID: PAT_TA_59828
gccggccgggtcgcgaactcgctcgctctcctcttcctctctcctcgcaccaccaagctcagctctgctctgctccgcattttgctcgaaagtcacctactcacacataccatggcggcatcagtggcctgctccttcttcttcgacgccgagctgctcggcgaggccggcatgccggcgatggacgcgtgcgcgctctgcgccaagcagctggcgcgcgaccgcgacgtcttcatgtacagaggggacacgccctactgcagcgaggagtgccgccacgagcagatgcacctcgacgccgtctccgccaagcaggccgcgcggaggcagcagcggttctcggcggagacggagtcccaccgtgtgcagcggcagtccaggaaggtgtcggtcgcaagctaaccggctggccgctgaatgttttgtttggatcgacaagatctgtattctgaagaatcatcgtcgtctccgtctctccggccggtgctctagcctcgtccggtggaggcagcttggcgcggcgtacaggaggcaaggcagggcagcagcatcaggcggcaccaagcatgtgtccatggcaagctaattaggctgcccaaatgggatgaaagtgtacttgttctcggtccaaaacagaaatgtaatcgcaatggatgtgatgagagccaccaaaaaaaaaaaaaaaaaggcccctaaggg

SEQ ID NO: 59829 - DNA, 325 bp, Triticum aestivum
  Clone ID: PAT_TA_59829
gccggccgggtcgattttgaaaaacaagggcaatgaatcaggtccgacagcgggttttccaacaggccgtacaaggagctctaggaactctgaatagttgtttgaataccgagttacatttccgtacgattcgtgctaatattggcattctcgggtccctggaatggaagagataattaaattaattaggccttgaacttctactttcgtttagaatttaggcattatttttccccataaacataaaaaagaagatagaggataggctcattacttaaaaaaaagatatggaaatagctaaaaaaaaaaaaaaaaaaggccccta

SEQ ID NO: 59830 - DNA, 800 bp, Triticum aestivum
  Clone ID: PAT_TA_59830
gccggccgggccgggatctttaagtaattcatctaaatacagtcaaaatgagcggaaagactttcaacgttggtatcgtgggatatggcatgtccgccaagatcttccacatccccttcctcactcagactcctcagctcaagctacatgcaattgtccagcgatctcccaaggagggcaactcagcgcctgctgactaccccgacatcaagcactacacagactataagcagctctttgccgactccgatgtcgacctgatcatcatcagtactcctcccaacaaccactttgaactcacaaaggctgctctcgaggccggaaagcatgtcttgactgagaagccttttgttcccacctctgccgaggccgacaagctcatcgagattgccaagcagaacggcaagctcctcatcgtttaccagaaccgacgatgggactctgactttgtcaccctcaagaagctcatctctgagggtacactgggccgtatcttccagtttgacaaccactttgaccgttaccgaatggttccttccaacaactggaagttggacttgcctctctctcagggtggtagcgccctttttgatctgggaacccatcttatcgatcaggcttatgtcctgtttggcaagccccagtctgtccacggtcgtctcctatctcagcgcagcggcaagttcgactttgagaaacccgatggtgtctcagctgagctgacctaccctgatggtctcatcgtcaacatccgtattagcgttcttagtgccgagcttgagcagccctcgcttctgggt

SEQ ID NO: 59831 - DNA, 761 bp, Triticum aestivum
  Clone ID: PAT_TA_59831
gccggccgggctacgaacacactcactcactgtccctcgtttttcactcaccaccaactaagtccacagagcaagcacactagctattttctgccattgcagctcgacgtgcccacgccgcgtcgtccttggccctgctggtggtggcgctcgtgctgtctgcagcaccggcgccggccgagggtgcggttgcgaactgcggacaggtgctgatctacctggccccgtgaatcagttacgtcatgggcagggtgagtgtgcctggcgctgcctgctgcagcgccgtgcgagcccttaacgcttccgctgccacccccgccgaccgcaagaccacctgcacctgtctcaatcaccaggcgatcggcatgagcggtatcaagcccaacctcgtcgccggcatccccggcaagtgcggcgtcaacatcccctacatcatcagccaaggaaccgattgctccaaggtgcgttatgcgtgagaccgcaaccatttcaaatgcatggtgacatcgaaataaatcgaggaagccagccagtcttgctgcatggctccaccccgattgatttactgctttactaggtctactgtttcgctaatatttagttttacagctgctgcttcgatcatacggtgtggacgatgttgatgacacaacagctgtgatcttgtactcatgaagagacctcgagtcctttgatgtaatcctgaaagcatgcttatatctatatatggatgctgaattagcgaaaatcaaggttccttt

SEQ ID NO: 59832 - DNA, 853 bp, Triticum aestivum
  unsure (1)..(853): unsure at all n locations
  Clone ID: PAT_TA_59832
gccggccgggtcggacccatcccagaacctagttaccgctgtgtccccgctctctatcgccatcgctcccggccccccggcgagtcgcaactctcgcattctcacgggaagtccttccttcctcctcctcgcacgctgccgtgctcgcaccgcatcctcgcttccacgtcccctccgttccacgtgcacgctggcatctatttctctggcacaatgcccaccttctctgcccagcgtcggccgcctcggcagcagcgcgctcaggccgttcggcggaatgccgacccgggtgccttttcttggactgcgacggttgccgtcgagaacccaggttggctcgtagaacaggcctgggaagcgttctgatgcgtacttgtatacgccggaggggcgactagcgagctacgttgcaaggcccgtggtttcttggcagcgtgaatccttcgacatggtacgtactacctaaggtgccattcctctcgtgttctgctagcgactacattttgttgtgcgtgctgagttatgtacattctgaagacagtacttgtattacattatcaaattctcattccatttgttcaacgggtggaccaaccaaacgtttggtgtctagtaattcgataattcacctccaactctggtggtttctcgaaacatctgatacaaagcaaatgggggacagcacataacatctgcactttaatggacatcattttcaatgcttatctgtacttgaatggaaaccatttggaatgtagcagtgtgaatatttcagttctttgaaactgaattcagacatctgctgttttgtgattattgtaagaaagcacgtgctaattaatatctagntctc

SEQ ID NO: 59833 - DNA, 798 bp, Triticum aestivum
  Clone ID: PAT_TA_59833
gccggccgggtcgggaaaacagcctcttatcatcagtctattgcacttttacctttccactttcatcaacatcgtgatttacgtgtgcagcattaagtcacacaagatattcagaaagaggaggaaataactacgaacgtcatccgcctataatctctaagtcaattctactactacaccttcacaatggccaagcgcattaccaaggaatttgccgagatttctcaaaatccccctgagggcttctccgtgtctctgcctcccaacgaatccatccacacctggcacgtcaccttgtcggcgcccgcctcgaccgtctaccacccaggcaaattcggcatcctcctcagccttcccaccgactaccccttcaagcccccggtcgtcaagttcgtcacccgcatttaccaccccaatgtgacaaacgacaatctcggcaacatctgcctgggcctcctcaagcccgacgcctggaaacctagtaccaagctctatggcgttctggaggcacttcgcaacctcctggaagagccacaactcgacagccctcttgaagatcgcattgcacagcagtaccagaccgaccgggctgctttcgagcaagcggcgaagcaaaatgtccaaaaccatgccatggacccgcctgtttttcctcctgttgcttaggtagaaaagcagattcaggaaaggaggcgagggcaattcggattatgtaagtccgagcagcaaagatacgtatagcgcagggtccggcagtgggagtgatttgagtggtgagaccttgatgaccactgacgg

SEQ ID NO: 59834 - DNA, 240 bp, Triticum aestivum
  Clone ID: PAT_TA_59834
gccggccggtccgggtcagtgtgaagacacatgttgtagttacattcgatgaactatgggatgcataagaatggtagggatgattacctctctgtttgttgtaatgaatagcgatacagctgatttccggcaaaaaaaaaaaaaaaaaaaaaaaaaaaaaaaaaaaaaaaaaaaaaaaaaaaagaaaaaaaaaaaggcccctgggccctagggccgctgtacgaatcaataacatacccc

SEQ ID NO: 59835 - DNA, 468 bp, Triticum aestivum
  Clone ID: PAT_TA_59835
gccggccgggccgggatcaccaagcaaatcattcaccatgggtaaagttcacggatctctcgcctgtgccggcaaggtcaagtctcagactcccaaggtcgagaagcgagagaagtccaaggtccccaagggccgtgctctcaagcgcctcaagtacacccgtcgattcgtcaacgttaccctcactggtggcaagagaaagatgaaccccaaccccggctcttaaacgattggttaaaaacgacaatatgtgcggaatcgggaatgttggcttgcggaccacaacaatggttgacttcactcagtaatgggatgatggattgggtcgggtcgcatggaataggctgagcccccttgagaattaaaaaaggaaatggcaaagaagcgctacgaccctactcggcgtccggtgtcagttgtcaatgcaacaacatttgttcgcaaaaaaaaaaaaaaaaaaggccccta

SEQ ID NO: 59836 - DNA, 797 bp, Triticum aestivum
  Clone ID: PAT_TA_59836
gccggccggtccggggtacgcttttctcttataccctctcctcccctcattaccttgaatcatcccgtctcttcctctcaagctgtaccaaggtagtctctttgctcgcttctattcaaaatgctggccattcgagctctccgaactcccgcctccaggcaagccctgcgcactgctgccccccgcgctgccattttctacaaccgatgctactcaacctctggcgaccgtgttgccaagtacaacggaaccaaggatgccaagggcaacttcctggtcagcttgattgagggtgacggtatcggccccgagattgcccagtccgtcaaggacatcttcgccgccgccaagacccccattgcttgggagcctgtcgatgtcactcccatcatcaaggacggcaagaccgctatccccgatgctgccattgacaacatcaagaagaacaagattgccctcaagggtcctctcgctactcccattggcaagggccatgtctctcttaaccttaccctccgccgaaccttcaacctcttcgccaacctgcgaccttgccgctctgtcgctggctacgagactccctacgacaacgtcaacaccgtcctgatccgagagaacaccgagggtgaatactccggtattgagcacgttgttgtcgatggtgttgtccagagcatcaagctcatcacccgtgaggcttccgagcgtgtcctccgattcgccttccagcacgccgagtccattggccgcaagaaggtccgcgtcgtccacaagcccacatcatgaagctctccgac

SEQ ID NO: 59837 - DNA, 770 bp, Triticum aestivum
  unsure (1)..(770): unsure at all n locations
  Clone ID: PAT_TA_59837
gccggccgggctctgatcgagtgtctgacattgcatcttgagttttataagctttatgtatgtacgttatccccttagactagcatatacctacttcctttttttcttaatttgaattctgctaatgccttgtaagggaacaaatgttactaaattttcagtttgatatatattaactaaagaagaacctgagaacatattgaagttgtagtcttcatacatttagagtgtctacttcctagatagatcactgcatgctggcttttttttattcgatgttcaataatatttgcagctttaccaacatatcgtccttagtggaggaagtaccatgtatcctggtctgccaagtcggctggaaaaggaaattcttgatcgctacctcgacgtggttttgaagggaaacaaggatggacttaagaaattacgtctgcgtatagaggatcctccacggaggaagcatatggtctatctaggaggtgcagtacttgctggaattatgaaggatgcgccggaattctggatcacaaagcaagagtatcaggaagaaggtgttgcctgcctgaggaagtgtggacaagcataaccatatacaatatacaaccgtcccacccttgttattaccgaatgcatattattactttaattggtagaaataataggacaaatagtaattaccttgcctaaggaagttttgttgtttgtccttttttttttgaacatcagtacaaacacaagtgctcaaaaaaaaaaaaaaaaaaggcccctan

SEQ ID NO: 59838 - DNA, 658 bp, Triticum aestivum
  Clone ID: PAT_TA_59838
gccggccgggttcgaacaacaactgaaatcccaatctccatacgccacagcgcagcagcagccagatccccagcccctccatcccaatggcccgcacgaagcagacggcccgcaagtccaccggcggcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcattcacaagctccccttccagcgcctcgtccgggagatcgcccaggacttcaagaccgacctccgcttccagtcctccgccgtctccgccctgcaggaggccgccgaggcgtacctcgtcgggctcttcgaggacaccaacctgtgcgccatccacgccaagcgcgtcaccatcatgcccaaggacatccagctcgcccgccgcatccgcggggagcgcgcctaggtttggggtcgctgctgtctagtagctgttcttgtcttatgatctgaatgtgttcagagcgcttctgtttgttggtgttgatatgatgtaccgtgatgcttgaatgaaattgcaatggaaaagttcagttttatgaaaaaaaaaaaaaaaaaaggccccta

SEQ ID NO: 59839 - DNA, 600 bp, Triticum aestivum
  unsure (1)..(600): unsure at all n locations
  Clone ID: PAT_TA_59839
gccngggcgccgtactccacactactactcagtgattcctccctcgtctcgcgccgaattcacctatccagccttatcgatgccgccgacctccaggaaggacccgaaacgcctctccgcctactctgactggtatgattgacggttgctgggcgcctactttccacggcctgctgccgaaactcatgaggtcacccaactgtattgcccctggatcgcacttcactcctattccgactctggtatgatatcaactaccgccaggccgatggccctttgcatgcagctgacttgtctggatgacgaatgggaactgcaccgcattccacacttctcctccgattttcagtgaacttcttcgccatatgagatcattgtttaaaacttcaggctcaactacgataccatcccttatatttcccgacaatagaacgcgaaacgaggaagtggagtaccagctgggaaacggcaaccacgatcagatagcgcgcactgcaatcccattcgtggacacacccgatatacggaccatgcgacactacgagcctcttctccctgatcacgactctggcaagattgacgtcgccactgactagatca

SEQ ID NO: 59840 - DNA, 511 bp, Triticum aestivum
  Clone ID: PAT_TA_59840
gccggccgggtttttcctgccctcctctcgccaggagcagaactccacccgctcggaccgtgccgcgtaatctcatgttcatgagtaacccgttgtatccagatggatcttgaggagcggtgcaagacaaagtgtgtaaagccactgttgagaagacaaatgtagctgagagttgctgccgatgatactgggcacaagcactgcactgggcaatattttgactaatggtcatgcatagataattgtgtaacaccatagttctttgcacagctgaaatgacgattgtcggacgccatctttcatctgctgtcttccctgaagcattgggttcaagaaaccttgcttaaaagattaacaatattttggcaatagtcaatgtcatttattgtaactctgtagctgtagttatacattgtcatgaaccttgttataatagaaactgttttactgctttttgtatccattgaaatgtgtttgttattcaaaaaaaaaaaaaaaagacgccactagc

SEQ ID NO: 59841 - DNA, 201 bp, Triticum aestivum
  Clone ID: PAT_TA_59841
gccggccgggctcgggacccacattcaacaagcaaagcctcgatacgaggcccggttagctcaatcggtagagcgtgagactcttaaatgagtacacaaatctcaaggttgcgggttcgacccccgcatcgggctgttcctataaattcccatgggattgagtaatcgtttctttaaaaaaaaaaaaaaaaaaggccccta

SEQ ID NO: 59842 - DNA, 350 bp, Triticum aestivum
  Clone ID: PAT_TA_59842
gccggccggtcctcgaactgggacggggctcgccgcgctgggcagattgcgggtaggattgcccacactgggctccacgtattgcatgcggcccacggtgtgcacggcgtgtacggcttggcgaatgcgatcggcagttggtttacgagcggcaactagcaactaccattaataatatgtgcaacagcaagcaggcatgcatgggcgcgcggcgcccaagtattatcatctatattgtgtctttgctgaattaattgtttcacccgtgccgcccaaaaatgtaaccgtccacttatgttgtggctacttgtaccgctgtgtgccaaaaaaaaaaaaaaaaaaggccccta

SEQ ID NO: 59843 - DNA, 836 bp, Triticum aestivum
  unsure (1)..(836): unsure at all n locations
  Clone ID: PAT_TA_59843
gccggccgggtctcgacttcttccctccaaagcacccctctccctttctcctctttccctcccaagcaaatcctctgcgctcccctcgcatcctcctccttcctctgccgcttgccgtgtttggttcgggaccgaaatggcattccacgacgaggcgccgctgctgctcaggatcaacaccgccgtggctcaagccgctgctggcgaccagcttcttcgggcaatgcaagatgcacgcggacgcccacaagtgcgagtgcaacatgtactgcctcgactgcgtcaacggcgcgctctgctcccagtgcctcgcctaccaccatggccaccacgccatccagataaggaggtcctcgtaccacgacgtgatccgcgtgtcggagatccagaaggtgctggacatcaccggcgtgcagacctacatcatcaacagcgcgcgcgtcgtcttcctcaacgagcgcccgcagcccaggcccggcaagggcgtcaccaacacctgcgacgtctgcgagcgcagcctcctcgacaccttccgcttctgctccctcggatgcaagatcgtgggcacctccggcgagttccgtggccggaagaggcacgccggcggcaagaagatgaagctgaagctgaagaaggcggcggcgtcggactcagacgactcgtccaccatcaccagcggcgggagcgacaagagcagcgtggtacagaagcttctccccgtccaccccgncggncaccgccaacagctaccgctccgccaagcggcgcaagggcatcccgcaccggtcgcccttncgcagcctcatcgtggagttctagagcagaagcatcgcatc

SEQ ID NO: 59844 - DNA, 353 bp, Triticum aestivum
  Clone ID: PAT_TA_59844
gccggccgggtcctccttccctgcagaggttcttcgagaatcgcaaggaccgcctcggcgcgcgcgcgccctacgcccgccccgccgcgccggcagccaacaagggctcggaggacaagtcggcgtcgtcctcctcgtggctcgggctggccagcgccgacggcgccttcgcgctctgatccggacggacggacagacggggcaagacggcttgctcgctcgcctcaagacatcgtttgtagagcactttcaattttaatgtattctttgggtaaaaagtcgaatagcgaaagaaagaaagaaagaaacaagattgagttcatagcgaaaaaaaaaaaaaaaaaaggccccta

SEQ ID NO: 59845 - DNA, 390 bp, Triticum aestivum
  unsure (1)..(390): unsure at all n locations
  Clone ID: PAT_TA_59845
gccggccgggnctcgatcaaaagaggaaaggtttgcggtggtatacctaggcacccaaagacgaggtaggagcgtactaagtcgacgaaatgcttcgataagatgaaatcatataataatcagaatatacacaatatactcaataattataactgtatgaataaaacatgaaaaagttactataatttatgtttataatgaaccatcttattaggcataggaataaatattataaaaaattcaccggtaaatcgttaagcaaaaatgcaagtaaccaaagccgaaataacgagatattaataaagaaaaaatattatactatgtatactactaaaaaaaaaaaaaaaatggattactaaaggacaaaaaacgaggtaccaaatggagcgc

SEQ ID NO: 59846 - DNA, 631 bp, Triticum aestivum
  Clone ID: PAT_TA_59846
gccggccgggctcgggagagcacttcgccccacagcgcatacccttcctccatctctcaccactctctctctctctctctgtcaagtgtgcacggagatcatggacaatcctccggccgcggcggcggccgccgccaacaacgtggccaatcctccggcagtggcagcggcggccaacaacgtggccaatcctccggcggcggcacctgcggctgctccagcagcgaatgccgccgccgcagcgcgcgccgcgcggcacaccgcctggaagaagaaggacaagaaggttgcaatcatatctctagtcgttctggcgatcgtcctggttctgattgcggtgctgtgcctccaaccctggaaaaagtagagagcgtggcgtgctctgagtgcttctgtgggatcgagggacatgatcgtgtgcgtggttaaggagtactactacgtccaacttatatatgcagtttgttcttcgtaccatctatgtctagttcattgtggaccaagtaaaaattcagattggtgtgccgacgatgaacgtgcaacagctgcttaattagagctcactcaagtcagtactgtgctctgataatatattttttcttcggaaaaaaaaaaaaaaaaaaggccccta

SEQ ID NO: 59847 - DNA, 588 bp, Triticum aestivum
  Clone ID: PAT_TA_59847
gccggccgggccgggatacgaccagcatgttaacaccacctgcggaagtctcgactgatcgcaagattgcgtcaaatatgcgacccgggatcaggcaaattgctgacttagttatcaactttctaaaccaggtgtctatcatcaattcagagcaaagagctagcgaactacttgttgagaaggagagacttcttaattctctgaatgattggtataaagactttgaaatggcccagacagtgggagaaattatgactgtcaatcactgtttcttgaaattactccatacggttatgagagtcgtgctcttgggaacactggattatgagacagactttgatgggagactgaaagatgagaacgagagtatccaggctttgactgatgagattaatgaacggctcagggattacgatatgcgtagggggattgaaggtgggctgaggcaacagtctgaagtctgaatatttgctgcatgttgtcagcccccagagctatggcaagggctagataagtcaggttctcagcaagttaagatcagaaattaaggatttataagctaaaaaaaaaaaaaaaaaaaggccccta

SEQ ID NO: 59848 - DNA, 208 bp, Triticum aestivum
  Clone ID: PAT_TA_59848
gccggccgggctgggtgaaatgatgaaagttagccaaatcttattataacatgctcctctacatgtaagctttatctgtgcctttggtgaagatctcttctttgccaggcacaagagtagatacgtagagttgaagtttgcgttattgatgataaaatagagattgggaacttactgatcataaaaaaaaaaaaaaaaaaggccccta

SEQ ID NO: 59849 - DNA, 479 bp, Triticum aestivum
  Clone ID: PAT_TA_59849
gccggcccggtctccgccgccacgaccagcgtcatcaacatgtcgccggactccaaagaggcggagatcttcaagcagtatgcgcgtgagcacgagggcaagaacgccgccaccacttcgcccgctgccgccgccgccgccaccggtaccaccagcaggaagagcgcggacgcgacgtccggcgcagggaggcgcacggtggtcttcgccgtcgtcttctcggctctgcttgcctccgtccttgttctcgcatgatgataggctttggctgcggctgcagggaaagggaccaagacactcttaagtgtattcggccttctgttcggctttcagttcgctatgtagctgagtgaatcctcgcggtaaaaaatgttgcgcagttagtgggttgcaagtttttcttctctccctctccttctctcttgttgttgcgaatgctgagttgcctccctgaaaaaaaaaaaaaaaaaaggccccta

SEQ ID NO: 59850 - DNA, 504 bp, Triticum aestivum
  unsure (1)..(504): unsure at all n locations
  Clone ID: PAT_TA_59850
gncggncgggatgcgaaacacagggatgcatatccagtgttttcccctggagcctctatggaagactgtgtgccccttgagactatgctaggccttcttatcccatatgaggatctggcccctgctcatgacataccaggcaaccactggtgttcacgttgcggccaggtagatcatgtcaagcacccaccacttcgacagcatgttcggccacatctttctaactactgtagagcctctgctcacgtatcgaatcctgaatgctgcattaaccgagtcgcccaagcctgaagcaaactcccctgcgaaccagcgaccattcaggaatgtatcgacaaccatggatttttttgtgtctaaccgcctgcccccggtaatattgcaatgttacctgctccacgtactacaagtctaagccgatcaccctgaatacatgcatcgcaaatcaattgcctcaactcaccataaaatacccggtttaattggcaactattcccttcactg

SEQ ID NO: 59851 - DNA, 299 bp, Triticum aestivum
  Clone ID: PAT_TA_59851
gccggccgggttcggtttactggcaaaaaaggacatggagtttaagctcaacccattttcatttctcaaagtgatctgcttcattattctggagggtgcagttcttctcagtgatatacggttcacagaggcttctggtttagagtagatggatgctagtttctgtacaggcgacatctttaccttgattctttgtaacttgatgtacacatggatttccgtagtagaaatgatgcaatcaaacttaatgagtcgtcgattcggctcatatccaaaaaaaaaaaaaaaaaaggccccta

SEQ ID NO: 59852 - DNA, 259 bp, Triticum aestivum
  Clone ID: PAT_TA_59852
gccggccgggtctcgttgattttctcgattcttttactattattcatcagcattgcctggcagaaataaggacattcagcaggaaagaaaatagcctatcatttctttgatctctagtattcatatattgtagttactacttagtaagcccttcccatctcagttacttgtatcaatttttatggaaacgcacactagtgatgaaattcacgggatgagtactttagtcacacaaaaaaaaaaaaaaaaaaggccccta

SEQ ID NO: 59853 - DNA, 427 bp, Triticum aestivum
  Clone ID: PAT_TA_59853
tcttcctggcggttctccggcctccagaagaatagcgtcagcacaactgcacaagagcatcgatagcacggaagaaatggcgcccgacacgttcctcttcacgtccgagtccgagaacgagggccatacctgacaagctgtgcgaccaggtctccgacgccgccgtgaacgcctgcttggaccaggatcccgacagcaaggtagcctgcgagacctgcaccaagaccaacatggacatggtcttgggcgagatcaccaccaaggccaccgtcgactacgagaagaccgtgcgcgacacctgccgcaacatcggtttcttttttgcccaccccgcccgggatgctgaccactgcgaggtgcttgacaacatcgagcagcaatccactgacattgaccagggagttaacggacactccaccaagcgccc

SEQ ID NO: 59854 - DNA, 605 bp, Triticum aestivum
  unsure (1)..(605): unsure at all n locations
  Clone ID: PAT_TA_59854
gccnggcccgggcctgggactccactcttcatccaacaaaaacatctacaaacaactcaacaccaccaacaaacacccaaaacagccatcaaaatggtccgcctttctctcttcgctgttctcgtcactgctatcactagtgccactgctttcagcgttactcaggcttgccagtgtcttttccaagatggctcccactgctgtgttactctcaagactgaggattgccaagctgagtgcctgagttctggcaggaatggtgtcaagtgcaacgccaatggcaagtactctaacgtcagctggttcactggcgttggtcgtaccagtgcgattcttagaactaaggacttgtggaaaagagtccatggaggacgactgtcaagctgcatcagtttgagattatctgggagaccaatggattgtggaatatgacaaggataccaataagaccacatgatcgggtcatgaactttgacaggtctgcgggggagccaatggggcgtatataaacagagaatttctttcataagctgttaatagcttctactttatcaattgaccaaagtcttcttttcatccaaaaaaaaaaaaaaaaaaggccccta

SEQ ID NO: 59855 - DNA, 348 bp, Triticum aestivum
  Clone ID: PAT_TA_59855
gccggccgggttgggactgtctccttaataacctcttctttttgtctcccccgatcgtccctgacaataaattgcaattacaactatcaaggtacggatacgtagttgatttttgccttttgttagctttagcttttcacatgcccccacaagcaccctcccatcatcatatcctagacaggtatctttccgttgatagttttactctttagcttttgtgtcggttgattgatgaggggtttatgtaaccttattgattgcaactacgtgtcatgctgtactggtcccatcccccctatttaaacacagactggttctctataaaaaaaaaaaaaaaaaaggccccta

SEQ ID NO: 59856 - DNA, 462 bp, Triticum aestivum
  Clone ID: PAT_TA_59856
tcacttcgtctgcatgccgatccgtcgcgccaccacacgaatatccacctcaaaccttctcctgtcaacattctcccaagcaacctccaaaatggcctgcggatcctccaagtgcctctacgaccgaaacggtcctggcagcgccgccacttcaatcgccgaatccatcatcaagccctccgaggccacaggcaccaagaccaagtgcatcgaatgcggtgactacgaatgctgctgcatcccttgcactatcctgtaaagaggcattcttcactttacagaataacatggaattcgggagttttatacggaaatgctgtcgtttctggcggcgcatacttgaaaggactatgaagaatgaactacgatgctatggaaaggctagtcgatgtgataataaccttataaattaaatacaataacaaaaagattcaacaaaaaaaaaaaaaaaaaaggccccta

SEQ ID NO: 59857 - DNA, 391 bp, Triticum aestivum
  Clone ID: PAT_TA_59857
gccggccgggttcatctcgtaagccagtggttggtgactttgttgaggtaaaaattctcaggtcgtcgacagcatcgttatttggagagccaattgcacgcacaagcttgggcatgtattgcaagaatcatgcatctgaagcacatgctggtgcataaggagtagtcgagttcatgggagtccacatgaagtgaatcagttaagtctgtgtaatgtttgacttgaaatgactacaattgggagcataccatgcaatttaagttggtgttgacatgttttcatgatgagatattggttgtctagttttgggtgggaaggtagcatggtgttatgcttggagcagatgaaatacaaagattttttcgaaaaaaaaaaaaaaaaaaggccccta

SEQ ID NO: 59858 - DNA, 780 bp, Triticum aestivum
  Clone ID: PAT_TA_59858
gccggccgggcttcggagatgttaagccagctgaggatgatgctgcttcaggaccagtagcgctcagacaactcggtcgatgcccagcactgctgaggctgatgaccctcctccggggacgtcggaggaggtggatactgaggatgctctctctgtctgagttcggagggggagaatactgaggaagtaccccctcctgtgagcacgccaactgacaactcagctgctgctcccagagagccggttattgctcctgctcctgttgtggtatccgaaaccaaatcagatgctgccgcatacacacagccgacctggcgcggccaccaatgagtcgccgcccggcggcaagaatgggccattgtcgcctggcgcctcgactgtgacgtgtacctgaagcagttgccgcctcctccgctccgtctgtgtcctatgatcattccacattcctattgtaatcaatcaccctctggaatccatgataatttatccagacggacgtgactgtatgatgataaccgaaatagtaagctctgcatgtatgtacattctggatcgtcggtgttcgtcaccgtgcccggagcgacatacatgtgccccaccccaccccaccatatcgactgccctgtctaacttgttaatgtcaagaacatatataccgcccgtctgtgtatgccgtgtctgtttatcatgtacccgcggtgtatcgtgatgttagacctgagaaccctctgcacgtatgctgagtatctccaatgagtaatgctggacggtctctgtgct

SEQ ID NO: 59859 - DNA, 754 bp, Triticum aestivum
  Clone ID: PAT_TA_59859
gccggccgggctgcgcatcactcgaacctcaacgacagcctccatcagcttaccagccgccataatgtcgtcccaagtggccaaagccgccagcaacgtggtcagcatcgccaagaagcaaaccgtccagtcgactggtatctgggagaccttccgccgcttcctggccatcgaccccgagcgctccaacggtgtccctctgaaccctcacttccgcaaccctccccccggcgccaacgaccctctccagtacgaagaccccgttacgctgcccgctggcgacatcgccgacaacccctactggaagcgcgacaaccgccgtaactacccccagctcagcgtcgtcaaccagtcccagttcgcccagctcctcaccatcggcagcgctgaggcccccaaggtcgatctcatcggcgaggccggcgagaagcagctcgttgctgtgaagcaggagtccgagactggtctggccaaggctcttgagaaggcgagcaacgcgaccaaggatgtgtttgtcaacggcatgcctcctctgcccagtggccagactctgaacaccggaaagtgggatgtgcacaagtatgagcttgaggagtcatcttatggtgaaggatacccttgcagatcattcaaataaattagaagcgaaggaagatgttgtgtatacaaattatgaggtagtgagggtatagaatttccattgacaatgcagatgactttctttttttcaaaaaaaaaaaaaaaaaggccccta

SEQ ID NO: 59860 - DNA, 605 bp, Triticum aestivum
  Clone ID: PAT_TA_59860
gccggccgggtcggaagaaggccaggccgccggtttctactatgctgaccctgccattcgtcccaacaagccttaccgtcagttcaacacatggatgggtgaccctgctcgcgctatcctcttcaaggccatcgttgatgagatcaacaagaacgatctcgtcaaccacaccgcaaaggttggtgaccagcttttcaaggaccttgagggtcttagcaagaagtacccaggccagattgagaaccttcgtggtaagggccagggaacctttattgcttttgacagccccaagcgtgataagttcctggctgaggccaagactttgggtgtgaacattggtggtagcggcgctgacgccgtccgtctacgacctatgctcatcttccagcagaagcatgctgacattcttctcgacgcagttgagaagattgtcaagcagtaaaagagaaagccaatggaggagaggaggatataaaaatgaccatccaagatggcggagttagggattgattcaaggcatcaaatcaaacgtgtatttagcgaagattgatatgattcatttatttataattttcacccaaaaaaaaaaaaaaaaaaggccccta

SEQ ID NO: 59861 - DNA, 466 bp, Triticum aestivum
  unsure (1)..(466): unsure at all n locations
  Clone ID: PAT_TA_59861
caagaggaaggnggaganggagcgggaagaggagggggcagcggaccaggcgaggancgagaccaccaagccaccgacggaccaagaggaaacncggacggggacgagccggacggcaaccacacgcaggacgacgccancggcagcgacggcagggncaggccgcggaaagagcgccgcgaacaggccaacaacgcncgcnggccnacacngggcgggggccaaancccaaccacgacggcgcccacgcacagggggcccgagaagcngacgaggagcttcgccaanccgaccccaccgaggaccaaccaggganacgaacnncaacaancgaaagagngcnaagnngaaccgggggacacagnanaggcgggacngaaccgccaacccagaggccaaagcngcgcaccgangaagcaacggcaggccgngagaccgacaaaaaaaaaaaaaaaaaaggccccca

SEQ ID NO: 59862 - DNA, 810 bp, Triticum aestivum
  unsure (1)..(810): unsure at all n locations
  Clone ID: PAT_TA_59862
gccggccgggccgggagaaaaaaaagtccaacactttgcgaacgtcttgaatagcaaacttcacaatgggacgccctaagagaaatgtacttgcggccgctgaggctgccctgacaccgcctgacgctctcgagcccaaccagtcccttgttcgtgttgtcaagcccgagggaaacaacctatacacctgcgagctcccaaataccaaaaccctgatgttggaattggcacagcgatttcgaaacaccatctggatcaagcgcggcggcttcgttctggccgagatataccaagatagcaaagaggacacacgagcagatggagagattgtgaatgttgtccgagacgagaaggcttggcgcaaacagtcctactggcccaaagaatttgtcaagaagagtacatatgacctcggcgactccgaagaagaatccaacgtcggcaaaatgcccccaagtgactccgaagatgagtgaggttaccctttagatccacatctatttgttcttggcctcgattttcctagcctgagaagggggaacagcaagcctggctgtcccgcgatacgccaacacaaccgtcgcaagcatcgcacccacagtgacgcgagagctgaggtcggtgcttgggaaaacgttccaggcccactcctgcgcagcccagataagcagcacaatgaagggatcttctgtggctcgccagatgagatagggtgatgcccacgcgagataggcatagaattgntaantggagcgatctcgcaaataggagggccatgacgttggcagagagcatcgttgtcatgacata

SEQ ID NO: 59863 - DNA, 613 bp, Triticum aestivum
  Clone ID: PAT_TA_59863
gccggccgggttcccggcatcagaatacatactggctcgcacttagacgacacaagtacgtctgcagctgcagcgtattcttatttacctgcttcccagtcgaaagagagaaagaatggcggccaggctcagagcgggagcaccggcgggcgctctcctcctggtggcgtgcctgtttctcgcgacggcggcggccgtgagtggcgccaggccgctagcggtgcgggaggaagggggcactgcgcgtgcggtgacggtggaatcgccggcgggcgatgctatccggacggtggtgagggccgtcgagcgcaggctaatgttcgacgtcggcatgctccgcgggatcaaggactccgggcccagccccggtgccgggcattaagcgccggacatgccatgccatgccacggctgccattagaactcgggaggaggcgtaggatgattcaaggtttcatgattgtttctttagttctttattcatgtatacgtagacgagtaacggagtaagtaccatagtttagtgtgtatatagtttagtgtgtatatctgtctgattttgcggtacaatttaaagcatttttttgtaaaaaaaaaaaaaaaaaaggccccta

SEQ ID NO: 59864 - DNA, 337 bp, Triticum aestivum
  Clone ID: PAT_TA_59864
gccggccgggctgcgattttgccagctcaatgtgtgttcattttcgtttgaaaactatatgtatgatgataagtccaaattttagtctaacctgcggctgcttggtttctctaaaatgggagcagcagtcaatctcttgtagccttacagatggaagggcattgctgtgtcgtgaacctgagtcaccgggtaggtactcgattactctgccttaacaatgccctggtaaaagttgtattcggttgaaagaaaaagattgtttggatatactctgtcatggccaaaaaaaaaaaaaaaaaaaaaaaaaaaagaaaaaaaaaaaaaaaaaaggccccta

SEQ ID NO: 59865 - DNA, 473 bp, Triticum aestivum
  Clone ID: PAT_TA_59865
gccggccgggctgcgatcgtcgacgtcgtgcttggcggctacctcggctggttcggcgcgatcgacaagatcatcgggcgccggctgatcgacccggcgaggacgccgctgctggccaggtgggaggagcggttccgcgcggcggacgcggccaagggcgtcgtgccggacgacgccgacaagatgctcgagttcttgcccaccgtgctcgcttggatcgccggcaaagcgaagtgaactgtgtctgtgaggccgtgacatcgccagctcgtgacatgtgtgtttgtgtgtgcctgagtccgtccagtgtgtgctgaataaatgcaccgcatgtcgtgtgttgtaccaagggcaaacaatgctgaataattttgctgtttgttgattccccaggaaaaaaaaaaaaaaaaaaaaaaaaaaaaaaaaaaaaaaaaaaaaaaaaaaaggaaaaaaaaaaaaaaaaaaggccccta

SEQ ID NO: 59866 - DNA, 350 bp, Triticum aestivum
  Clone ID: PAT_TA_59866
gccggccgggttaccgtaatgtgtgtgatgctccagctccttgcaagcactggggcaaagggctctgtcaagcaggtctcctggtagtatactgtgctggtgatgttttttcgttgctgggatcatttgaacctggatgtcatgtgttatgtgatctgagccatatggcatattgtaaaaaaaattatgtatgatgttttttcgttgctgagatcatgtgaagatgtacttttgaaatgctgctttgacaacaaacttgtattcatgtgtaaaaaaaaaaaaaaaaaaaaaaaaaaaaaaaaaaaaaaaaaaaaaaaaaaaattaaaaaaaaaaaaaaaaaaggccccta

SEQ ID NO: 59867 - DNA, 798 bp, Triticum aestivum
  Clone ID: PAT_TA_59867
gccggcccgggctacgactcctatggccctacctccacctttcggagtaggagtaccctttcaaaggaaaccttcctttccattcgaggttgacgggcgctcccgttactcaatttactccttcacggctaaacttacaatgtattctttcatagagtgcatcgctggagctctgtttgtccttggctgcgttgttgttacccttgtcgtcattggcgtgcgtgcactcctttacaactttaggaatcgccctgctcctccgctgtcctctcagcttggccaaaatgcacctcacgtcaccattattcgacccgtcaagggcttagaacccagactctatgacagtatcgctgcatcctttcgacaggactacccacaggacaaggtctcgatccgactctgtctcgaagatgataccgatcccgcgtaccctgttcttcagaaggtcattgaagatttccccacgatcgatgcgcgtattatgcttgagaaagaagaccatgtactaagcgaaactgtcaacatgggacccaatcccaagatccgtaacctaagccgagcgtaccgagaggccaaaggtgacattgtatggattattgactgcaacatctggatggcgaagggagttttgggacgcatggtcgacaagcttatggggtacagagtcggcggcgctgcaaaaccctacaaatttgtccaccagctccctattgttgtggacttgatggacttttccacgtcactcgctgcagaaggtcggtctctcttggatgcttcaccccgagaagacaccctact

SEQ ID NO: 59868 - DNA, 264 bp, Triticum aestivum
  Clone ID: PAT_TA_59868
gccggccgggccgggcttctatttcgcaattgcggcggcggcggcagggatggcaccggaggaatgacccaattgcgatggctacttctctcgagcgtggtgtacttccctttcccgcgaaccggaggcgacgtgggcggtgcaacgatcggggcgagctcggcggcgccagcggccttctatggcatccgtctccaccctcggcgtcttatcgcttgggaaggggaagaaactagggaaaaaaaaaaaaaaaaaaggccccta

SEQ ID NO: 59869 - DNA, 379 bp, Triticum aestivum
  Clone ID: PAT_TA_59869
gccggccgggctgggtgtcctctctttcgaggcctctcaccaggtccaaagtctcggcaagcccaacgacatggtcgagcgtatcaagaagaccgacttcttcaagcccatctgggctgacctcgacgacatgatgaagcctgagctgtacattggccgcagtgcccagcttgttgacaagttctgcggacctggtggtaagttggagaagaagcttcagccttaccaggaggtcatccagaaggccaaagctgctgagttgaatgtttaaagagcaaaaaggtgaaaattatacgtaaatggcgattttagattgttttagagtaaggataatatgtaaaagtatttttcggaaaaaaaaaaaaaaaaaaggccccta

SEQ ID NO: 59870 - DNA, 185 bp, Triticum aestivum
  Clone ID: PAT_TA_59870
gccggccgggtcatcctcatccacgtgtgcaaaagccatccttacctagtgaaaacttgaccagtcttgctggagtggtggagaaagaacatagaagactccttgcgaggaaatcaattattgaaaaacgtaaagaagaccatgaacgtcaaatattggaaaaaaaaaaaaaaaaaaggccccta

SEQ ID NO: 59871 - DNA, 823 bp, Triticum aestivum
  unsure (1)..(823): unsure at all n locations
  Clone ID: PAT_TA_59871
gccggccggttcctgaaccacaatccaatcttttatcaagaacaaattaaccacccctcaccctttacccacaaacaatcgtctaatctttggtctctgcctccacattgctcccaaatccaacttcttgggccctgtcgcccctcaaatccaccctttttcgtcactccatcctgtcctaaattcccctcctcacccaaaagccccagcgtttcccactgcatcatcctctgcgaaatccaatcttggccgcttggattgcccattcatttattctctgagggaatccagcctttctgctccaattctctgcaggaacccaagctttagcgggctgctctgttcgaaacccgatctctctttagcaccgaattctgcaagaaagccagagttattgcggagatccgccattcctggttgagccgacgagctccgccgccgcggtccgatgtcggactcggaccagagcaccgtcgtcttcgggctccacctgtgggagctcgtgngcatcggcgtcggcgccgccttcgtgctcctccttgtcctcctctccctcctgtgccttctcgccaaccgccgtcgcgncccnntccccgggggcccccggccgcccccgtcctccacctcgccaccgtcgcgcccagtacccatccccagaaccccaccaagccgcccaaggacatccaagaggtgccctctcggcggcgcgaagggcccccgcggggggcaccgcgcccaaggtgccgctcgctcagaattctcaggcgtccccgcaagaagtcatccagatcgagaccggcaaggagcaccgcatcacgttccc

SEQ ID NO: 59872 - DNA, 243 bp, Triticum aestivum
  Clone ID: PAT_TA_59872
gtgcggccgcttcgaggccccggccgggcctgcgaaaaaaaaaaaaaaaaaaaaaaaaaaaaaaaaaaaaaaaaaagctaatgcgaaagcctgagacttgaaagtgttattgcttcccttgtgataccctaataataaatgcatttggcgacttaagcacttatgcgccgctgaggtgtgatgctttgcttcatgattctgtttcctagttcgttgcaaaaaaaaaaaaaaaaaaggccccta

SEQ ID NO: 59873 - DNA, 820 bp, Triticum aestivum
  Clone ID: PAT_TA_59873
gccggccgggcctgcgaaagctcagagcattccgatccagcaccgccgccgcaaacaccacacctcgagagccctcttcgccggtgaagtagcaagcaagatggctggaaggaagggaggcgacaggaagaaggcggtgacccgctccgtcaaggccgggctccagttccccgtcggccgcatcgggcgctacctcaagaagggccgctacgcgcagcgcgtcggctccggcgcccccgtctacctcgccgccgtcctcgagtacctcgccgccgaggtacgcactgatgtttcccgtcctttcttgtgcactcctgttctttccgtgctcgacggataactgacagatttcgtttctgaatctcaggtcctggagcttgccggcaacgctgccaaggacaacaagaagacccgcatcatcccgcgccaccttctgctcgccgtccgcaacgaccaggagctcggcaggctgctcgccggcgtcaccatcgcgcacggtggcgtgatccccaacatcaactccgtgctgctccccaagaagtcccccgccgctgcagagaaggaggccaagtcgcccaagaagaagaccaccaccaagtcccccaagaagaaggtcgccgccaaggagtagccgcccctagcttagctgactcttagttccatatcagggagaagatgaggagacttttggttgattggatcctgtatgtaaatgctagtctgtagtggctcattcattagttcgatgaacaagccagtcaggactgtattttacatggtgattagtatgcgtggaatggctaaagatgtgacccgttcg

SEQ ID NO: 59874 - DNA, 437 bp, Triticum aestivum
  Clone ID: PAT_TA_59874
gccggccgggcctgaaacctctttcccttgaactcaacaactcattccttcaaaatggctatcactagtgctattaacgacctcttcgcctccatctacgagcttctcgcttcggtcttcaacaccgtctacgctatcattcactctatcctttcggcggttctgggctttgttcaggggcttttcaaccttattggtgatgtcgtctctggtcttgtggacgtcactggtggtgttggcaaatttgtagccagcaatgctgctattctggccgtcggtgcactgggtgcttttgcgtatgtgagatatactgcgcagggaaaacaggttgcgaacaagaagacccagtagatacctttcgctgtttgatgggtaatgcagacctaggttaattgagaattaattacatctaaaaaaaaaaaaaaaaaaggccccta

SEQ ID NO: 59875 - DNA, 574 bp, Triticum aestivum
  Clone ID: PAT_TA_59875
gtgcggcgctcgaggccggccgggcttcatcacgcctttccccaccttccgtctttcccccgtcgtcgcggctccagctagggttcctcgcccccggcctcccgcctcaccgccggccccgtccgccatgtcgaagcaaggacctaagggcaagccgctcaagcagggcaaggtcgccgagaaggactacgacgagaatcgagctggcctacctcccgaagaagaaagatgtgaacaaaaggcctgaaggagctgaaggcccaggcaagccacaagggtgcgctgggatgatccgggctccagaacagtgggaagaaatgagtctgcccacccattcgtaatacccggaaaatgccaatctgtctatctacctatctgtggcgcgcctcactcactgtggttgtgacagactaccttccgatgcggtgagcattgggcatcctcgcacgacatctctgaaacctatgggatggcagcagcctcttctgcctatctgggataccgatgggtcgcgaactaataatgacctgacttgtgttgtgatgaaaaaaaaaaaaaaaaaaaaaggccccta

SEQ ID NO: 59876 - DNA, 365 bp, Triticum aestivum
  Clone ID: PAT_TA_59876
gccgtgtgcgtctttcttctcctcctctcctcccttttctctccccgcacgagcagcgcgcggcggcgctgcctgtgccggatctcgccggccccgtgggagaggaagaggttggcagcgacccatggcttgctgcagcgtttccaggcagcgccatggcgtgcggcggcgacctagtatggagatggccggcggaatcgaggcggggatggccggcgggattgacttgccggatatagggactcgattgctttttttcaaaagattacagggacccgattgtgtttttgaaacatttacagggacccaattgcttttaaatgaggaagagacattgtcaaaaaaaaaaaaaaaaaaggccccta

SEQ ID NO: 59877 - DNA, 394 bp, Triticum aestivum
  Clone ID: PAT_TA_59877
gccggccgggcttcgaattgcccctaaatacgctggatccctacacggaatgacgaacggcattgggacagtggcagccatagttagcacagtaggagcaggatacttcgtccagtggctgggatccttccaggccttcctcaccctaactgcggtgctctatttcagtgccaccgtcttctacaacatctatgcgacaggagacctggtttttgactgagctgaaaaatactgttaacgtcaaatgtacaattatagcttgtaaaatgtctgtctgcgcccaccgcgcagagcaaagaaacaaataaaatgatgattgattggttggctcattcatataagactgagcgcaaccatgatggctttgcaaaaaaaaaaaaaaaaaaggccccta

SEQ ID NO: 59878 - DNA, 340 bp, Triticum aestivum
  Clone ID: PAT_TA_59878
tttccggggtttctgcaggaatttcatatccaggttatccattacgtccaccctcagggggggcccgggaacccattccgcccatagtgaggcggattaaccgcggttcatgggcggccgttttacaaggcgggactgggaaaaacctggcggttccccaattaaacgccttggaacacattcccctttccgcaggtggcggaaataaccgagagggccccaacgaaccgcctcttcccaccggtgtgcacactggatagggcaatggaaattgtgaaagcgtaatatatttgtgataaatattcggcgttaaatatttgtgtataactcagtctctatt

SEQ ID NO: 59879 - DNA, 417 bp, Triticum aestivum
  unsure (1)..(417): unsure at all n locations
  Clone ID: PAT_TA_59879
gccggccgggttttccaaaaacacgtactgccgggaaaattttgcatccgactttctgtattcttgagaagttctactgtcttaccggcaacacgtgcatgtcgtcggatatgcctcttttttgtttatttttgtctatcattgtgggatcagcagttagcatttcttttgtatcttgtccaatatttgttgaactgtgattgtattgggattggagacaatgaacatgtataaaatcagtagaaacattttagatgactagtgttgaactgttctattcatgatctaaagtcacctggaacaggaaatgggacttagatttgactgcnaaaaaaaaaaaaaaaaaaaaaaaaaaaaaaaaaaaaaaaaaaaaaaaaaaaaaaaaaaaaggaaaaaaaaaaaaaaaaaaggccccta

SEQ ID NO: 59880 - DNA, 461 bp, Triticum aestivum
  Clone ID: PAT_TA_59880
gagagctcataccatcccatcgtctgctctcttctgcctagctagagttccgggctgagactaagaagatgtcgagatggggaggggaaggattgagatcatccgcctccagaaccttgtcgtgctgttcatgacttcctccttgatggcggctccactcgttcgcctggcttcttgatgactgtcgcttccgctgctcccttgcttgctactactccgtctgctgttgctgcagcccctgcgttctcgttcctacttgcccacgtccggcaaggcccttcggcattttttgtataccctcgtacagagttctttttttttcaccgttgcacctcgacgccgccattatcctctccgtcatctagccccgcgagtcgtcctccggtcccctcgggggacggacgctgtcgtcttccatcactctcctgaagcgtttttcccctcattcgccacattccccc

SEQ ID NO: 59881 - DNA, 844 bp, Triticum aestivum
  unsure (1)..(844): unsure at all n locations
  Clone ID: PAT_TA_59881
gccggccgggctggcaacaccccgctggcatctcggagctcatgtcggcttcggaatctactgtatgctatgctcctctcggtcccggccaagagtttcccttcaccgttctgctccgaacacccgctcgccctggtaaggtcatctcttactggcgcctgacaacccccactggtgagaagttcggccaccgactctggtgcgacgtcaacgtccgtgttgtcaaggaggaatctaaggctaagcccgagcctgaggttaaggaggaggaaatcacacatgtcgaggagactaagcaagaggatgagagccaagcctccagccagatgatcttccccaagctggacaaggagtcacctatggccagcattcacgaggctgctgttcctgtgcctgttgaggagcccaagcggtccgttaacatcgatgacgagtgggactactctgaggagggtttcatgacggacgaggagtacgatattctggatgcttcggacgaagagtatctggaggagcaaaagaagagacttgccaccaagtaggcgcgaaattgatttaatgggaacggatctggggttacggatgttatgtttgttttttcgtgtcggtcaagctttttgttgatttcccctctttactctgtactatttctcctttcttcttttcatccgtcgtcgacaacgacaaaatctacgggaaaaaacccatgncagtatggcttgggatagaattgcagccagtcatgcacgaatctgctgccattcgaaaatggtccgtagagacccacgctctttttgtagccagtattcagcaaggaaggaaacatgggacttgatattttagc

SEQ ID NO: 59882 - DNA, 749 bp, Triticum aestivum
  Clone ID: PAT_TA_59882
gccggccgggccaggattaggatggaactcgaggcattttgtggactagtatctatagttttttgatgcctataaagcagaggtttgtgtgacaaaacagaagtatccatgaattactactttataagatttaggttccactataatgttgttgatgatagccaagccgagaaagaaggatcccgatctctgccgtggtcgacaaacagcgcgatgggcggagcacccagcccgtaggctcatccccttctccgatccactccggcggcgaccatcgttgtcaaggcatcggttcatgtggtttcctgctactggcatatcaaagagatgcagacgagaggaagagagcctcccccaagctatgtctaggcgatgcacaggcgacggccacccttcctgttattgcctctatggctggctgttcatccccaggaacctcctcccctctcacgtgcgtgattaagttggaacacaggtatctagggcagggcgtggtcacattgcaggaagcaaggagcagcgcaaagttgtctcggccgtgccctgcatcgaggaggaacacatgtatttacaaatcgaggaagaaaacatgtagttttctgtatttttctgtttgttattttgtaactttatgcttcacctgtcctgaattatacctatactcatgttgtcagatacataggtatacagatacatagctatggaagatacgatttactgatacaaaaaaaaaaaaaaaaaggccccta

SEQ ID NO: 59883 - DNA, 379 bp, Triticum aestivum
  Clone ID: PAT_TA_59883
gccggccgggccgggtggcctaatcaaattagtattacttaccctaaaactttctcaaaaaaaaaaacttaccctaaaaaaatttaaataaattttactatggagaagataaatttccatttttctctatgatatactatatgtgggaggaaataataattattcatatatacttttcaattgccaaatgcaccgccgaaagtactatatcatactgtttacattagagtcatgagttattgtattgtactactgtattttcataagttgtttgttcacattgtgaaaaatggaaacagggaggttgaaagttgtattcgtgtatgtattttcataagttggtttatcacgtcaaaaaaaaaaaaaaaaaaggccccta

SEQ ID NO: 59884 - DNA, 833 bp, Triticum aestivum
  unsure (1)..(833): unsure at all n locations
  Clone ID: PAT_TA_59884
gccggccgggccgggaaaccccaaacaatacttctcgaagcacgtctcttgcatcttgatcccataaatctttgcgagatatctatcggataaattcaaaaatgcctgcgccaacagcactgaagcaggccgagagtgccccgctcgccaacgatatttcgctcccagttgagggtgccgatgaagagtttctgttagatgcgcctggcgctgaggatgccgatgcgaatgtcctcgtgcccgtcgaggatagcaacgatatgcaaatcgacgaggaaggacgacctcgatttgcgcccgccagggacattgatcccgtcaccagggtcgagacacgcaagattcctatccctcctcaccgaatgacacctctaaaacagtcatggacatccatttatccaccattggttgagcacctcaagttgcaatgccgaatgaacatcaagcgcaagacggtcgagttgaggtcatcaaagcacactaccgagtccggagcgctgcagaagggagaggactttgtcaaggccttcaccctgggctttgatgtggacgacgctatcgccctactacgactagacgacctttacattcagagcttcgagatcaaggatgtgcgaacgatgcatggcgacagccaagcccgtgctattggacgaattgctggaaaggaggnaaagacgaagttcgctatcgagaacgctagcagaacacgtatcgttctggccgatagcaagattcatanttctgggtggattcaaaaacattcaccttgctcgagagtcagtcgtgagcctcattctcggaaagcacccnnggcagtgtatggcaacctt

SEQ ID NO: 59885 - DNA, 272 bp, Triticum aestivum
  Clone ID: PAT_TA_59885
gccggccggtccggtcgttgacaagtaaaaaaaaaaactgtgctctctgaagccaaaattgctgtagccaattttgtcgctatagttttggggtgggtcaaggaatgatcgcatcattgaataatttgagatttgacagcacgcttgctcgaacttatcatgtgtaacattgagaaaggtggattttacttgcaaaaaaaaaaaaaaaaaaaaaaaaaataaaaaaaaaaaaaaaaaaggcccctaaggccaagaacgaatacaaaaactcc

SEQ ID NO: 59886 - DNA, 860 bp, Triticum aestivum
  unsure (1)..(860): unsure at all n locations
  Clone ID: PAT_TA_59886
gtgcggcgctcgaggcggccgggtcaaagaacaactttggaacaatcaacgagcaacatctcattttgacagtgattcgcaggttcttctagtcagctcttcggttgatggtagtcttcctaataccggtcagcttgatagggagtgtgacattgacaatgggatgataggggtaccaagtgataggacaaattacagtggtgatgcgtctggagaggttgctgacggggggctttctgtctcttccgcccctcaaagggagaatgtaatcctgccaagattgggtgatatctgcatggaagggccatctgttcggcggcaaacagctgacaggggattccccagaataatatcgtcgtcatccatggatgcccggggtgatttctctgccatcgagaatcaggtacgcgagctaatcaatgatttgggaagcgattccatagaaggtcagagatcagcaacatcagagattcgccttctagctaaacacaacatggagaacaggattgtcattgctaattgtggggctataaacttgctggttggccttcttcattcaccagatgccaaagtccaggaaaatgcagtgacggccctcctcaatttgtcactcagtgatattaataagattgccatcgtgaatgcagatgctgttgatccactcgtccatgtcctggaaacagggaaccctgaagctaaagagaactcagcagctactttgttcagtctctcatttattgaagataacagagcgaggattggacnatctggcgccgtaaagcctctcgtgnacttgctagngaatgggagccccacgagaagaagatgcggntactgcattgttaaattatcatacttat

SEQ ID NO: 59887 - DNA, 758 bp, Triticum aestivum
  Clone ID: PAT_TA_59887
gccggcctggcccgactgtcctatcctgtcctgtcctacttgttctcctaagtttcttggtgattcactagcaaacaaagaccattcattgttcacgcacacgcttcacttacactaccacatatacgctctctcttcctcacttccgcccttcagcaccaacgactctttacctcaagagtattctttcaccagaaaaacctccaccgatcaactcttcatcatgcgcttctttactgccgccgctctcctcctcagcagtgtcgcactcgcagcgcctgctcaagaacaaacaaaagactgctgctgctgcgacatctcccaacctgccattgtctgccaaaagaatgtcaagcccgaagactgcatctgcgccgccgtcatgtgcccagtcaacgctcccacctactggcctgccaccgctaccgccacttctacgccaactccgacagccaccgtcgtcaagcgacaggaagacaagaagcccgccacgactgatcctgccaaaacgccctgctgttgctgtagcgtggctgaccaagctatcgtctgcgaagtgcgccctgagggtgctgataacacatgcgtgtgtcctaaggtcatgtgccctgttggtgcgccgactttaacgaagaacgtgggtgcgcagaagactggaaactaaattatacccaagttgttgaaaggggagactgcgacgagggattattatagttgcgctttgacagctttgcacgtttgctattaatctttactta

SEQ ID NO: 59888 - DNA, 421 bp, Triticum aestivum
  Clone ID: PAT_TA_59888
gtgcggcgctcgaggcggccggtcggggaggactcgatttgggttggaggaggtcgcttccgtccgcccgcaagggagggtgggaaaccccgaaagctatccatccccagcccaaatccgtgcggggttggtgaaccggccgaattgggggcgagacacgtcgatcccacccaggagcccccgtctctcgccggaatttccaagggagccgccgccttcccgccgcacgggtcggagattgggtgcgcgcgatcggtgggaaggcaggccgcgggcttcgtgcgcgactgggcgccgagagattgaggatttggtgcctgggctacgactccgtgccgtttggtggcgtggtagaaccgcagatttttaatctgaaggggcgcgaggcagaaaagaaaaaaaaaaaaaaaaaaggccccta

SEQ ID NO: 59889 - DNA, 762 bp, Triticum aestivum
  Clone ID: PAT_TA_59889
gccggccgggtcgggatctatttattcttcttctattatctgcatccagatgtctacaggatgggcagcgttttacgtttaatcttggatcttggcttttgattgagcattttggtggacgttctgtaccgcaccgaatctgtatccttatgcttctattcttgggttaagcacgcctgttggcttcattgcagaaacttgatacctcaaaagtgttgatggtgggaggatccatcccgcagcgattcggtgctctattatcagctgctcaggtcatgggcgcttacgcaaaacaactcttttaccggaaatcatgtatgccctcgcggggctcgtgttggatttagttggagcaatggaaagacgccaattgtgttttagggatacgaggtttcatctttgggcggctatcgaccgagtcgtctcaatctgacgcatggccgaaggctacccagcacggtgactaccttgccccctaagactaccctggcaggattacgactacaacttgattatgttggtctacatcttccttttcgctatgactggatttatgtgcatcctcgaacggagctgcgtgagagatggttacggatgtggctttttgtattgcattgttgagcatgtcgtaagaggaggaaatcaagacatggctggaaggattatacaagctttgttatcaaaacgatagattgtacgggcaaatgaggttcgcgcctctatctgttgccctacagataataatcttatgttacaaccaga

SEQ ID NO: 59890 - DNA, 318 bp, Triticum aestivum
  unsure (1)..(318): unsure at all n locations
  Clone ID: PAT_TA_59890
gactctctcntccccgacaaccccagctgcatccatggcgaagccgcggcttcttctcttcctgctggtcgccgccaccgcgctcctgctcgtcgcctccgccaagaagtccgaggacaagtcgacgcacgagatcggggtcaaggaatgcgtctatgaggtcggtgaagctatgatctgagatacacgaagtcaaagtatgagggatgatggaattgacccagtgaatcctgaattggtatgcggctgtggctgcgaaagctaccttacctgtgattcgtccaacttagctgcttaacactaacctgactatgttca

SEQ ID NO: 59891 - DNA, 310 bp, Triticum aestivum
  unsure (1)..(310): unsure at all n locations
  Clone ID: PAT_TA_59891
ctgtgcggcgctcgaggcggccgggttgcgtcaatttcccattgaagagatcgaatcacgacgcaatgttagcattgtggtttaagcgtgctgccaagcttccagcagctctttatccatgctctgagatggcgccgaactgattactctcatgacacgttacgtctaatgttattgttttatactggaactgggagttgggagctacaaaggccattggattccttgtgtcaatacacttataagtacgacaattttatatatatatatctgtttatgcgngnaaaaaaaaaaaaaaaaaaggccccta

SEQ ID NO: 59892 - DNA, 374 bp, Triticum aestivum
  Clone ID: PAT_TA_59892
gccggccgggttccggacctccacttgggcaagctcggcgtcaggctgaccaagctcaccaagtcccagtctgactacattagcatcccagttgagggtccgtacaagcctgcggcctaccggtactagtgtgtccagcacgactagcggctggcctgagcctgagtcggagcagcggcaccaacgggaactcttatcaactatcctgtttcccttctattatcttacatgctgtctcttaggcggaggatttgttattatggttatgttttgagccttgtgagggttgggagaggcggcgtttgcttttgcccagaaataatggcattattattggtttaaaaaagaaaaaaaaaaaaaaaaaaaggccccta

SEQ ID NO: 59893 - DNA, 324 bp, Triticum aestivum
  Clone ID: PAT_TA_59893
gtgcggcgctcaggcggcgggtcggaaccagcgctgctgtcacttgttgacggcaggagcccgattcatctcacaatgggttcttaacggaacgttggtatatcaaattcttcggtcttagaaggcctgtgactcaggatcaattggtctgctgtctcttcggaggcagatgagttatgggcaagagaaatttccgaacattccgtaatgtattcctttaggtgccattgttagtcattgcctatagctggtagctacgcgtcaactcgcggtcaattcaattcaagattatttcaccaaaaaaaaaaaaaaaaaaggccccta

SEQ ID NO: 59894 - DNA, 156 bp, Triticum aestivum
  Clone ID: PAT_TA_59894
gccggccggtccgggagggttgtcagtcagtgaccatgttgcgcgatggatgcgcagaactgcccagcattgtaataggtcagcagacatttgtcggaatttgttgtgctcgctaaagttgtgttgcagcaaaaaaaaaaaaaaaaaaggccccta

SEQ ID NO: 59895 - DNA, 743 bp, Triticum aestivum
  Clone ID: PAT_TA_59895
gccggccggttccgggacactcattcactttactcatcgacgcaactcaacaaacaaaaatggagactatatatctcatcatcggtcttttcattctgttcacggttggccgagccatattcgcggaccgttcccccatccccgagacctcaggaaaggtcaacaaagtgaccgaggcatcagagttagacacagtcctctcttcaaacaagcatgtcgtggtagacttttacgccgactggtgtcctccatgccgcgccatcgcgcccgtcttttctactctcgctgacaagcacgcatcaaccggccatcttgcttttgccaaggtcaacaccgatcatgtgaaggaggttgctgccaagtatgggatctcggctatgcccacttttgtgtttttcacggatggtgtgcccaagggtgtttcggttgagggattgccgagtggccattctgttaatgtcaacaaggatggactggttgataggattcggggtgcggatcgaagagctttggaggctgttgttcaggttttggctagtaaggagtaggatgtcgggagaaacacagccatgagacaattcatcttacaaacgatggataatggtggaatggcacaatccgctgcgatttgtgtatgaccagagttgacgagtcaatgtatattgtcgggcgccctcccgccatgtctagagccataacaatacgtgttctacgatccaaaaaaaaaaaaaaaaaggccccta

SEQ ID NO: 59896 - DNA, 732 bp, Triticum aestivum
  Clone ID: PAT_TA_59896
gtggcggcccgctcgaaggccggccggtttccgggaacaccgttcctcatcacaaacacatcaccatggctcctataataccaatactacaagccgagcgcccgcatgataagcccgtccctagaggacctaaatctccagctcggactgcgcagatacaatcgcagaatcgaaggcgtgagtatctcgctcggcatccctcttactttgagaaccttgagcatgagcttgctgatcctgtgctatatgagcggctagtcaagaggctccagacagcttcagagcgtgaggctgagggcaaagcaaaaggctatggtcggacgctggaggctgatctacaacgaggagaatccaaactctctcaactcaaggaaagcgacggagccgggaattcaattggtgatcttgagcatccctgggagaagccagccgctgacaaggctcacggtatactcttatggcatgccttccttgaagagcgattcgtccatggcctggacgaagattttgactataggccagtcgatgctaatgaagatctcgataccatgcttagacgagatgctcaagatgcgtggttcgatgatgaagaaccaagctggatagatgaggatgaaccatcggtacaagcagcaaggcggcagggtgagactggcgtccaggacttttaggctcaacatttctttgaatcaaccctgagctggacaaaaaaaaaaaaaaaaaaggccccta

SEQ ID NO: 59897 - DNA, 660 bp, Triticum aestivum
  Clone ID: PAT_TA_59897
gccggccgggttggggagccgcaggtacgaaagaccccgacaatttctccctcgcagtccctacctctcttcttgagactacgagcgcttcgactttttacacattcgccgacaaaaggactaacattcacatttcagccatgtcgtcgaccaagaagccctccggcaagactcagcgctccgccattgcggatgtcgtcgcccgcgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggacaaggttctagggtggcatggcatttggagttgtactcggcattctggctttcgacgctgaaaaatacacagagggaaaatgtgattaaagcttgaagtcaaaaaaaaaaaaaaaaaagggccccta

SEQ ID NO: 59898 - DNA, 712 bp, Triticum aestivum
  Clone ID: PAT_TA_59898
gccggccggtttcggcccttcggcgccgcctcgttacagacagcgggagcgaaagagcgagcggtgagagaactccgggagagggcggcgagatggtgcagcggctgacataccgaaagcgccacagctacgccacgaagtcgaaccagactcgcgtcgtcaagaccccaggtgggaggcttgtgtaccagtacaccaagaagcgggcgagtgggccaaaatgcccggttaccggcaagaagatccaaggaattccacacctgaggcctactgagtacaagaggtccagattgtcaaggaacaggaggactgtgaaccgtccttatggtggtgttctgtctggtcctgcagtcagggagaggatcatcagggcgtttttggtggaggagcagaagattgtgaagaaggtgctgaagatccagaagaccaaggagaagaccaccaagagctaaacaactgggcgatataggcgtcgcggtgatgttttgtgtttcttcgaatttgttttaagcaatcaagaattttctctcttcggatttgctgaatcctggttctagtatgtgaggtttgatgtgcttctctagattttgcgcgctggttctctatggatgcttagcctttgatgcaagagcttttggactccaattcggcttagatgctcttgagctgcttagctcagttaacacaaaaaaaaaaaaaaaaaaggccccta

SEQ ID NO: 59899 - DNA, 435 bp, Triticum aestivum
  Clone ID: PAT_TA_59899
gccggccgggtctcgtcgttaactaactgttctgaataatgtgcaaaagaccaacgaacgcctttcagtccctgtaacaaaagctgaatttgcagttatgcgcacggcattgagttttgcattgccgcacatcatgggttgggaccaagcgttgtcaactcaccctcaaagcacctcgacctcagctagcaagcctaggttcgagcgcccaaacccagcttctgagtgggacaggtgaagctttcctcctcgcagcagatcgcctgagggctttaaacaccaccgcaggtcgccagtgaaatgtgtggagatgtgggatgtcgaattatgtttcttttgtgatcaaactagggaattgtctttatcagattttatgttaccccaggagattgaagttagagagcaccacaaaaaaaaaaaaaaaaaaggccccta

SEQ ID NO: 59900 - DNA, 746 bp, Triticum aestivum
  unsure (1)..(746): unsure at all n locations
  Clone ID: PAT_TA_59900
gccggccgggtccggcatctgtgccgtgaccggcgtcgtgaccccctgcctcgcctccatcatacgtgaggatgaagacgacagcgcgccatcgacccgtcccgggccgtccctcgccacgctcgcgtggagcgcacctgcgcgtggaccgccgaccgggcaagccgcccctcgccgataggagcgccggtgccgctcgcctgaagcatctaatggcggcccagacgttgttccctggatgactgggactcctctttgagttcattcttatccccatctgcatctctgtcattttagtaatttgtaaatcatcacccccgacgttgttggttgtgctaatttgatttcgtcgtgaaggccactggcctcgccaagcagcaggaggacctgtgggctaggctcgcctgccgcaagcgcgcccgcgagctcgccctcatgccggccaaggccacctccggctacttcctgtccgccgcgctctccaacgcctcgacccattcttgggctcacgcggcgccgacgcccgccgcgacgcatcaccccttccttggcttctccagaatgcacgccgccggcggcaagcggcggcgcgtgccgggcgttggaggccggcaatggataagtggcagtggtggccggcaatggataagtggcagtggtagcagggggttttctgtanaaacaaaacattatctcatcaggaacacacttanagtaggaaaaaaaaaaaaaaaaaaggcccctan

SEQ ID NO: 59901 - DNA, 729 bp, Triticum aestivum
  unsure (1)..(729): unsure at all n locations
  Clone ID: PAT_TA_59901
tgtgcggcgctcaggcggcgggttcgaatcccaatcgcttgcatcggcatcatcaattgatcaatctgttcaggccacaagagcagcacagctatacacatactcagcagaactacacttggttctttaacaccacccactcgcttgctactgtagctacccgccattatcaacaaccgacttcaccatgtcttctcagcctcttctccagaccacccccggcaagcgcatcgccctgcccactcgcgtcgagcccaaggtcttcttcgccaacgaacgaacgttcctatcatggctcaacttcaccgttatccttggtgcccttgccattggtatgctcaacttcggtgacagagtcgcattcatctcggcattcctattcaccggcgttgctatgtgtaccatggtatatgcacttgtgacctaccattggcgagcccagtctatacgtatgaagggacaggctggtttcgatgaccgttttggtcctacagttctggccatcatccttctcttggctgtcgttgtcaacttcgtcctccgaatcaccgacaagtccaagaaccactccaactagactcaatcagagtgataacatcaaaagccgcaatgcggcaatcaggcggaatatgaaacagtggacgaatggggcgggtgaagcgtatgagatgaaacaagcggatgaatatcaagttacattgggctgttggcgtttgagccgngtcttct

SEQ ID NO: 59902 - DNA, 676 bp, Triticum aestivum
  unsure (1)..(676): unsure at all n locations
  Clone ID: PAT_TA_59902
ggccgctcgaaggccggccgggctcccgnaaaaagaganaaagaaaaaaaaaaaaataaacaaaaaaaaaaaaaaaaaaaaaaaaaaaaaaaaaaaaaaaaaaaaaaaaaaaaaaaaaaaaaaaaaaaaaaaaaaaaaaaaaaaacccgtggtcccctttttttttcccaggggggggggggaaaaaggggggggggaggaaaaaaaaaggaaatcccgggttcgttgtttccccgggggaagggggttgggaaaaaggggggaccttacccttgattttcccggggcgaaaaacatggggggggaggctcgggaggcttgggtttggactcctacggggggcggcggaaggttcaggcccatggtgacccctttgggaaagggtccaaccaacaccccctgggaaaaaaggggaaaaggtgaatttaattgaaccccttttggcccaaaaactttggtcctttggaattttaaaaaagggggtttttgggccacgggttaaaggggggcaagggggggcccgaaaataactgggttttttaatgaaacccccagggatggtaaggggacccgggcctttccaaaaagggggctttcggggttttttaacccaaaaaaaaaaaaaaaaaaagggccctagggccggggccggctcaaaaaaaagggaccccccggg

SEQ ID NO: 59903 - DNA, 405 bp, Triticum aestivum
  Clone ID: PAT_TA_59903
tgtgcggcgctcaggcgccggttccgaagtttagaatggcgcacatttgttgcgccattactatcccagacagtaatggcgcacctaatagtgcgccattactaacccttacgtgcgccattagtaataaagccaagtgcgccactagtaaccttagaggtgcgccactagctaaaaagctagatgcgccatcaataaaggctgaaatgcgccactaatagtatatttgaaaaacaaaaaaaatacaaattaaaaaaacctataaggaaaaataattcagactcagccttatgaatatgctctgcagtctacataatagggcactagaaacgcaacatgagtgcagtacagaatgcagttaaattggccggtgaaaaacaaaaaaaaaaaaaaaaaaggccccta

SEQ ID NO: 59904 - DNA, 174 bp, Triticum aestivum
  Clone ID: PAT_TA_59904
gccggccgggtctcaacagaagggagccttcaatgtgtcatccctgtagactcacctgtgagtgctgctggtttcagattagacgagtaaagttgatcatagaattatcaaggcttgctaattaactagccagattctctagagacgtaaaaaaaaaaaaaaaaaaggccccta

SEQ ID NO: 59905 - DNA, 293 bp, Triticum aestivum
  unsure (1)..(293): unsure at all n locations
  Clone ID: PAT_TA_59905
gccggccgggctgcaagatcgcaccgcgcaaacgcagcacacttacgcatggctgccaccatgaagctcacaatcaccttcctcctcctcgtctccgcgctcgtggtgttcggcgacgccaagaaggcgccgtgcgccgtggtgtgcgtccagggagggcacatcacctgcgacaactaccccggccagaagctcgacgggtgcgactgccagtgcgcgcccaaggacggcaagggctgcngtgctccacctcaacagcgggctccccacccaacccagtggcaccacccacg

SEQ ID NO: 59906 - DNA, 629 bp, Triticum aestivum
  Clone ID: PAT_TA_59906
gccggccgggttccgaagtcttcccagcaacaaccaaccagtctcttctacactctgtgtccaactagctagcatctgcagcagcatccgagagagaaataatggtgtacgaggcagtggaggccattgctctcaggagccagcttcagagaagaaacatcagtgcgaggagccatgagcatcaggtgaaaaccagagagaatgagctcatatggggcattattctctggatcatcaggaaggtttgcccgggcttctaggacatgccacgttcggaagatcagagtgtaatagttaaaggtggcaccgagctgagatttttgcataatgtctgtgcgtttgtatgtatatagtactatgcattgggactggctatgggccaatcaactgaataagttttgggtcagtcgattgaccctgaatcgtttcggttgaccggccagaggcgcgggtgcaacctacgaacgcattccggcggccatgcatgtactaggtaagtactgtgtacgtctattataggtgtacaagagagcgtctgggctcatcgatgatacatgaagatcgtgtatggtgtggtctgaagagtaatacatatttgcatgcaaaaaaaaaaaaaaaaaaggccccta

SEQ ID NO: 59907 - DNA, 648 bp, Triticum aestivum
  Clone ID: PAT_TA_59907
gccggccgggttgcgaccaaaccccagcgtctcaacaaagccctgctgcgcctgctccgatcggcgcgaggaaccagcgagagaccgcggagccagaggaggaggaggagaagatgagctactacaaccagcagccacccgtcggcgccccgccgccgcaaggctacggggacaaggccggctacccaccgccggggtaccctccggccggctacccacccccggcgcagggctacccgccggccggctacccccagcagggctacccgccgcagtatgcgcagcagccgccgccccaccagcagcagcagcagagcagcgggccttccttcatggagggatgcctggccgccctttgctgctgctgtctcctggacgcctgcttctgaggagggaggaggaaagacgacgatcaacttcgtggaactgggactgagctatcctctctgacggagaaatgctgctagtagcttaattattatttctcgtcgggcattatcgcctcctttgtttgatccatgtttatgaacctctctgcgttgcaactattcgcttggttgtcgactgatgattatattatgcctggtgccttccgtgtgtatattctatattgtgtcggtttaaaaaaaaaaaaaaaaaaggccccta

SEQ ID NO: 59908 - DNA, 770 bp, Triticum aestivum
  unsure (1)..(770): unsure at all n locations
  Clone ID: PAT_TA_59908
gccggccgggctgcattcttcgcgtttcttccccccacagtctcttttactctccccttctccttccccaagccaagcaaaggcagcagaggccaagaaatgggcgaccgggcgtacgggccgtcctccaagccggtccctgtggcggcaccgcggtccgccaacggcacggcgaacggcggcggtgtagggacacctcggcctccgtccatggtgcccggtcgcgtcccgccgccgccgatgtaccgaccaaagccgatgcaaccgccaccgggccgtcggcggagcgggcgcgggtggtgctgcgcgtgttgcctgtggctgacgctggtgttggtggggctggtgttccttggagcaatagcgttgggggtgttctacgtgatttaccacccggagcttccgaccttcgccgtgacgtcgctccgtctggcggcgctgaacgtctccgactccgactccgtcacctcccgcatcgagttcacggtgaccgcgcgcaaccccaacgagaagatcgcgttcgtgtacggcgacatcggggctgccttcgcggccgacggcacggacatcggggacggcaccgtgccgggcttcctccaccccagccgcaacacgacggtcatcaaggggtcggcttcggcggccgccgcgacggtggactcggtgcaggcggccagtctcagatccaagaagtcccatgcgatgtcagtggagatggactcccangntgggtttcccagatcggcagttcaagtcgaagcgcatcagcg

SEQ ID NO: 59909 - DNA, 489 bp, Triticum aestivum
  Clone ID: PAT_TA_59909
gccggccgggttccgataatggactttgccactgctaaagtctccgagagtagaatgctctgatgctctctgagctctttacaaatgtctacctctttgttttcatggctcgcctcgttttgtcgcatatagaaaggagatgagagctacactcccataggtcacctacctgaagatgaacacgagcactcttctagcactctgttatatcgaggaggaataagattggtgaacaaacccttgagcgttgctgacatcatttgttgcaacacgaacctgcataaagatgtgatgtcaggggaactccgtccttatgagctatgctctccttttttttatcgtcctgcgattcacgataactgctgctacctgtacgacttggactgcctagaaccgttctgtctccaatgcctgtcggggaaagtaacgcttgtactgtgtctctacgacccacacaacaatcaacaagactgctctagggcctccgct

SEQ ID NO: 59910 - DNA, 378 bp, Triticum aestivum
  unsure (1)..(378): unsure at all n locations
  Clone ID: PAT_TA_59910
gacaacaaacgccagagcaggggnacaggggccaacaaaaaaaaaccaaaaaagggcccccacaccaaccaccccacgcccgccgccgccccgcgaaggaaagccggaggagcaggcaggcgggcggaccacggccagcgggcgcggacgcgcgaccggagcgagcgcccggaccggaagaagggggcagcccgcgcaccaccaaccggggcaccaacaagggcggcgaggacgacaaagccaaggggaacggagccgggcacaagggaaagccgcacaagaccaaccacgcgcgaaccggacgagggaggaacgacaccaagcgcgacaacggcgcccagaccaacaagcaggaggggaaccgcaacaacaggaaaa

SEQ ID NO: 59911 - DNA, 330 bp, Triticum aestivum
  Clone ID: PAT_TA_59911
gccggccggttccgggtcccccaattaaacctctctcgtcgtctgctcgctcgcccgtcccccaaatccctactcccccaccaaccccagccgaaccccggcggcgtcaccggcgatggagtgcgtcatcggcgtggtcggccgcgacttcgcggtcgtggcggcggacacgtccgccgtgcagagcagcgtggagcatggtcgtcgtcgtaccgtattgtctgtcgtatattcgtgctgtacatgagtaccttccttgtgagtcactgtggtagtcttctcattaaagattctttccgacgagaaaaaaaaaaaaaaaaaaggccccta

SEQ ID NO: 59912 - DNA, 757 bp, Triticum aestivum
  unsure (1)..(757): unsure at all n locations
  Clone ID: PAT_TA_59912
tcaacatccatcactccttcttgttgataacaacccaacatatcccacctgttatcaatatcttcagtattagcatcactgaagcccgtacaaacagcacacaatgcgtttgtcaacttctgccctcgtgctgggcgctgcctcttcggccatgggcctggagcagcatccttggcggcgactcaaagcctctcatcgaccttgacgtgaacgcgtggaccaagcccctcgagaagttcttcggagagatctcatcagaggccaaggctgtctgggacgaagtcacacttcttgcccccgacgctgtcgaggctttcaagaagcaggtcctcactgagcccaagaaggtcaaccgccgacccgactctcactgggaccacgtcgtcaagggtgccgacgttcagtccctgtggaccgagaagaacggcgagaagcaccgcgaagtcggcggcaagctcgagaactacaacctccgcgccaagaaggtcgacccttccaagctcggtgttgacaaggtcaagcagtacagtggttaccttgacgatgaggaggaagacaagcatctcttctactggttcttcgagtcccgcaacgaccccaagaacgatcccgtagtcctttggctcaacggtggccccggctgctcttccttgaccggtctcttcctttgagctgnncctgcttccgtcaancagaagattgagatcgtncacaaccctgagtcttggaacaacacgcttccgtcatcttcctcgac

SEQ ID NO: 59913 - DNA, 330 bp, Triticum aestivum
  Clone ID: PAT_TA_59913
gccggccgggtctcgactttacgagcccggttccagagtggtgacgaacgtcgagaaggataggctttccttggctgtgttttacgccgtggatgcagaaacgatgttggagccagcgcccggtttgctggatgacaagcgaccgccaagatataagaaaatggtggccaaggattttgtggctgggctctttgaacatttccgtcaagggaagagattcattgacaccctgaaaatataggttcgctgtttattatggagccgtagaagtgattgctataaagaataaagagatggttttatcaaaaaaaaaaaaaaaaaaggccccta

SEQ ID NO: 59914 - DNA, 652 bp, Triticum aestivum
  Clone ID: PAT_TA_59914
gccgggcctggaccaccctcctctccctcccccgctccgcccgcagagctcccgtcctccctccactgtgccgcccgtgctccgcggcgccgatccggccctccccccctcccttgatccacacctcgccatgtgcggcggagccatcctcgcgggcttcatcccgccgtcggcggccgccaaggcggcggcggccaagaagaagcagcagcagcgcagcgtgacggccgactcgctctggccgggcctgcagaagaaggcggcggacgaggaggacttcgaggccgacttccgcgaattcgagcgggactccagcgacgacgacgccgcggtcgaggaggtccccccgccgccggccgcggcggggttcgccttcgccgccgccgccgaggtcgcgccgccggcccctgcccgcctagatgctgttcaacgtgatggacctgctgccaaacaagtaaagcgcgttcggaagaatcagtacagagggatccgccagcgtccctggggaaaatgggcagctgatatccgtgaccctagcaagggtgtccgggtttggctcgggacatacgacactgctgaagaggcagccagggcatatgatgctgaagcccgcaagatccgcggaaagaacgccaaggccaacttttcctga

SEQ ID NO: 59915 - DNA, 595 bp, Triticum aestivum
  Clone ID: PAT_TA_59915
gccggccggttccggaggaggacagcagcagctgtcggcgtcgggcaaggaggcggcggcccccgcgcggatgcagcggagcggctccagcgggggtcacggcgggtacagggcggggcacgtccagccggcgctcgacccaccctccccgcgcgtcgccgcctgcggcttctgcagcctcttcggcaagcaggcgccccagccgcagcaccgcgcgggcggcggcagcgccaaggggaagcgccggtgagccagggaccagcttgccgcttgcgttacttgtgcgcgcagctatgtacatgtatgccagacagacttgtgcctctgatctgttggacacggcaccttcttgccctagacttagtacaaatgatgtggggcggcgttggtgttgatgtcaacgcgtatgagtaaaactcgttacctctccttcaaggacgtgctgctcatgcatacccatgtagtcgcatttaaagatgacatgtcatcttgtttttgtaatattcccccatcataataaaagtgtgccttcatgcatatgcggcttttcccgcatgatttttccacataaaaaaaaaaaaaaaaaaggccccta

SEQ ID NO: 59916 - DNA, 476 bp, Triticum aestivum
  unsure (1)..(476): unsure at all n locations
  Clone ID: PAT_TA_59916
gccggccggttcggatctacttccatagattttntggccttccaatgctgcaactatgggtctccactctctttttttacagtatatgggcgtcctattagcagtcatttgtgacttcaaatgtttttgaattttagaaattagaaatgatcattgccgacaatgaacgaataaaaacggagattttgaatcttagcgagtcaatgggcaataccgtacccactacattgcctggcacacagctggaaggatattccatccttgcctttcatcctttggtacagaagcgtgggtactaactgtgctgaaaggtaggccaatattgatgagttgaaggagagaaataactaccacaccacccagcaactcgcaccttccagttatgttatttgtttatgcagggttgtactggttagtagttagtatatgaaaaagcatgtttatgctccaaaaaaaaaaaaaaaaaaggcccctaa

SEQ ID NO: 59917 - DNA, 510 bp, Triticum aestivum
  Clone ID: PAT_TA_59917
gccggccggtttccggaccagccagaaccacggttacgccatcgacgccagcactctccctagcgacttcaaggaatactttgtcaacctgaacgacggttccaacgagggtatgctccacaagacccgacctatcttctccacccagttccaccccgaggccaagggtggtcccatggacagctcctacctcttcgacaagtacctccagaacgtccagctcgccaagagcaaccaggtcgttttcaaggacaaccgacctacccctctgatgctcgacatcatgagccgagagcgtgtcggcgttgagcccactccccttgccgcttctgcttaaatgaagagtctgagataaatttggcgtctgggattggtagttgggtaacatcggttgtgttttcttgggagcaagggaaacggtttttttttaaaagaagaaatgttatatgtaaagtagcattgaatgagaattattgtgataccgaaaaaaaaaaaaaaaaaaggccccta

SEQ ID NO: 59918 - DNA, 316 bp, Triticum aestivum
  Clone ID: PAT_TA_59918
cggcgctcaggcggccgtctcctctggggactccccgtgaaggccaagcccgggtcgtcgctgctcaggaggctggccatcggatatgggtataacttcctgcgccggaactgccgcagcccagacgtcgtgctccgcgtgccgccggcatcgctgctcgaggtcggcatggtctatgtgctgtgactcacagacacggggcttctgttctgtctctagcttccggacatgctgctgtaaattgtaatgtgacggcgtgatgcgtgatggaaatatatgttttgattgacaaaaaaaaaaaaaaaaaaggccccta

SEQ ID NO: 59919 - DNA, 337 bp, Triticum aestivum
  unsure (1)..(337): unsure at all n locations
  Clone ID: PAT_TA_59919
ggccgcttcgaggcnncggccgggccttcgaaaaaaaaaaaaaaaaaaaaaaaaaaaaataaaaaaaaaaaaaaaaaaatacactgagttcgacgtcttctccaagtggctcggcgtcagccagtgatcatctagttgtagtagcagtctatcgtcctaccttaagagaccctaaagtatgattttgtgtcatgttatcgtttatctggagtctgagacatcttgctgttttggtagctgtttatcttgtgtgttctatctatggacgcattttgcgagacatgttatattgcatgctttatcgtcgtcggaaaaaaaaaaaaaaaaaaggccccta

SEQ ID NO: 59920 - DNA, 378 bp, Triticum aestivum
  Clone ID: PAT_TA_59920
gccggccaggcttgcgccaccagcgaggagtgcaccgtcgcatggggtgtctgtaatcatgctttccacttccactgcatcagcaggtggctcaagactcgccaagtgtgcccactagacaacagcgaatgggagttccagaaatacggccactagaccaccctcctccgccgcccagcggcggcatgttacgtgcctactaccacgctatctcttgtcgaacgtcgctatctccagctactttagaacatttgcatctacatctctgtgtttgatgactttgtataaaggattcatgtacttgcacatctaatgctatcgtattgtattaagggattcccctgttaaattcaaaaaaaaaaaaaaaaaaggccccta

SEQ ID NO: 59921 - DNA, 629 bp, Triticum aestivum
  unsure (1)..(629): unsure at all n locations
  Clone ID: PAT_TA_59921
gtgcggcgctcaggcggcgggctggaaaaaaaaaaaaaaaaatctagtgaggctagtccagacagataaccacaagtcggaaaggaaaaccaggcgagatgaacgcacgcgacctcctcttctccggcgtcgacatcgtcaagcaacaggcgagcgccgtggcctccaccgtctcgctggccaagccgtacctcccggcaaaactaaccgagatgaacacgggcaacatcgtcgccggtctcggctacgtcaagaaccatacaggagcggccgtggcctccaccgtttcgttggccaagccgtacctccccgcaaggcttaccgggatgaacaccggcgacatcgtcgcaggtctcggctacgtcaagaaccatacgggagcggccatggtctccaccgtctcgttggccaagccgtacctgcccgcaaagctctccacgcgggacggtgccgtgggaaccgcgggagggnnccatcggggggcgccgtgggcgcctacttcctctggcccgctgcggccgcccccgccgcggccggcgccatgatgaaggcgcctggtgccgccggcttcctcatctcccgcacggngttcctggccaacccgcaggtctactaccagatcctccgca

SEQ ID NO: 59922 - DNA, 752 bp, Triticum aestivum
  Clone ID: PAT_TA_59922
ctgtgcggcgctcaggcggcgggtccgatcccctttttgccagcgtgagatcttcttctttcttgcgagggagagagggtagcgagcaaccagggagctaggcgtcaatggcgaccatagccacgatgaccatgctcaagcccgccaagatcacggccaggtcggcgccttcgtcgccgtcgtccagcgccaaggtggcgtcgccgagcatctcgctgcgcagcctgcagaagaacgcggccaagaagggagccctggccgtgtcgccggcggccgcggccatggcgagcgccttcttcacctcgctggcctcgtcggacgcggcgatggcgtcgcagcggatcgcggacgtggcggcggcggcccccgcggacgacaaccggggcctgctcctgctcttcgtggtggcgcccgcgctcgggtgggtgctctacaacatcctccagccggcgctgaaccagctcaacaagatgcggtccgagaaggcgctcgtcgccgggctcggcatcggcgccgccgcggccgccggcctggccgccgtgccggagccggcctccgctgccgtgcaggagctggccgcgctggcggcggtcgcgccggccaacgacaaccggggcctgctgctgctcttcgaggtggcgcccgccctcggctgggtgctctacaacatcctgcagccggcgctgaaccagctcaacaaatgcgatccaactgagcgcgcgtacgtcgtcgtcgtggcatcgcatgcggtc

SEQ ID NO: 59923 - DNA, 678 bp, Triticum aestivum
  Clone ID: PAT_TA_59923
gccggccgggtcgcggaagttcccgaccctgccaaatcccattcgcttttaaattagagattttatttatcgtccgccttccaacgcgcagctgcctcgctgccccggtgctgctgctgctcccctcccgccccgccgacgcctccgccgatggaccgggaacaagtgacggagttcctgggccaggtgccgctcctgcagtgcctccccggctcctccatccgcaggatcgccgaggccgtccaggtcaagcactacggtgagtcgcgcgcgccgtcccccgtccttgtgctgtggcgccctagatcgatcgctcggcccaccgggtttgcctagtcaggcgagcgcagcctaaatctggcttgggtcagttcagagtactctctactgtcagcctactgaattactgaaggatgctctctgtgtcagtgagtgatgtctgatgtgactcccatgatttgtaggagtagttcactgtacttcaaatcgcgcacatgattctgtatgcatctcatgattctgtactggcgttgcgatctgcataaatagaaaattttaaccatcaggagcaaccgcatgcaaattaggctgctaaaaaactgggcgctgcatttcagtgcgtacctattaactagatgttgtctaccccttgcaaaaaaaaaaaaaaaaaggccccta

SEQ ID NO: 59924 - DNA, 844 bp, Triticum aestivum
  Clone ID: PAT_TA_59924
gccggccggtccggggcttccgtcaacccctcctagtgcctgatccccgaaaccgaaatcatgaggcccattcttcttgccgggcacgagcgtgcgctcacccaaattaagttcaacaaagatggcgatctcatcttctccgtcgcaaaggaccagcagatctgcgcctggttctctcacaacggcgagcgtcttggaacctaccacggccacgtcggtgccatctggactgtcgatgtcaaccccacctcaaccatgatcgcctccggttctgccgacaacactatccgtctctgggaggtcaagtccggccgcctcatcaagacctgggagttccccaccgccgtcaagcgagtcgaattcaacgaagatggaaccaagctactgggagttactgagaagcgaatgggttacctttccaacattgttgtcatcgacatcaaccccgacctcaacgccgagcagaacgacgagaagagcctcaccatcgtttgcgacgagagcaaggccaccgttgccggctggagcgccctcagcaaatacatcatcgctggcgaggatggcagcgtaagccgatatgacgccaagactggcgacttgctcgacaacgtccccgttcacgagctcaaccagcctatcgtcgatctccagtgatctcccgaccgcacctactttatcaccgcttgcaaggacaagacttccaagctcatctctgcccgtgacctggagggtcctcagacttacgtcgccgacacacccctcaacagtgccaccatcacccccaagaaggactttgtcatcctcggtggtggtcagcccgcatggatgtcacccgaaacctctg

SEQ ID NO: 59925 - DNA, 807 bp, Triticum aestivum
  unsure (1)..(807): unsure at all n locations
  Clone ID: PAT_TA_59925
gccggccggttcgggaaaaaggctcccgcgtttaagcggcgacggagaggaagagcgggcgagatggcggcggcgatcccggcggtttccgcggattctgtgacgggggaaggcgctcgcacgggagtgggtgccgccatgtgcgcccaagcaaggagcgggctcaaggccaaggcatggcaaccgagagggaaaaggggggagatggcagcgccgattccggcggtttctccggcgggggaagatgcccgtacgggggtgggtacccatgaggggcccttcagcgctcaggagtgggacaatttcaaggtcggatcacgagaaatcctccgtcgattcgcaaatcggaagaggtgctgggagaggatgaagaggcgtgcagaaaggttgattagcgggcatccaggtgagatcgtatccgatcgatctggtgggagaggggtcggcccaagccaatttgcgtaaggatttgcctttgttggtagattttagggaaattaataggcggaaattgctctcttttgtgggtggggtatcaaattcgttttcagccggattgggaagaaatccccatggttcggggcgcatgcagagtaatctttggagtgcgtttaaggaaggagaggagaatttggatactgatagcctctgtacaattagggacaaggaaaaaacaaacgtgattttaatttgngaacggncgtttcaagatcatttattatttcatatgtatagcaattcggagggtgatcagggnaagaatgttatctgcacatttangagaaaaaaaaaaaaaaaaagccccta

SEQ ID NO: 59926 - DNA, 395 bp, Triticum aestivum
  Clone ID: PAT_TA_59926
gccggccgggctgcggctgaaccatgtaactaacatttgtgtaatgctgtcttaatgtatatagtgtattattaaccaaaaaaaaacaagtacgatgaggcattattcattcactgacgagtctgctggatacaaattaggagacgcctggtcctggttaaatcatgtgtaatatataccctgagttatactgcacgcaaaccgtgtctccattttggcccccatgtattgtagcggccgtttctgtgcgatcacgttgctgagtagcgattacgaggttaaatctgcagatattcgttttagtggacacttttgcagctgttagcgtgttttgagtgtacttggggtaatccgtgctcacaacttcataaaaaaaaaaaaaaaaaaggccccta

SEQ ID NO: 59927 - DNA, 280 bp, Triticum aestivum
  unsure (1)..(280): unsure at all n locations
  Clone ID: PAT_TA_59927
tgtgcggcgctcaagccggccgggnttcganataacaatcgtaaatactggcacagtaacgtgcagttatggtttcaaggaaaagcttgcttggtgttgaggagttgtccaagatcagcacattaagagaacaaagaataaagcaggcaatgttaaccgttgttttaaaagaaaaaaaaaaaaaaaaaaggcccctaccgcccgcgccccgcctctataactaccgcctctccccgtttttgttttttttttttntttcttccctctatccctcacccct

SEQ ID NO: 59928 - DNA, 343 bp, Triticum aestivum
  unsure (1)..(343): unsure at all n locations
  Clone ID: PAT_TA_59928
tgtgcggcgctcgagncngncgggcttgntagtattgacgacgagtcatctgatttcctgacaccctggactctatgacatcccatccactggacctcagaactctggagctgtcaggcaagttgctgaaaatcccagaatggcttccacgtctcagtgaacttatcaaattaactctttcggcaacagctctccggacagataatctggcgctcctaagcaagctagattcactgttttccctgaccttttcaatcagtgaggcaaataaggatcctgacttggcagccattctcgagaaaaacaaatctgactccagaggagagatctttttaccaaatga

SEQ ID NO: 59929 - DNA, 558 bp, Triticum aestivum
  Clone ID: PAT_TA_59929
gccggccgggtcgggccgccaaggcggtgaaccaggcgctgcggacgggcgcgccggtggagacggtgcgcaaggcggcggcggggacgaacaagaatgcctccgccgcggccgtggcggcgcccgcgcggaagctggacgagatgacggagcctgcggggctggggcgcgtgggcggcgacgtgcgcgcggccatccagaaggcgcgcgtggcgaaaggatggagccaggcggagctggccaagcgcatcaacgagcgggcgcaggtggtgcaggagtacgagagcggcaaggccgtccccgtccaggccgtgctcgccaagatggagcgcgccctcgaggtcaagctccgcggcaaggcggttggggcgcccgcgcccgccgggacaaagtgatggtccgtggggacatatcctttcctgtgaatttgtgatgaatggtagtaaatcagatctgtaaatctcgggttgctttgtggtggattgggttgtaagtcgtgcaaagtgataaatctcatgtgaaatctgatgtcaaaaaaaaaaaaaaaaaaggccccta

SEQ ID NO: 59930 - DNA, 262 bp, Triticum aestivum
  Clone ID: PAT_TA_59930
tcgaggccggcgggtcgggacctctatctctctgtctactctatcctcaaagggggaagaaggatagagtggggagcggagctcagctcacttcagcgggagctcagcccatggccatggcgacctccaccttctccgcccacccgctctcgctcaagccccagctcggccccaagccccaccgcctccacctcgtccccttcccgcgcctccgctcccaccgccgcctcgccgccgccggggaggcccccggcggggcgcc

SEQ ID NO: 59931 - DNA, 424 bp, Triticum aestivum
  Clone ID: PAT_TA_59931
tcgaggccggccgggtcgggactggacgtgactcggcaccattggtcgtcaacggcggcagccctggtggtactcgacggcggcggctacatcccggccaggagacaacaattcagatgagctaggtgttggagatggctgaaacggagacgggtgaccacgtcgttgcagacagcttcgattttcctcctttgtttgttcccgagcagaggccgcctccgccgccgctcgtgttcacattaactattagagtagctcgttatgtctacaagcttgatgatggaagcgagcaagttgttgacaagcatgatgttgtgtttgatttcaacatttctggtatgtcatgttttaacttcagcgacctaatcttcaaggcagtcccaatcccgtgactagaaggatgttggttatggtattggatgat

SEQ ID NO: 59932 - DNA, 197 bp, Triticum aestivum
  Clone ID: PAT_TA_59932
tgcgccgctcgagccggccggctcaacaccaccccccccacaatgatatcttctccactcctattctaatcaacccctcgccgccgccgccgccgcagatctcaccaccgaccgaccgaagcgatggccgcctccaccgtcgtagacagaggcggggtgagccttgttttattcttcgccgtattgaagtcttttgt

SEQ ID NO: 59933 - DNA, 150 bp, Triticum aestivum
  unsure (1)..(150): unsure at all n locations
  Clone ID: PAT_TA_59933
tgcggcgctcgagccgncngtccgaaaacacacagtcagcaagctagcttcgcttcagttcttgcacagttcagctatacatcctgggnagtagaggtgatgatggagtacgaaccacagagcttctcctggccggtcgcgctgtcgtcg

SEQ ID NO: 59934 - DNA, 856 bp, Triticum aestivum
  Clone ID: PAT_TA_59934
gccggccgggttccttgactgtccttgccgagttcatcggaggatccttcgttgagggcaacgcattggccatgaactacttcaagtcattcggctatgttacttgtgctcacgctgtcatgttctccaacgatcttaagcttgctcactacgtcaagatccctccgcgacacaccttctttgctcagatcattgccacctttatcagcacctttgtttgtgttggtgtcctcaacttccaaatgacacagatcgatggtgtttgtactgaggatgctcgatggaagatgacatgtcccagtgtcaacaccttcttcactgcctctgtcctttggggtactgttggtcccagcaagatttttggaaagaacggactctacactgaggtcttgatcggtttcccattgggtgtagttgttgtgcttgttgtctgggctatcaacaagaggttccctcactggacctggacccgacagattcaccctgtggctatcatgtatggaggtatcgtttgggctccttataacatgtcatacgtctggccctcagtgcctattgcatacttttcctggatttatctcaagtcgcgctatctcgtctcgtggtcaaaatacaactttgtgctctcagcagcttggtcttgcggcattgccattgcaggcatcatcatcttcttctccctccagctcgaaggtaccgaattcaagtggtggggcaataccgtcggttatacaggatgcgaagacgacgcttgcccccttcaacctctggacggcagcgactactttggtccctcgagtggagagtttcactaagtcgtcgtgtcctggcttcatgatgagatgatttggcgcat

SEQ ID NO: 59935 - DNA, 481 bp, Triticum aestivum
  unsure (1)..(481): unsure at all n locations
  Clone ID: PAT_TA_59935
gccggccgggtcgggattgccaatccccacctccacttcctcactcacagagaagacantctcttgttcccacatctccagctactacaagctcaaccacaccagtaccaaggcaggcagtcaccatggacgctgtggagtcctcctcgccctattcgccgccgtcgctgcgccacaagctgcggacaaccgtgtgcggctgcttcggctcgccgtcgtcgccaggcagcggcgcagagaggccacacacccgcggcggcaggagcaggtggaggcgacgcgtgaccgccacgggggagttcaggtacgacccgctcagctacgcgctcaacttcgacggcggcggtggcgacgacggcgacgccgacgccgaggacgccgccttccggcacagaaacttcagctcgcgcctgcctccctcgccggtgccggactcccgagccgtcagaatcgcctgaagtgaattgcactaagagcctct

SEQ ID NO: 59936 - DNA, 511 bp, Triticum aestivum
  Clone ID: PAT_TA_59936
gccggccgggctgcaatacatcattctaactaacaaatttcttgctcattagactttcatattttcccatctttctcatctccacctacatccatcatctcatcgaccaacaacagaaatcatgttctggatgacaagctgtccgtttgaagttcgctgtgatctcttgtgacaaggtcctacgacctcttccaccacagatcgcgagcacaaattcgcctatacctctccattaacgacgcctcctgcttctagcgtagtctgtggccttgattctgctcgaagagcctggactccccccatccttccactctcatacgggaaggtgcggctactttgatggcaagagtgttagcaagagggaccagactgcttctattgcctgctctgtcgctgctgcccactactgcagctctcctactcccacctacgggatccgcgctctacttgacaccgataacatgcgacatgaagctcctcccttgtctcgatggcatgctcgatgacgacg

SEQ ID NO: 59937 - DNA, 658 bp, Triticum aestivum
  unsure (1)..(658): unsure at all n locations
  Clone ID: PAT_TA_59937
gccggccgggtttcgnaaacacaaaaagatcgcaatacaacctgcacaaacatattacaccatgtcgcaacgacagcaacaacgaagcgcaccagcgccctcacaaacacaaactgaaaccccaacacaaacaccagagacgagagaacaagctcctcagattctgcggctccggggtgcgcatacctccaacggacgatctgtgcagtgggcagaggatgtagtagacaacgaaggtctaggacgcaagagttcaaaagtatgttgtatttaccacaaacccaaggctgtcgatgagtccagcgacgagtcttcttcagattctgactccgactcggggtctgatcgcgacggcgcacaaccagcaggtggcaagcgtcaaggctgcggccatgggcatgggcataatcacggacgaggacgaggaagcggaaaggacaaagagaagagagcaccaagcccaaatgcgtacgagaaagtgcccaagccgaaacccaaggatgggtcgtcggaaaccaagccttagaacaaagagggcggcgggttgtcgaataagaaggacaaagaaagatgagcacgaatcatgatgatatgaaatagatgcgttatatggcagaggaggggttcttatgaaaaaaaaaaaaaaaaaaggccccta

SEQ ID NO: 59938 - DNA, 647 bp, Triticum aestivum
  Clone ID: PAT_TA_59938
gccggccgggctgcgcgtgcccatcgatctcagcctcctcttcaactactgcggcaagaacgtcccctccggcttccagtgcccccgctagaagagaagacccgagagatccatcgtccactgcatgcaggcatctactatacgtacgtacgtgcgtgcatgcatgatctacaatccatccattgactagtgctctatagctagtcgtatacgttatttgcttcataatttatcatcgcacttgctagttgataaactttacatatgcgtgctgcgtgtctctctgtgtggtagtatcgtttgtactactgcttgtcgtcgagctagattacggtactgtaatggatctcatgcgtgtaccgctgcctgctactattatatttgcttcaaaaaagaggttagtcctcctacaattgtaaaaaaaaaaaaaaaaaaaaaaaaaaaaaaaaaaaaaaaaaaaaaaaaaaaaaaaaaaaaaaaaaaagagaaaaaaaaaaaaaaaagggccccctaggcccgggcgctctataaaaatagggtcccccccggtgtgggaaatttatataaaaattttatatacccccgccccctagggggggcccccgacccccttttccccatatagagacgcatattacgcgctctct

SEQ ID NO: 59939 - DNA, 535 bp, Triticum aestivum
  Clone ID: PAT_TA_59939
gccggccggttccacatcgctggtggcggtgcccctgtgattgagattgcggcacagctctccaagcaagcgcgtagcttgacaggtaccgaggccatttgctggaaggcctttgcagacgctcttgaggttatccccaccacactggtcgagaatgctggtctgaacagcatcaaggttgtcacagaactgcgacaccgccacgagatgggcgacaagaacgctggtgttagtattaagtcgggaggtgttaacaccaacatctccaaggagaatgtgttgcagcctctcctcgttagcacaagtgcgatcgagctggcggctgagactgtcaagatgattctgaggatagacgacattgccttgacccgatagagtgagatatcccctcagcaggatctgccttgggttgtatgaaaataccgaaatgggttctgagtctgctttaaaagtattgaactgtatagactgggtcaatgacacccataattgacataaaaaaggccccgaagaccgcgaaacgatcaggccccta

SEQ ID NO: 59940 - DNA, 539 bp, Triticum aestivum
  Clone ID: PAT_TA_59940
gccggccgggttgggacttcaaggattctttcatgaaggcccagaaggagaacgaggagatcttcaacaaggctcaggaggccgaagctcccccctcctaagcagcccgcactttagaatcctccccgacccccctgccctttcggagttcgatctggatattttcaaggattcacactcgttcgtagtcctgcgatgtctagagaagtcttactccaacaccccaacaacgcatgtcacaatcacgcatgcatctcacattgctgcgatgcttgattcatcacacgcacacgcaccacaccacaccacaccacaccacaaccccgccacaacactatatcccccaagtctggttttaagatggatagatagagattcaaaaggacagagaggtttcttgaggtgagctgttcgagtttagcctcaaggcggatcagtgaatggatggatggacggatggatagttagtatcataggaacatcagatcacacagcaccctctgtagaagaagtaaaaaaaaaaaaaaaaaaggccccta

SEQ ID NO: 59941 - DNA, 611 bp, Triticum aestivum
  Clone ID: PAT_TA_59941
gccggccggctttctctcggtgactcagcgaggagtgccagtccgccgttctcgacatcgcccagggcgtccctactcccgcccccgagatcgtctctgatctcctcaagaacccccagaccgacccttgcagcttcagcacccccgcctctctctccagcgagtacgccgactacagctcctccatcatcgcctggtacggcaagaaccaggacgatatcatgtccgctgtcaaggagtgccccgagcttgcttcgctcgccagccttgtccccgtctgcgaggcttctgctaccggtgcccccgcctccaccggcctcactgccaccaccactggtgttgttcctcccgtcgtctcttctgccgacgagaccgccaagactcccgccgctactcctacttccggtggctcttcccccgttgagaccaacggtgctgtcgctcgtgagggcgggctcctctacgtcgccgccgccgctgttgccggtgttgttgctgctctctaaatctgagatggtaacagatggactgttggataaggcatttaagattaatagtttttaatacaaacacatctctttcgcgaaaaaaaaaaaaaaaaaaggccccta

SEQ ID NO: 59942 - DNA, 400 bp, Triticum aestivum
  Clone ID: PAT_TA_59942
gccggccgggtctcggaaaatatatgccttcaccttgaagtgcaactacaagcgcctgcgtctcaccgtgcacgacctctgagcatcgtattcagtctactaaactgcttaattagcctatgaagttctgtgtgtatagcttcaccataagaacctgtttgcttttggcactggactctttggtcatcatgttcagtctactaaactacctaaatagcctatgaagctctgtgtgtatagcttcaccctaagaacctgtttgcttttggcaccactctctgcttttgacactactctctgatatgtataaatttggaatccatgatgctatgtttgatccatgtaatatatatatatatattccaactgcgtcgaaaaaaaaaaaaaaaaaaggccccta

SEQ ID NO: 59943 - DNA, 485 bp, Triticum aestivum
  Clone ID: PAT_TA_59943
gccggccgggtctggtctgggtggaagatcatctgaccgtcgactctgttcgattctggttttgttactgacaatgtgagtgaagtcgggcccgtgaggggcgagtatctggtaaagcctcacctcccgtttctccttgatcctctccagctcgctgaacctttgctgcagcagcgcgatggaggagaacatcagtgtgccttcagtgccatgcacccccactgatgatcgatgaagagacatgcgatgattgactgctctcgtgttgagttggtggagttttcgtttgtctggctactttggtctgctttctgtgtgtgtgtgtggggctttagtggtggcagcggggaagagcattgtgagtgcttttttaaccagtaagttttgtcgcggtgcagctcgtaaaaataagtcaattcctggatccaacttttcataactgaattgcatgatctgtccaaaaaaaaaaaaaaaaaaggccccta

SEQ ID NO: 59944 - DNA, 645 bp, Triticum aestivum
  Clone ID: PAT_TA_59944
gccggccgggtctggatcacacaacttccacacactattaaaaacccccctccgctgcagtcgacctcctccatttcccttcccatcctctgaacccaacataagctcgccttaaatgcaattgctcaataatgtcggcccgcgctgaaggtgagttaatggcattcgctaagggggtggccgatggccaccggaaaggtgatcgtgcgacaactctccatggtcaatcagccataccacgagggatcctgtctgtctgaacgctcaaggaaccgaacgtgaccgcgctgtctacggggctcctctacgagaagacccgcgcattcgctcatcatcttcctggagaaggttatcctttacgccttcacctactctgaggacgcccaccgcaagagctccaccgtcatgcacgtcaactacgcgttcaagagcattggacacaccctctacggtttccccgacaaggccgagacgaaccagtggaatcctgcctcgcgccgccgaattcacttttaattacccatcgctcgtctcattgtccttgcgacttcggcgtactgccatatggccgcatcgtctgctgctgattgccgcttcgatgacctactactgatggaatgtaactatctgcgttttgccccctga

SEQ ID NO: 59945 - DNA, 757 bp, Triticum aestivum
  Clone ID: PAT_TA_59945
gccggccgggtcgggagcgtcaacacactgaacaatccatcagtcacacactcgaccgagaaagagaacgggagaggtgcagaggagtgagcaaagcaactaagcaagcaatggtgagtgctccttgctgcgagaagatggggctcaagaggggcccgtggacggcggaggaggacatgacccttgtggctcacatcgagcagcacgggcacagtaactggcgggtgctgccgaagcaggccggcctgctgcgctgcggcaagagctgccgcctccggtggatcaactacctgcgccccgacatcaagcgcggcaacttcaccagcgaggaggaagaagccatcatccaactccatgccatgctcggcaacagatggtccaccattgccgccaggctgcctggcaggacggacaacgagatcaagaacgtctggcacacacagctcaagaagcgactccagtcgtcgtccaagtcgtccggccaggcagcgcctaagcgcaaagccaataaacctgctgtggctgcgagcacgctcgaggatccgacctccgacccggtgtcggcggagcagtccctcgcgatgtcgccggagcagtccctctcgacgtcatctgccaccgactactcgatgggcctcgtcgttggagaacacgggcagctcttcctcggaggagttccagattgacgacagcttctggtcggagacactttgcgatgtcggtgaacaggctccgggtcccgggatggaaaccagcg

SEQ ID NO: 59946 - DNA, 784 bp, Triticum aestivum
  unsure (1)..(784): unsure at all n locations
  Clone ID: PAT_TA_59946
gccggcagggtctgggcaatgtattctcctttactgcctttgctaccgtatatcgatctttaaccgtgtgccaaaatgcctgagattgcagaagttgcacgtattgtccacttcctacgactccatgttgtggggaaacgcatcatatccgcttcagcaacagatgacaagaatgtgttcggtaaagttggtaccagcggcgaggaggtggaagcagccctgaagggaaagaagatcatgtctgctggaagtcaggggaaatacttctggatagccctcgaaaagcctccccatctagtaatgcactttgggatgacaggttggatacacatcaaggatgagcagacggcatacacaaactactacaagaagatgaaggagggcgagcatgagcaatggccgccacggttctggaagtttcagttcaagactgagggctctcctgaagttgaagttgctttcacagattcgcgcaggtttggtcgtgtacgactcatcaactgcccaggagatgagataagacaacactcaccccttgtcgagaacggcccagatccagttgtcgacgttgatcggttcaccgaggaatatttgcatagcaagatgcgagcccgtcacgtacccataaaagcccttttactggatcaaacaatgatcagtggtattggaaactgngttgcagacgagacactctaccaggctaagctccaccctgaacagtactgcgaccaggtcagcgatgcgcaaatcaccactctctacaagatgatacgctacgtctgcc

SEQ ID NO: 59947 - DNA, 376 bp, Triticum aestivum
  Clone ID: PAT_TA_59947
gccggccgggcctgggatcaagaaatcgaaaccattcaacaagctcttttcccatcttgtttcgcagcaaacctttgtttgaagagttaaaaggcagcagtgatcttacggaaatcttaattagacgttgccttaagacgggaggatgcacaacagagcggggaaagtaacattgacctggcctggtcgtttgctgttgagttggaggtagaggctcgagatagattggttgaactgtgtttctgaaccatggcagcatgtacatatagcctgctttagtatgcaaaaataagcagtctaaacactaggtccaaatagtatgaattaacatattaatttcatcaaaaaaagaaaaaaaaaaaaaaaaaggccccta

SEQ ID NO: 59948 - DNA, 820 bp, Triticum aestivum
  unsure (1)..(820): unsure at all n locations
  Clone ID: PAT_TA_59948
gccggccggttcgggaattccccttctccttctccttcgattccccacacccgccgccgccgggctctccaccgcgcctccgcgctccaccacggcgttggcctctccctcgcgcccccgcatctctacttcacgctgtcgacctctccaccgcgccggccacctctccacctactccagaggagcgttgccctgcggaatggcgtgacggccgtggcggcgcacgtcccggaggtgctgctgctcgtggtgtccaatcccgtcgacgacctcacctacctggcctgctcgtggtgtccaatcccgtcgacgacctcacctacctggcctgaaagctttcaagcttcccggcgagcagcgtcggcggctccggcaccaacctccactcctccaggttccggttcctcgtcaacacccaggacgtgtaggtgttgatgggctgtaactatttgccactctgaagatataaagtgttatttcttcaggtatcgtatcactgaggcaccctcccacgcacctgcaagcatgaatgaaggacgtgttttgaggtctagtgtaacacaagatcatgatcatgtagatcacgcgcatcagccttccaaagaagcaaacataaggactggactcacaatgaaccatgaagccggcgatctgtgtcaactggatgctttagctttcattttgtacaacgatgtctcatatttgcgtctttttgctgtcattctggaaacctgatgtatggtgccttgtcttggtgcttagacagactgaagtgtatgtatgtgacaattagttaatggaataaaagtggtnntggtgc

SEQ ID NO: 59949 - DNA, 713 bp, Triticum aestivum
  Clone ID: PAT_TA_59949
gtgcggcgctcaggcggcaggtttcgatacaccaacaccttaacacacaatggcatcggctacatcattccgcgaactcatcggcgtccagccctccagcgctagtcccaccgacagcgttctcatcatcattgatgctcagaacgaatatgccgagggtaaactccgagtcaccaacgtcgccgagtcgcgcaaggtgatcgccgcgcttctggaaaagtacagagccgccaatggaagcattgtgcatgtcgtgcatgccacgccagagggcgctcccgtcttcacacccggtaccaagcttgcgcaggagtttgatgagctcaagcccaaggatggcgaggctattatccagaagaactatcctggatcttttgcaaagacggatctgcaggaggtgcttgacaagacgggaaagaagaaggttgttctgactggatacatggcccatgtttgtgtctcgactaccgcgcgtcaagctgcagagcgtggctttgatgttttgatccccgaagacgccgtcggtgaccgaaacatccccggcgttggtgctgatcagttggtcaaggttgctttgagtgagattggcgatgcttttggaactatcatcaagagcagcgacatcgcttaggtaaatgcgtaaagaatattctatttattatataaagtctagaattacttttctgagcaaaaaaaaaaaaaaaaggccccta

SEQ ID NO: 59950 - DNA, 694 bp, Triticum aestivum
  Clone ID: PAT_TA_59950
gccggccgggcttcgcgacactcatcccaattcgagagcatatctaagcaacaatatcatcatccgttacctcgtcgcaccaccaccaaaccagcaacatggcatggcccccctcctccgggtgcgtcaaggtcgctgcgtacgtgtcgtggaatgtgacccctcgccaggccgctaaagctgcatttggtgacacggtcactgttaactcagcaagaaagtgcggtgctcccgtgcgcaacgtagatcttctctcccattcccgctgtgcgcatgaacacctattcgaccaaagaggagcagatgaacgtctactacctcaacgagcgcgatcgcaacagccccgatgatcttcctgtgagcgccatagcacactcagatacttgtctgcgacctcgtccccttcaccaacaaggcggattactgaagcctggacaaattgatctgtatctctgcgatcatctgcatcctgactccaaaacgtgtcggatcacaacgttaaccgctacgacgacatcctacagcatctacttctcatactacgcacacttcgcccctgattggacctacctcagctacaaagatgcctatctcgaactaaccggcttcatcccaagacttcgagggcgcctacggcaggtcaagcttcagccctatcgtcttccccttctatatattctacaccttctacctc

SEQ ID NO: 59951 - DNA, 434 bp, Triticum aestivum
  Clone ID: PAT_TA_59951
gccggccggttccggggtgtgggtgtcagcttgttcccatgtttgcatgtttctgcaggtcggtctgagccgttttgcgtgggggaagcatcttgattgatccaaagccatacgatggccgtgatgccagggtgccatcccatcggtggtgttggggtcgaagtgtgcccgtcccgaactaggtacccggtcaaggcgtttggtggtgcagggcaaatcggaggatagcagagaccatattttggaaccaccacgaccgttgtaagcgtctgtagaggttgcgagatttgaagatggacgttgcagtgtaacttgtagagggtggaagtggaactcgggatggaagcctgcgaaacgagatgtttgttccaacaagagttagcatcgaatacatttatgggccgcgacaaaaaaaaaaaaaaaaaaggccccta

SEQ ID NO: 59952 - DNA, 726 bp, Triticum aestivum
  Clone ID: PAT_TA_59952
gccggccgtctactctacctggcgatccaatccagtccctctccccgacctcaccgggaaacctcccatcgaagcgaagccaaggctctctcctcctcctcctcaagatgcagatcttcgtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtggtatgcagattttcgtcaagaccctgaccggcaagaccatcaccctggaggttgagtcctcggacaccatcgacaacgtcaaggccaagatccaggacaaggagggcattcccccggaccagcagcgtcttatcttcgccggcaagcagcttgaggatggccgcacccttgcggattacaacatccagaaggaatccaccctccacctggtactcaggcttcgtggtggcatgcaaatctttgtcaagaccctcactggcaagaccattaccctggaggttgagtcctcggacaccattgacaatgtgaaggccaagatccaggacaaggagggcatccccccggaccagcagcgcctgatctttgccggcaagcagctcgaggatgggcgca

SEQ ID NO: 59953 - DNA, 679 bp, Triticum aestivum
  Clone ID: PAT_TA_59953
gccggccgtatcatcaaagcagataatggtgtggagatttacaagagagcatcatgtatcctgaaaggcccggtgaaccagagtgtgcccactacatgaggcaggggtactgtaagtttcagatgaactgcaaataccatcatcctaagaaacagtattgaagtcatccgcgccgaccacttgagcaaagcagggacacgctggttaccgcatgaatgctaccaacggaaagcattgtcttgatgtgtcgccaggtgttgttagagcaggctggctggctcaaggaggcggtgcgtgtgagtgtgactgacgactgaagagagaggtgtaggaggattctgatgaaccaaccaaagcttggagctaatataatcgtcgtcgtttttctgggggtctatgagcgagtagttgctagttatgtcggttttgagcgcgtttgagctatgttggtgaaaggcactttgctaccgattatgcgtttgcaacatactctacctgtgtggacaaggccaggccaggcaatcatgaatttgcaaactgtaatcttggcatgactctctaagtgattgctgtctagctagctaataggtgtgggatgaacacggatgagatgagatgcgattactacttacttagcatgatgatattgtgacgaaaaaaaaaaaaaaaaaagccccta

SEQ ID NO: 59954 - DNA, 436 bp, Triticum aestivum
  Clone ID: PAT_TA_59954
gccggccgttactcatatttggataacaagtatgcctcttgcgtgggcagaggtcattgaccgcgaacacttttgagatgcccaaatcatgagtgcacacgcgccaatcatttgaaggttggcaaggctgctgccatacggtgtctgttgctccagtcgatgttctatgagatgtttttctcaacaacacaggaaacatgcgcaatgcaatctcttccctcatatcctggccacagtgcatgcatgttaccagtctcgatactgtgaatagaggttatccactagatcaatatacactggaacaacatgcttctgagtggatctttcgtcaaattatgtgcctatttctctggaatatgaaagacaagattatgcttatacttaaagaagcaaattaaagctatgatgtgaaaaaaaaaaaaaaaaaaggccccta

SEQ ID NO: 59955 - DNA, 771 bp, Triticum aestivum
  Clone ID: PAT_TA_59955
gccggccgtcaaatcaacatactggggtaacttcatccctgttacgattttcttccagtctatcttcggttaccttgttctctgcattatttacaagtggtccgttgattggaacggtctcaagctcaatcctcctggtctattgaacatgctcatctacatgttcctgcaaccgggaaccatccctgagggccaagagctctactctggacaaggttttgtccaagttgttctcttgcttctggcgttcattcaggtccccattctcctttgcctcaagcctttctaccttcgatgggagaacaaccgcgcacgcgccaagggttaccgtagtataggtgaaacttcccgggttagtgctttggacggtgacgaagatgagcccaacggccatggcaacagcttcgatgaggatggcgagggagttgctatgatctctcaaaacattgatgaggaacacgaggagtttgagttcagtgaagttatgatccaccaggttatccacaccattgagttctgtcttaactgtgtttcccacactgcttcttacctccgtctctgggccctgtcccttgctcatcagcagctcagcattgtgctctggtccatgacccttggtcctgctctgaagacgccaggcgttatgggcgtcattatgatcgttgtctgcttcactatgtggttctttttgacattgctattctcgtctgtatggagggtaccagtgccatggtgcactcccttcgtcttgcttgggtcgagtcgttctcc

SEQ ID NO: 59956 - DNA, 147 bp, Triticum aestivum
  Clone ID: PAT_TA_59956
gccggccgttccggaaagaaaagagattccccgcctctcctactccaacgagcttttctctcacaaggctactccacacatcatcgagctgatacagtaaagaccaccagtccctcacccaaaaaaaaaaaaaaaaaaaggccccta

SEQ ID NO: 59957 - DNA, 729 bp, Triticum aestivum
  unsure (1)..(729): unsure at all n locations
  Clone ID: PAT_TA_59957
tgtgcggccgctccgaggnccggccggtcacatctaaaaaaaggaaaaaaaaaaaaaaccttctacgaagtacggtatcgacacctttggccccagcctgtgggatggcgctacccctgagcttgccgttaccggccccaatgtcggcagcaacatctggctccaagttcccttctccggcactgttggcgctgcttgctatgccgcccacgaagtcggtattcccgccattgccttctctggagcttctggcggcaacactgccttcaacgccaaacccgttcccgagcgtagccttgtctacgccgagcttgcaaccacgttcgtcaagaagattaccgactccggaaagccttacctgcccaaggatgtttacctcaacgtcaacttccctaaggttgagggcaaatgcactgatgcatccaagttccagtgggtgctgacccgcatcaacagtggcctgctgtccgaacgtgatactgagtggtgtggcgaggaccgtcttcctactgagactgagattgctctcaagagtggctgttatgcttctattagtgttggagatgctgccgataagaccacagctgatgctgcgagacagaagatcgtcttggagaagatcaaggacatgcttgtgtgtgttgactgagcgagggtgtgagttttatagatatagtttttaaacccaattgatttatataactcaaaaaaaaaaaaaaaaaggcccta

SEQ ID NO: 59958 - DNA, 618 bp, Triticum aestivum
  unsure (1)..(618): unsure at all n locations
  Clone ID: PAT_TA_59958
gccggccgtacaattcaaaagagactgaagacgaagccgatcttcaagaaagataaacctaagggcctttcatctttaagtcaagagcaaaaagctgactacactaatggcgacttggtcgaagtggcccccaaaaaggctgtgtccaagggcatcagtcctgtcaagaagctcaagatgaacaagcctcagctgggctcacccaagccaaaatccaatctcatcagggaagctaccggggagtctgaatcttctgacaccctttcatctccaccacagtaagccttcgctcaacaggtttgagcttaatcgtatcctgtaaggtgcagtacggctacaatggcgtcacataaaggctgcatttccaacgctctcatgaccacaccgatcagcatacagttatggttggatacatagaagcaggcaatccgttacgcgaccaaggagacacttgcttatcgaggttctttattattcatttgtattattctcaacaacattgcattggcacggcggagtggttggctaggatgaccgggaccggatatttacagcatccacggaaaagggaccggngcgttattggcgtaccaagtataacaattgatactttcagaa

SEQ ID NO: 59959 - DNA, 522 bp, Triticum aestivum
  Clone ID: PAT_TA_59959
gccggccggtcaccggtttcttacgacctctggcttgcgccttcagttggtgccaacaacaagtacgagattatgatctggctgggaagctatggtggtgctggacctatctctgaccatggatctacgccaattgctacgttgactatcaacgggtcgcagtggaagttgtttcgtggacccaatggcgatacgactgtctactcttttgtgtcgaccaagaatttgggcaacttccagggcgatcttctcccttttcttacgtaccttaccaagagtcagggtgttccaagtagctacgttgcgactagcttccaggctggtactgagccctttgttggatccaactgtgtctttactacttctgcctacagtctgtctgtcaactaaaggcctggctggtcttttctttctccctttctctttttgtgtatattataaacaagtacatagtattctacgcagtatatagtaaatactcactctgctgtctccgaaaaaaaaaaaaaaaaaaggccccta

SEQ ID NO: 59960 - DNA, 157 bp, Triticum aestivum
  Clone ID: PAT_TA_59960
gccggccgtatactcaaaccgagcttgcttagctgtggtcgcggggatcataaaatgattgcccaggaccaagcaggaccgggaccttgcctcggaaaagtctcgtcaacctgatgcacgcagccgttcgaaaaaaaaaaaaaaaaaaggcccctag

SEQ ID NO: 59961 - DNA, 387 bp, Triticum aestivum
  Clone ID: PAT_TA_59961
gtgcggcgctcgaggcggccgtcatccaattcttgagtgctacctcttttcattcatcccatcaccaggtagtacaatcattgccgttttgcaagcacactgacggggaaccctacagctgcgtgcgattcaggcgccacagcaagtgcagctgcagcacattcttgcctgctttttaaccacaaaattgtagtattactgttaccatcggaggcgtcgtcgtgacaagagttttgttgtatagaagaaggggaatgccgtggtacagtacaaattaagtaagcagcgcaccgtgcattttgctttccgcggagatggtgcaaatcagctcattcttaaaagatatggactgctcgattggaaaaaaaaaaaaaaaaaaggccccta

SEQ ID NO: 59962 - DNA, 609 bp, Triticum aestivum
  Clone ID: PAT_TA_59962
gccggccgggtccggtgctgtagaagaggctggaatagttgtaccgggatctgcttgaactgtaataatacctaaacaacagagttagaggcttggcgatcctgtttggtctgtggctgaatttataatctgaagttcaaatttcacaggtgctaataggcttttgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccccaaggcccgcggccgctcaaaaaaaagggaaccccccgggctgaagaaattcaaaataaagttaatcaaaaccgccaaccccaagggggggcccggaaccaaatccccccaaaagggagtcaaataacccgcgcccactggccggcgtttaaaaacgccggaacgggaaaaacccgggggtaacccaactaaacccccttggaaaaaacccccctttccccagttggggaaaaaaaaaaaaggcccccaccaatcccccttccaaaaagttgccaaacctaaagggcgaaggaaaattgaaaccgttaaa

SEQ ID NO: 59963 - DNA, 670 bp, Triticum aestivum
  Clone ID: PAT_TA_59963
gccggccgggttcaagaatgtgacaaagattgtaacctatttgccaaaagttaaacaaataataaagtatgacttgtgtgcattcatctcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagttaaaaaaaaaaaaaaaaagggcccttagggccggggcgtttttaaaattatggattccccgggtttgaggaatttctttttaagttttttgattccggtcaccttcaggggggggccggttaccaatttccccttttaggggttttttttacggggtttctttggcgttttttttaaaaggcggggattggaaaaaccttgggtttcccaattttattccttttgaaaaaattccccttttcccaatttgggttattacaaaaaaggcccgaccgttttccttttccaaaaatttgccaaccttaattgggaattgaaattttaaaggtttatttttttttaaaatttccgttaaattttttttaaattaactttttttttttaccaattaggccaaattgggaaaattcctttttaattcaaaaaattaacccgaattagggttaattttttttcaatttggaaacaaattccatttttaaaaa

SEQ ID NO: 59964 - DNA, 800 bp, Triticum aestivum
  unsure (1)..(800): unsure at all n locations
  Clone ID: PAT_TA_59964
gccggccgtactctcgatcgagtggtgggatgaaggacttgtcgaaggcgggagctacgatgtgctcgatgatccctccaagctcaaattcacgacacccgatactattattaccgaatacatacagcaccctgttgctcttgagccgcctcaagatggacatgttccagctgctaagccaatgttcctagtaaagaaggaacggcaaaagctacgacgacaacgcagaatggctgagctgaaggagacgcaagccaagattcgcctgggactggtgccagcacctcctcccaaggtcaagaagggcaacctgatgcgagtcctcggtgacgtcgctgtgaaggatcctaccgccgtcgaagcacgtgtaaatcgtgaaattgccgaacgccaccaaaagcacgtcgaatcaaatgaggaacggaagctcaccaaggatgaaaaacacgaaaaattggcagcaaaccaacaaaaagacgccgaaaagggaattcacatgctcgttttcaaaatcgggagcctggcgaacggacaacatcggtacaagatcggcatcaacgctgatcaactggccctcacaggtacatgcatcatgcaccccgagttcaacctggttatcgttgagggaggcgaatggggtatcaagaagttcaagaagctcatgcttaaccgaatcgactggaccgagaattcgccgtcaagagaccgagancgaaagcaagcgcaacacgcgactggcttctcgctgaaaagacaccggcgagctcaagatatgntcacgaacgaatgcagctcatctt

SEQ ID NO: 59965 - DNA, 801 bp, Triticum aestivum
  Clone ID: PAT_TA_59965
gccggccggtcaatccaacactcccaatcaataaatcaccatggcctcagacgcacccgccctcaagcctattcacagtcttgtactcgacacaggccctctcatcaagaacgaccctcccgcaaataccctccgcgccaaagccgaacacctctacacccttcccgtcatcatttccgaaatccgagatgccgccactcgatcgagagtagagacgactcttctcccctttgttacccttcgatcgcccacccctgcaagtgtcaaggtcattcgggattttgcgcgcagaactggtgatctcgcagttctcagcaagcccgatattgaagttttggctttggggtatgagcttgagtgcgagagaaatggaggagattggagattgaggaatactcctggtcaaaagggtttgaatgggaaaccaccaaagcctgctgacaaggaggagtctttagagagcgctaccgataagttgaccattgagtctactgcagagactgccggggagcctaccgccgagtctgagcctgtcgcagaatctggaaccgaaaagacagagaccaaggatacagaggcgaccgcagagactacacaaactggagagacaacagaggctacacaggcagcggagactacacagaccacagagacagaggcccccaaggaacccaccacagagtccacagagacggcagagcccgtcaaagagtccgcagacaccgagtcaccccaagtttccggcgaaaaggtcgacgagaccatcgaagccgtcgaggaagcttctggaggcgaagtctc

SEQ ID NO: 59966 - DNA, 710 bp, Triticum aestivum
  Clone ID: PAT_TA_59966
gtgcggcgctcgaggcggcatatatcaatcaatctgcgaattactatccttgatcgagatgccgtcgccaagatgctctacgaactgattgccattgtccgaccaggcagcctcttagaggtgaaggaaatcgcccaaactgtcggttccctcgtcctcaagaatggtggagtcgtccgcggtctcgccaactggggtgtcttctcgctgcccaagcccatctcagtgcatcaaatgaagcacacccacggccactacttcgtcatgcgatacgatgccgccgccaaggtccaccacgatgttcgcaacacactgcgcctcgagccacgtatgattcgtgccgcacatgtcaagctcggagacggaaagcttgagtccctctccagattcggcccgccaaagtggaagacgacaggcagcgaggcgtaaggaggggcaaagaattttaggcgtcacaaatggagcggaatcaactttaatggcaacaatgaaggagagggaaatatcatgctgtatgatacgaaggaaaccttgacaaagagtatggactttatggcttggaaaagagtctagttcccagctcaggcatcacacgatgccgtgtacaacaggtatgctgcatcaaaggacagcagcaatcacggttacatgaataggtactatagaaatccaaaatccgcatctcaaaaaaaaaaaaaaaaaagccccta

SEQ ID NO: 59967 - DNA, 851 bp, Triticum aestivum
  Clone ID: PAT_TA_59967
gccggccgtaatccaagatacctctcttgagatgtctgtgcacgttggtattcgtcacttctctagcttccttaagcaggttcacgacatgcttgacgacgatggtgttttcttccttcagtacgccggtatccgcaaggcttggcagtacgaggatctgacctggggtctcttcatgaacaagtacatcttccctggcgctgacgcttctactcctctcggctgggttgtcgacaagctcgagggtactggtttcgagatcaagcatatcgataccatcggtgttcactactctgctactctctggagatggtaccgcaactggatggacaacagggacaaggtcgaggccaagtacggcaaacggtggttccgcatctgggagttcttccttgcctactccaccatcatctcccgccagggcagtgctacttgcttccaaatcaccatggttaagaacatcaactctactcatcgtattgatggtgttgagacccaattcaaccttcacggtgctcttgacaactgccgtgctgaccttcagtcttgggctgctaagaacaatgtcaagactccctctgagctcctgtaaagttatggctgagagtctgacaccaattgggatttcccttggccgtgcccgaaaaagcacagcttcaaaaggatgcctcctaatgagaggccagtattgagtgatctgtcacacaattgataatcaaggcgaaaatgataactggattcatctcgggcatggttaaaccggaatgcgcccccttgtccgatgaactcggttgaggctggcctagacgcaacgggcaagtttcatatttcatgatagatgcctaacagca

SEQ ID NO: 59968 - DNA, 648 bp, Triticum aestivum
  unsure (1)..(648): unsure at all n locations
  Clone ID: PAT_TA_59968
gccggccgtcaactcaattgatggattcttttgactagtattcattatggttcgtaaaacaaagccgcatatacgaaatggtattctgaatctggtactaactgctcgtcgaatttttgtatactcagtttgcagctcatcaatcagcaacagctcggctgatcatgatctgcgcctcccgaatggcacctacgcgctcaccgcgcaggactgcatccagtgccgctgcagttcaaacaccttccagctaaattgcaccgcactgcaaggaaaaaagggatgcccagcagtgcggccgtgcggcgaagggctcaatcttgggcagacaagtggcgccggttgcgactccaagatgtgcgcttacagtggttattccaacagctcttcactcagcatacacaccactgttttcaagaaccagacagcaccagcatgcgagaaagcaggatcttcgaggtcggtattggcagggtccatgtggaggatacctgctatctccttccacatggtgttgatcttggtatgcttcctttgataccgnngaaaaaaaaanaaaaanaaaaaaaaaaaaaaaaaaaaaaaaaaattgcttttacctatataacctcagttgttgttcctcaaaaaaaaaaaaaaaaaaggccccta

SEQ ID NO: 59969 - DNA, 765 bp, Triticum aestivum
  unsure (1)..(765): unsure at all n locations
  Clone ID: PAT_TA_59969
gtgcggcgctcaggcggcgtccgggaagcatgcaagaatccatttgagcttccaaaactcgtactccaacgtgttctcctctctcaagtgtgtgtccgtgtgctagtaacccacagcaccgtttctcgcgggaggcatttcatatacacgccattaacacgtacagtacagacatccttcaacgacaatcatgtccggcgctcaagagcaagggctgaagctgctggtgccacggagcggcgtgagcatatacgccatccttcatcggcggtgtatccctcgggctgctcgacatcgctatcgggtgctatcttccttggttcgaagcgataggccgccttgctggcacgccgccgttcctagacgcggcgaggacaccaaagttggtcgcgtgggcggggcgtttcagggccgccgaggcggtcgttgcgctgctgactccggtggacaaggtggaggagtacatcacctcggtgctttatccaaagtgggaagttgcactaactgcaccggcaactaattagagatcgtgtcgtctccttagtcgtagttacattgcagttgctgtgcttgccttctaaatggagttggtgttttcacgagttgttgagctcgttgaactgttggttacttgggttggttagtgtctcgntcgtcatcgatggtgcgcacgcatacanctgtatttgggatttgagctgttgttttcgtgaataaacccgtggnctttcgtggaaaaaaaaaaaaaaaaaaaagggcccctaa

SEQ ID NO: 59970 - DNA, 555 bp, Triticum aestivum
  Clone ID: PAT_TA_59970
gccggccggtatcagacttcctggcggcgggcccggcgttcggcgaggcccccgaggcgatctgcctggccgtggtgtcggacgtgtcgagcgcgagcggcggcgccggggtgtcgggcgggggcgggccggccatcatcctgggcagcttccagcagcagaactaccaggtggagtacgacctggagaagaaccggctcgggttccggccgcagccctgctcgtcgtcgtcgtcgtaggctccttcctcctcgcagcggcgagctggactgggaccggagcgcgggagctgtgtagttaccggctcctgcttaattacttaattaatccacgagagtagaggcaggcatgctcgcttacgtactgtactgcatccaatccagtggaaaagttagtgacagattaagctgcccggtcgtgcaggcagctttcggaattcggatgcagacccccgcgctttcgttattagatttgaggatttcaattagcaataaataaaagcgaacggcactgcgtgtcttcttttgctaaaaaaaaaaaaaaaaaaggccccta

SEQ ID NO: 59971 - DNA, 300 bp, Triticum aestivum
  Clone ID: PAT_TA_59971
gccggccggtcattcaaaatagatcgctaggtgtagcatattgcattgtttctttcttttgttttttgttcttttggttctctgcaagattggtcaagtcgtgattccatggtcagtttactaactagtagaaagtagaaacactatgtaaatagctttttggtgtaaacaataataacggtgatagagttgttgattgttaaaaaaaaaaaaaaagaaaaaaaaaaaaaaaaaaaaaaaaaggacatggacaactatgtaaggttggtgttttaaaaaaaaaaaaaaaaaaggccccta

SEQ ID NO: 59972 - DNA, 541 bp, Triticum aestivum
  unsure (1)..(541): unsure at all n locations
  Clone ID: PAT_TA_59972
gccggccgttaccggccagtacgcagttgcttttcttctcccttgttctgccccggcctagctgctccagccgaaggggggcggctggcggcgacaccgcatcagccaccaacatggcagcacggcaacacctgtaggcggccgcgattggtccaggcgttcatccgtcggctgctctgctcgtccccgacgctcacggactggattggagtttggagaggaatggagggagtagatgaagaacaagggcgttagcttatcttgtgttcttgtaatgtattgaagaacaagtgtgtcggctaatttgctactagatgctactgccacttatttgtaatgtaatcttgacacttatttttggacggagggagtagatcgtagagttgtattgtaatattttttgttgctttgtaatctttcttaattgttagagatattgccgcaacaatattttgctaccattgtcgatatatagtcattgactcattgatattgccnnnaaaaaaaaaaaaaaaaaaaaaaaaaaaaaaaaaggccccta

SEQ ID NO: 59973 - DNA, 311 bp, Triticum aestivum
  Clone ID: PAT_TA_59973
cgactatcaacgccgttaccttgtcgagccttcgtcttccccaacaaagcccaagctcgccaaggagaacaagtagaaccgccccatgtccccgggtattcacctccaagctgcccacaccatccgttacaacgccaagcgaacgcactgacaaccagatccccatcggtatccaagatactcgccatctcccgtcgtccgcccccagcacccgacgtttatctctcctgcggatgatatcacgactccccaaggaaagcatggattgacctgccatgccctgaaccatgccaccgggttgctacttcacg

SEQ ID NO: 59974 - DNA, 543 bp, Triticum aestivum
  Clone ID: PAT_TA_59974
gccggccggtcctcgactctgagaaaaccaaagcccttgctaacttcgtcgtcctccaagccggccgaaaatctgcctgaaatccgcgccgctccctccagcccaccaccgcgctcaagttcgtcgcggctccaatggtgaccaggtggagccagaagagccccggcctcaagatcctgtggatctggaccctgggcaccgccgcgatcatgatcaccaacgtcatgagagacgacgagttgacttgagcagcaagtgaagagtttgcttgagcttgagcgactctacatggcaaaattcgcggaagcccgcgttttgccagccaagactaaacggttcatcgtttgatgtctccagaaactttttttagggcatttttattggtaaagcagtgaggtatgtacctgcgtggggcatgaaactgtggaactgcttggttccaaatactgctgcctcttgtacctgtctgttgcttagaaatgaatctgttactttacaaggtcaagttttttatggcaaaaaaaaaaaaaaaaaaggccccta

SEQ ID NO: 59975 - DNA, 243 bp, Triticum aestivum
  Clone ID: PAT_TA_59975
gccggccggtcctctagtgaaacagagctgtacaagctttatcctgaatggacttctcgtgccagacatttcttcgggtgctgccatgttttcgttgtaaagctgggaattgctgttcctgcttttacctgcacatacatctacattgtgggagattgtaatcttgtacaccaattgttatcggaaatgtcatcggctgggtctttctggtggcgcgaaaaaaaaaaaaaaaaaaggccccta

SEQ ID NO: 59976 - DNA, 743 bp, Triticum aestivum
  unsure (1)..(743): unsure at all n locations
  Clone ID: PAT_TA_59976
ggccgcttcgaggcccggcccggtttcgggaggctacatcatcatcaagcttccaacgtcaacttatacgccgcccttgacctttgagctcgttgacggccccatctcttcaccatggcagaatcagagctcgccctcaagtttgccccctttattgggatggccggaattgcagctgcaatgatcttcggatgtattggagctgcctacggcacagcgaagtccggcattggcattgctggtgtcggtacctttcgaccagatctcatcatgaagtgtctgattccagtcgtcatgtccggtatcatcgccgtctactcgctagtcatctccgtcctaatcgctgaggatctcgacccttccaagaactacagcttgttttcgggctttatgcatctcggatgcggtattgcagtcggcatgactggtcttgccgctggttactgtatcggaatcgttggcgacaccggtgttcgtgcttatatggaacagtcccggattttcgtcggcatggtcctgattctcattttcggcgaagttctcggtctctacggcctcattgttgccctgattcttaacaccaagagcaagggttaaatggcacacgattcgcatcgcaatcacacacccgctcatatgacctttctcaggnggaactgacatgaaaattgaaggagcttcgagctgccatccggatacggngataaaacattgtttgtacatcgggcatggcgttattggac

SEQ ID NO: 59977 - DNA, 619 bp, Triticum aestivum
  unsure (1)..(619): unsure at all n locations
  Clone ID: PAT_TA_59977
gccggccggtcttcttagtcggcgttgcacatgtccgcagattcttgttgtttttttcccctcgaaacatatatgttcgcagattgatcggcgtatatttcgcaccatggctgatggttcctgctcgttttcccctttgcttcgatcgttcctgtgatcccttccggatgcttaatgattgtgacttcacttttcgtgactgttagcgactgcctgtagttctgtttccgtcagattcttcggctgttatttgtcggcgattgctatggacacgatgtctaccatgtgctcttgttgatgttgatcactgggcttcnaaaaaaaaaaaaaaaaaaaaaaaaaaaaaaaaaaaaaaaaaaaaagaaaaaaaaaaaaaaaaaatgaccaaaaaatctccatgaaaatgaaacaaaaaataatttggcggggggcggggtatttgcccagttttctcctgggctttggccccctttgagtttaccttccccaatctgcttttaagtttgaaggggcccctcccaaagggaagaacaatacttgttgggaccttggggaaaaaaggaaggccttttttgcaccgaaaggaccctcccatattcgtcccccccgaaaaccaccc

SEQ ID NO: 59978 - DNA, 270 bp, Triticum aestivum
  Clone ID: PAT_TA_59978
agtcaaccgttcccgggatctccagataaacccccaaggaggagaataacacgcgcgcgaccaagctcggcagagacgcctgccgactacaacaatcatgaccacaaggacgagggaatagagatcgagttcgatcacgagactgaaaggaatgagatgtgagatcaaccagatctctaacacatgtttatgatgctgctatcctcaagctgctccacaagagagcaccccgacagagaacggcccttcacttcccagtagaactggagg

SEQ ID NO: 59979 - DNA, 848 bp, Triticum aestivum
  unsure (1)..(848): unsure at all n locations
  Clone ID: PAT_TA_59979
gtgcggcgctcgaggcggccgtttcaaatacgggatcgaccgaccagctgttcccgatcttttgaggtggcatttaagaaccgatacgatccccttcactttttgtttcttgattcttttgtattatcgtcaatcctcaaagacttaactcaacagtcttcccaaaccatactcttaatactcttcctcctccctcgaacaaaccctctcccatcttggcttccaccctcgctctacatctcgaacaacacacaaatcatgctcacatcaaccttcctcctcagccttatcggccttgcagcggcctcaccggtccagcctcacatcgtcaaggaccccaaatacccatcacgcttgacatcaaagggcttcaagcttgtcgtcaacgtcacagatccttcgttggactttgatcctcccatccaaaacttcgagctcaccggcatccacacaggagccggcctcgcccttcttggtatcaccgagaaggacggccgcatcttctaccagaacggcacaaaagaggagcgtcaaaacggcgaggctaccgtcatcagcgatggtggtactcccttgactcccaacggcattgctctcgttgccgataagaagaacaagaacctcttcggtgctacgctcaacttcgagcctggtactgctggtgtccaattgaaccggctcgacgacccctacacctacttgttacccgagacctttgttgcttgcaacaagagcatagagtactaccgcggccagaaggtcgtggtcattgagcaagcacgcatcaccatcgacaagacaacaagatccagcgcaacatccccaaggnttgtgcgccatccgcctcg

SEQ ID NO: 59980 - DNA, 471 bp, Triticum aestivum
  Clone ID: PAT_TA_59980
gccggccggtcatcgaacaagggctcatccacgaaagatgtctccaataaagatgagacccctatggagtaaaacactacttcgccgtctcaagggcaatagaatgaagatgacgcccagactccataaacgcgtggcatctgaacctgacttgactcatctatacatgatgttactacctcggacgcctcaaagatacctaggccgaaggagggcacttgccgactctggtcgcctctgggatctcccacaacgtattgaattgtcatctgactttgtcaattacctaaggcagagtgaaccccgcacttgagcgaatgatgtgccacacaatgaatattatggtgaatgagattatgaccatcagatggtcaatacaaagcgatgttgtatcgaccactatcaaatgctcaccaacacgaagcatcactacaacattcaaagataaagaaatacagagattcctctgcc

SEQ ID NO: 59981 - DNA, 555 bp, Triticum aestivum
  unsure (1)..(555): unsure at all n locations
  Clone ID: PAT_TA_59981
ctgtgcggcgctcgaggcggccgtaatcgaaaacagggcgtggaagggtgcttgacacactccaagagatccaggagcggcatgacacggtgaaagagatcgagactaagctccttgagctgcagcagattttcctcgacttgtcggtactggttgaggcgcaaggcgagatcctgaacaacatcgaagtgcaggttacaggtgcagtggagcatgttcagactggaacaaacctccttcagaaggcgagggtcctgcaaaaaaacacgcggaaatggacctgcatagcgatcatcatcctgctgatcatcgtactcgtcatcgtcctctcgttgaaaccgtgggcaaagaagtagggaaaaagaagcatcacgctatgctaggacaatatacgatattccatatcggaaatgcactttggcacatgggagcatgctcctgctattggaaaaatatttcaaaatgtcaaaaaaattcaaacaanaaaaaaaaaaaaaaaaaaaaaaaaaaaaaaaaaaaaaaaaaaaagaaaaaaaaaaaaaaaaaaggccccta

SEQ ID NO: 59982 - DNA, 395 bp, Triticum aestivum
  Clone ID: PAT_TA_59982
gccggccggtcatccatatatgtgtgatcgagatatgctattatcgagttcgtagtattgatgaacagctacatatatggagtctgctttgatgtaatattggacctttttctctgcatgatcaccggtatatgcctagcttcggtataattgatgttgctgaaatcgtctatgtatgcatgcactcatgttgtatttggcgttaagcatttcattatgctggcaacaattggtgtatcaatgttgcatggaataaccagtccatcagggatgagttgaggtcctccttaaaaaaaaaaaaaaaaaaaaaaaaaaaaaaaaaaaaaaaaaaaaaaaaaaaaaaaaaaaaaaaaaaaaaaggaaaaaaagaaaaaaaaaaaaaaaaagggccccta

SEQ ID NO: 59983 - DNA, 531 bp, Triticum aestivum
  Clone ID: PAT_TA_59983
gccggccgtgattcggtcatcagatgaggctatggaagttctagttttagtgttacgtcataaaaaaaatcttgcacatactatgttatgttagtcgtctgacttgtgccattgtgcgtctgcagctcggtgcaaaaaacacagcagaggaccctaaatatgatggcccttctcgtacgtgtagagatcccacgatccaggattcgatagatgactgcccttcttttgatcttggcttctaatggaagtggaagggtgccgtgcatggcttgggcggactgtgtcacgaaacgatcagatctcttgattgctggcgagagatcaggcaaaagcagcagtttttctcaagaaattaggcgcgttgagcgggtgaaggaatgatcctacgtgtgggtggtcactgtacagttttttactcttgtcttgcgtccttgtttatgttagcgagtgattgctttaccttttgagttatactactaatatatagcatggcctttccgttgcgaaaaaaaaaaaaaaaaaaggccccta

SEQ ID NO: 59984 - DNA, 801 bp, Triticum aestivum
  unsure (1)..(801): unsure at all n locations
  Clone ID: PAT_TA_59984
gccggccgtcatcgaagaaatgctgagattcctcagggttaccaattagtctcaaaaaactacctcaaactttattttctattgaatttctagagtttgattgttgaagatatctcctcctatcatgccgtcagcaactcgtcaagaccagatcctattggttccctgggaccccagctcaacagagcacgtcaatcgtatctatgaacagagagttcaatgcggctgggataaacagcgagtcgacggatggaaaacgaagcagacctcaggagaaaagtgtatattttggattacacttcgaccggagaaccctcagacacgtgaatcccttgaacttcatttcgatgcattccccgctgagaaagaaccattggtagacaccgccgacagcctccgagccaagccacgaacgccatcacacacaaagttttacccagtcggccacatctcgcttgaccataccaatgagaagatgggagacttcgttctggaccttcccaagaaaggagtctattggatcaaaaccttttacatttccaaagcactgcgaagcaaaggcatcggacgcgccgctatggaccttgttgaatcaatggccattgacgagccgctatgtgccaagaccctagccatcgacactgcccagaaggatacgcaaaagaggatttacagagagaaaggggtggaactagcttctactaaccaggaatggtatgaacgaaggggatacaggttgattcatacggaacccgacttctacacggaccctgaagagcccccagntgatgctgtattcct

SEQ ID NO: 59985 - DNA, 566 bp, Triticum aestivum
  Clone ID: PAT_TA_59985
gccggccgttcccggatatcgacgactcaaccctcgataaagtcattatccgcgaaatagcctcaatcacttcccgaaatcaatcagacaaagctcctgccggcaggataacactcaaacttcaaccgcaatcatggctcaaggatacgccgtcttcattggcctcgctgtcatcgcagttctttgcgtagcatcgtggttctttgcccccaagggagaaaaccaagtactctggcgatcgtctgccatcctggcgatcgtgagctgctatctcatgtgggctatcacgttcctcgcccagctccatccccttattgcgcccagaaaaggcggcatccgcgaagagtacctcgattagtggacgcttacctataatatgcattgggggaaagaggcggatagaagggagagactgtcatgaggatggatgcgtttgtaattttaaatgttggtctttttgagactcatactgttgttgctgttttctttacggagttggaatgtctgttataccaagccaaagatgcgctctgcacatacaaaaaaaaaaaaaaaaaaggccccta

SEQ ID NO: 59986 - DNA, 379 bp, Triticum aestivum
  Clone ID: PAT_TA_59986
gccgccccgttcttcgatcggaaccactgaggctggccgtgttctgctgaattttgcatcgctactattactactactaccaagcaaatgagtgtttcgttttgaaggcagaggaaatgagagctctttagctgtataggatgttgcaattgttgctcgtttggtaactattccgtactgagaaataagcagtgtgcttgtcagttacgtatctaggatattgttgaaccaccatgtcgctctaagatgaacctatttggcgtacgccacgatgtcttcgttatcagaccaccattgatctacctcgctatgtacatatcccttatttgaaatattcttccttttccttgccagaaaaaaaaaaaaaaaaaggccccta

SEQ ID NO: 59987 - DNA, 342 bp, Triticum aestivum
  Clone ID: PAT_TA_59987
gccggccgggatcgggagtcgttgacgatgaaatatgctgtgaactttttgtgacagtcagaaggtgtcttgagcagagtccatcttcacccccgctgggtgttcacgcgtctgagtatttattgttatgtaaaatatctgctcgcatggcttttggatggtgttgtcttgcttttgtcaagaacttgaaatgtagtccatgagtattgagtttggaacattttgggtttgaattgtgggtatttgagttgcatgtgctggttatggattgcatacagcttataaattacttgctatattaaaaaaaaaaaaaaagaaaaaaaaaaaaaaaaagggccccta

SEQ ID NO: 59988 - DNA, 725 bp, Triticum aestivum
  Clone ID: PAT_TA_59988
gccggccgtcattcaattgcatctcgtctatcccatatccttccatctccattttccgccttcgaggggtcagaaaaggttgaacgagctagagctcgctagcggcgggccggcagccaggagagaggcaatcgtcagtcgtcagtcgggaaggttatctgatctgatggggaactgcgcggcgtcgcggcacgccggggagtcgtgggccgacgacggcgagtgggaggaggcgtcgtccacgtccgaggacggcgaccatcaccaccacaaccaccatgacgcgtcggaggagcacttgtcggaggtgacgatcaggatcaccaagaggcagctgcacgagctgatggagaggaagacgcccggcggccggggtagcagtacccggcagctgctggcggacatcatggactccggggaggtgcaccaccatgacgtgcaccgggaggagcactggaggcccgcgctgcagagcattccggaggccgtcgagtcgtgacgacacttggtggtggctacgtacgtacttacgtacgctgcccctgccgagctctgtgtgcggaacaaattaaagttgccatttccctcctagcctcctttttcttttctcgttcccacagtgtgttctctcatgtccttgaatgggtatccatgggcatgcatgtacaaagattggatttggatagttcgttcaaattgtcaaaaaaaaaaaaaaaaaggcccct

SEQ ID NO: 59989 - DNA, 458 bp, Triticum aestivum
  Clone ID: PAT_TA_59989
gccggccgttacgggatcctgatttcagtgccaatttgcaagaaagtgctagaatgggaaggctaaaacacatcccagtcatgtatatgcgataagaagccgacgatgggctgcgacatccggatgtggacatagtcgccccatagctcacctcttcagaagtgtcgccgcctcggacacgacatcagcggctctttttgtttattctggtagttaaactggacttgatcagaagtgcagaactggcgtttagctccttgtaaatgcgactgcacttgtagtagatagggttaatagtaaacacttagcacataactgaatgctaaaatgtgaagtgtaattcagtttcacctcatgttgtatgtgggattcttggccttggcctgaataatgtggaacgtttaactgaatggaattgtgggccttggtctgaaaaaaaaaaaaaaaaaaggccccta

SEQ ID NO: 59990 - DNA, 510 bp, Triticum aestivum
  Clone ID: PAT_TA_59990
gccggccggtccgggtgacttgtactccaagagcgacggcgtccctgacgccgagaagctcaagccttactacatggatctcattgccgagtacttccccaaccctgttatcaagtggtaaagaacaggagaaaaaataagggtgtaaaaaagaaaaaacagaaataatagacacgaaagcgtagacaatggtttagtttacaggctttttattagcaaggatcaatgactgggagttaattagggataaaattggattgggctaacggattaatacatttctttttattatgatcaaaaaaaaaaaaaaaatgtaatggaagaacacctacttgcttagagcaccatccactgcatttgtgtgttacatacatatctgtatgaaaaaagaaatgcgctttggttggtgtgcggtgacaatagtgaaattgtatcagtttctggaagtcttctattgttttctatatcaatgtgttcatatgggaaaaaaaaaaaaaaaaaaggccccta

SEQ ID NO: 59991 - DNA, 446 bp, Triticum aestivum
  Clone ID: PAT_TA_59991
gccggccggttcgggacacgccgttcgtcaccatctacggcctggcgcagtgcacgcgggacctcgcgccgctggcgtgcgcgcagtgcgtctcggtggcgctgtccaagttcggcgactactgcggcgcgcagcagggctgccagatcaactacagcagctgcagggtgcgctacgagatctaccccttctacatcccgctggacggcgccggcggccgcgccaccaccgatatgacgaaatacaccaagatcgtcgtgcacgcttgacgtagaggctccttgcacatgtccgacgtgcttcatgcctttggtgttgagatgcaagtgagacgtgatatctgagctgcatgcacttaataagcgggggttatgtaagctgtagccatcgcgtgcagcgattgggaataaaattatgcacaaaaaaaaaaaaaaaaaaggccccta

SEQ ID NO: 59992 - DNA, 658 bp, Triticum aestivum
  Clone ID: PAT_TA_59992
gccggccggtttcggattcgcggaaccgactaccgtagccctcacggattacccctcgactttttagaccgagttgccatcatcaacacgcactcctacacccccgaggagatcaagcagattatttcgattcgagcacaagaagaagaggttgacgtgcaccctgacgctctcgccctccttaccaagatcggccaagaggcaggtctccgttacgccagcaatctcatcaccacttcgcaacttgtctctgccaaacgaaaggccaagcaggtcgaagtcagcgacgtgcaacgcagcttccagcttttctatgaccctgcgcgcagcatcaagtttgtagccgagtcggagaagcgcctgatcggcaacactggtgcagtggacttttcagtaggcgctgctgtaagcaacggcgaggagaagatggatcttagttaattatcatggcgagcagagcctggcgtttaaagggtattggaatgcgaaggcgggtaaacccgaagagaggagggttatttgtaccatactgatttggcgtagaatgggatcgaacgaaaactaagctcgcaaagggattacaaaccgtccaggttatgtgtgactctcacaatggaaaacttcgtggttttgaaaaaaaaaaaaaaaaaggccccta

SEQ ID NO: 59993 - DNA, 478 bp, Triticum aestivum
  Clone ID: PAT_TA_59993
gccgagggtttctccggccagcgtgtccaccaggcgccgcaccacggcgtcccgcgtccgctgcgtcggcggccagatgctgaaggagaacggggcggcctcctcggcaccggcggcggcggccttggggagctcgtcggggcccatggtgcgcggcggaggggggcgctcgccgtcaaggaggagacctcccaggcctgagccccggacgagaaccgttcgtttcgattatgcttcgagataaaattcatttgcatctagagttcgtgtgcggcgttggcctctgcttgggatgagttgcctgtaggttgttcgcgtgcctgtgctgttattgttctttcagtagctgctggttacctttttttttagtgtgttcgtttattacttccgtttgtatctgtgaacaagaattatcttcaccttgtcgtggcaatgatccaagatttgaccggaaaaaaaaaaaaaaaaaaggccccta

SEQ ID NO: 59994 - DNA, 206 bp, Triticum aestivum
  Clone ID: PAT_TA_59994
gcgccggaacagacccagcaccgcagaggcgaccgagagaccaccatgacccgcggcagaggcaggggaaagaaggagggcctcacccagcccgcggggaacgggaaccacccccaccccagcaggggcggcccgagaggggacgctgggccccacaacgggaagacagcccgaccgacgaccacgaccccacaggcgaggagaag

SEQ ID NO: 59995 - DNA, 772 bp, Triticum aestivum
  unsure (1)..(772): unsure at all n locations
  Clone ID: PAT_TA_59995
ctgtgcggcgctcgaggcggccgggtccggatcatttcgaagatacgccttagttgactgaataaaacaccatggcagaggaacagattgccgtggaccctgactttgactccgctcttgatgtgcctcttgaagagccatcaacgtcgtcacttcgatctagtctcctacagtttgcacaagagaacggccgtacctaccacaagcttagcgaaggaaaatatgctttcccaaatgatgatgcggagagtgatcgctagatctgcaggataacctgtatcttattacactggatgggaagagagccctcaaccctggagctgagaaagccacgagagtgttggatatgggcactggaactggtctctgggcattggaattcgccgatgagcatccagctgccgaggtcatcggtgtcgacttgagtccgatccaaccaccatttgtgccccccaactgcacctttgaaattgatgaccttgagaaggagtggacatggaagcaacctttcgactttatcttttgtcgcatgatgacgggaagcttcagtgacccacaagccatggcccataaagcatatgaaggtcttagcccaggtggttggtacgagatccaagacatccaaatccctttgttctgtgatgacggcactctggatttcaacacatccccctccatganatggcaacaaggtctcattgaggngtcccgaaagcttggccgccctcttggcgaatctgancagtacaagtcgatcgtcgagaaagccggc

SEQ ID NO: 59996 - DNA, 515 bp, Triticum aestivum
  Clone ID: PAT_TA_59996
gccggccggtcatcggatacttcatcacaacatgacttattatatactaactggctctcatcattacttgacatgcccctctatggtccaatcatcacatggacgtccctgggcagcacaggtgccgcacgtggttgaccagggtgtttgactatagcgatctcttcgtcgccattgctcttgacatcatgatacttccgctggcggtggacgcgtagcgcacgactgcggtgtacgatgactataccctaaacaccctgctttgcctgtctccgacgtgcgaaagactacaccagatgcgcgtgatcgccgaacaagttacggatgttgtgaagtacctccgcatcgtgatcacctctatcttctctcgctaaccaaccaatctgccgaaataatcgaaggatacgatcgacatatgacatctgaacggcgacctacatagtctatataatatatgcatgcgtgcctcttatactcgaggaatatcatctcgtgatgcactcgtacctacttag

SEQ ID NO: 59997 - DNA, 556 bp, Triticum aestivum
  Clone ID: PAT_TA_59997
gccggccggttacacatcagccaccgcagctaccacaaagataactcaacctcaccgaggagaaggaaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccggcatggacgtcgtctacgcgctcaagcgccagggacgcaccccctacggattcggaggctaggccgccaccagattagctagcctgtgtctagggttcgtggtcgttgatgtaatcgcagcatctcgctgctgtttgctatcttctgtagaatggaattgaatggaaattcaactagtttatccttggaaaaaaaaaaaaaaaaaaggccccta

SEQ ID NO: 59998 - DNA, 286 bp, Triticum aestivum
  Clone ID: PAT_TA_59998
gccggccgggtttcaatattaccgtaatgtacagcgtgttattccttccaacaataaactacggtgctattttttagtggtgcgtgaacctgctgtgccataaccatgttatttgaagctctctaatgttaaaataactgaacggagtggaataaaaaatcgtggttgggaaggttactatagcaaaagccattggaattaatattttatatatcggaataattagttttgttttgctgtttcaagaaataaccggttccaaaaaaaaaaaaaaaaaaggccccta

SEQ ID NO: 59999 - DNA, 187 bp, Triticum aestivum
  Clone ID: PAT_TA_59999
gccggccgggtctggttgagctttgagggggtgaggacgtgagagcgtgttggctctgttgctttgctactttgctttacttcttgtacaaaacatttattctttttgatttattctgaagcacatagatataaaagagaacctaattgacctctttctccaaaaaaaaaaaaaaaaaaggccccta

SEQ ID NO: 60000 - DNA, 226 bp, Triticum aestivum
  unsure (1)..(226): unsure at all n locations
  Clone ID: PAT_TA_60000
gccggccgggtccggagaccgggngaaccacatggcgtgagttgcgagtgctaactgtatttgggcgttactgcggatatgcggctggtatgtttacctcgtatgtgctcgcgcgcatggccactggttggatcgttgaattggagccagatgaaaagcagtggatcaagaagaaaagagaagaggcacgcaagcggagtgaagcaaagtgattgagaggcatgtt

SEQ ID NO: 60001 - DNA, 388 bp, Triticum aestivum
  Clone ID: PAT_TA_60001
gccggccggttttcggccaagtcaaattgcataaagtaagtaccagtgggcagtggacaattgatttattgtgcagaaaatattttaaaacaggcgtgcaaatatcaatggtgtatagcatctgtacaggaaacaatgggattgtaagtagcacaaacacctcttcagagctgcttgtgaattgggagtattctgagcttctgactgtcgagatttttttcagtttgggtttcatcgagggcataaactattgtggctggctggctggttggttatttattattataagagaaaaaaaaagcagaggtgtaactaaaaaaaaaaaaaaaaaaaaaaaaaaaaaaaaaaaaaaaaaaaaaaagaaaaaaaaaaaaaaaaaaggccccta

SEQ ID NO: 60002 - DNA, 227 bp, Triticum aestivum
  Clone ID: PAT_TA_60002
gccggccggttctcggcagggctcttcatgtaatttttcttgcagctgtaatgtgtgtggcattgttagctgttcactcagctccattgtacctttcggtcgctgttgcttggtggcctcgtgtaatcctggccggttgatggcttcgttaattcaaagccgggctcctcttgagccttcgttctaaaaaaatttttttttaaaaaaaaaaaaaaaaaaggccccta

SEQ ID NO: 60003 - DNA, 301 bp, Triticum aestivum
  Clone ID: PAT_TA_60003
ccgccggacagcgagcctttacccgggcgggaggggcggcggcgacccgacgaagggagcgacccagaccgggaaggacgggacccagccgaccggcggcagaacccccagcacaccaccaggccggccgcgacgcacaccgggacggaaccgccgcccccggggaccccgccgcagaccgccagaagccgaccaggaccggcagcacaacgagcaaacgccggccgggacaacaagcagcaccgaaacagcccgcgaccccccgcagacgggcggccggaccgccgggacgaccccagga

SEQ ID NO: 60004 - DNA, 158 bp, Triticum aestivum
  Clone ID: PAT_TA_60004
gccgcgcgctttctcaaattacgagacccctacccagctcattcacttaactactcgattgtcaatcatgctttccctcagtgcatacgctcttttggcttcggccaacctatccgctgatgacgacctcattggacgatccagaaccggccctcttg

SEQ ID NO: 60005 - DNA, 374 bp, Triticum aestivum
  Clone ID: PAT_TA_60005
gccggccgggtctggaaaacaaggtgctgagaccgccataactgctatcgagatggcctcactgtttcggatcacttagcctgatggcaccggatgctatggtcggcgagccagcaagattttctcccctgttcgcggctgtcggagttctttttttcccccacatttgtttcaaaatttcttttttattgctgcaggctagtgtttgatgtgtcgtttccaaattattttggtctctatatatgaactctgattgcctgttcgcctttgcccgcaagaaacttgcaagtctagagcatgaataaacatttttctagaagcatgaataaactttttcacttgtgcccgaaaaaaaaaaaaaaaaaaggccccta

SEQ ID NO: 60006 - DNA, 604 bp, Triticum aestivum
  Clone ID: PAT_TA_60006
gccggccgggctgcgatacttcctgatcccggccgcggagctggggcggccgctctcgagcgccgacatggccgcgctcgccgtgcgggcgagcgcagcgatcgcggccaagagccccgagcagcgcggcggcaagaagaacctgcgcgtcgtgccggtgcgcgaggagatggaagactgcgaggacgtcatgttcaacgagaagcttaacgagcggacgctcggggagttcgccgtgtcgctgagtccggtgaagaagagcaacgggaagctcgcagcgcggtcgcggctgatgctgaagcgggctctgagcatcatataggaggctgctaactgactcgagcatttctacaagatagtgttgctcatttttttgttccttcaattttggaaccattcttaattccagaggccaaatggcctaggccaatagtattaaattgatttttgtagatttaggtgggaaagaacaaaaaattgggacagagactgtaaatatctcccagtgtgtatagtacaatactggatgcaaaactaccaggaatgccaaaatttaattcttgagttgttaaaaaaagaaaaaaaaaaaaaaaaaaggccccta

SEQ ID NO: 60007 - DNA, 527 bp, Triticum aestivum
  unsure (1)..(527): unsure at all n locations
  Clone ID: PAT_TA_60007
gccggcaggttccttattcctgaacattacagtacacacnatactattacttctatcttatctctaaccgtcaaaatggctcaagtcctcgttgtctacccttcgggtccttcgtttgacatggactactacctaaagacacacatgcctcttgtcgcatccaagtggggtcctttgggtctcaagagctacaagatcctgaacttccaggagggtgctccctatcaagttcaggccactctcgagtgggagggcgtcgaggtctttgacaaggctgccgcaaacgaggttgccaaggagatctttggggatatcaagaacttttacaacggagagccaatgcttctcaagggccctgttgttgctcatgaaagcgtttcgtcttctcacgcaaaactttgagacttgtctggtgactttggttatctgcatgaatgcggcgggcatctctgtgttggtctgcgtggatacaagagctacctgtctgtttttgtaacgtaaatctgtagtaaaagcaatcgtagata

SEQ ID NO: 60008 - DNA, 567 bp, Triticum aestivum
  Clone ID: PAT_TA_60008
gccggccgggctgcggaaaacactcaaatccctcaccgactaactgtcctctccctataccctagcctccttcatccgatggcccaccttaaacatacgattgacataatcacttgccttcaggatgcccgatattatatggctactacggcggagatcaagtactacccgcccaccggcgttgagaataatgccctccgcttgcggccggctaccgtactgttccgaatatatctgaagaacctaaggaggactgaattggtcatccgcaagctcccctgccatggccttgagagggatatcgcgcatgacttcaagaactacctcatgatccagagctctgattcttccgtcctgcaggaggctgccgaggcgtacctggcgctactgttcgaggacaccaacctgtgcggcatccacgccaagtgcgtcaccatcatgcccaaggtacatccaactcgcccgccgcatccgtggggagcgcgcctattctttctattgccgacggtgtaactggcgatcacttgctcgtgtctgacgacttatgtctgttgaagcccatatgat

SEQ ID NO: 60009 - DNA, 585 bp, Triticum aestivum
  Clone ID: PAT_TA_60009
gccggccgggctccgaaagacaatggatcctcaagtcttcccagcaacaaccaaccagtcttttcttcactttgcgcgcaacttctagcatctgcagcagcagcccgagagcgaagtaatggtgtacgaggcagtgtaggccattgctctcaggagccagcttcagagaagaaacgtcagtgcgaggagccatgagcatcagggtgaaggccaaggagaagtctgaagggaatgagctcatatggggcattattctttggatcgtcaggaaggtttgcccggccttctagaccatgcatgcgcacgtacggaagatcacaagtcacagttgaaggtggactgttttttatgcttggagcagagattttgcataacgccatgtatttttatgtgtatactgtgtagtgtttagccagcgcagctaagtgtgtgtcagttgtagttagtaggaatagttcatcaagatcatgtacttaaaatcagtgtccaagaactccggtcttgcccaacttgactgtacttttttttaaaacaaggcaaaagatttgccatttcattgaaaaaaaaaaaaaaaaaaggccccta

SEQ ID NO: 60010 - DNA, 694 bp, Triticum aestivum
  Clone ID: PAT_TA_60010
gccggccggtaatctgaaaatacctcgtaacgacctagaatcttcctattcgccaccaccgaattgcgacaaccgagaaacatgctgctcattatcttgatgccggcatctgcgaccaccgaactaccgtcgccaccctgaaattgatgaaaaccatgaagctgcggccataaatgagtagacgtcgaaccaggagactctcctacccattacagctcgcgcagaaaagcaaccccacctctgctttttactccatatatacgacttactcctctgcacccagatgaaaactcaacaccgtcgcatccacaatgctgcttcaacgacaacctacatgccactactattcaaatcactatgcctcaagttggagctctgaatgctcccctccatgcagataacttactactacttacatcggcacgaacaccgtcacaagcttgctcttatgcccataccggcgccgagcttgagcttcaacattgccgtaggttgtgcaaacactcgaaaaatatattgtgcttcgagcatgtgggactgacctcacctgctgatggatacctgacagcataaacattctgccgcgacccgaatcgcaacgtattgagttaccttacaccggctcagtgttctgctctcaacatcctggtcacggtaagaatcacgcagatcttcttctcattcgcatctgaat

SEQ ID NO: 60011 - DNA, 607 bp, Triticum aestivum
  Clone ID: PAT_TA_60011
ccgtcgcggtcagcatgtagctcatgactgacgatccctcggaatcctcttctgcttcctcaacaatgcacagcctgaagaactagaagtaagaaactctcccccggagccaccctcatcaggcggtaactccattggtgtcatatcacgatttgtccgcagcaacctaatgtcgagtgtattcatgccttgaacgtatatattgatcacgtgccaccaagtacatatgatcttatatattgttaactactgttgcaggcattatcacgacagaatacatgcagtctttattatagtgagaatgagataaatactcgtatctatcatgcctatatggaaactggagaccttaatgaatattatataatcaatctacattattattttaagaaaaaactgaaataaggaccgtaaattgcaagccgatcaataagtaaagaatcccccgaaatgcatgaaatatatattcattttattaatcacgacgaccacaacgggaaaatcccttatacaactcaacaaaaaacgaagataattacgagcgctcactgagcgtggaactacagcgcactaacagagaaagagcagtcgaaagccaaatgaataa

SEQ ID NO: 60012 - DNA, 518 bp, Triticum aestivum
  Clone ID: PAT_TA_60012
gccggccgggtacaagagaaacccatagattattgtaggttcctaagaatgatgatgattacactcggagcaagccttgttgcgacgctacaagtgttgccctcctcctccccaagggcaaggtgaaggaaggtgcctgtgtggttcttctgcagctcgtagcgaggattgctgtgtccaacctgcacaagaatgccaagaagtccttctcggagacgtaagccatggcgcatgtttctgccatgatttcctttggttggatttcgtggatttaggtgttgaaaaattatgggctgtggacgcaggattaaggacatgtacttgcactacaacgagagatctgggctgcttctttgtggcttccaaacttgaaatgtttgtttggaagttagtttagttttttgttgtggattcacagcttctcacatgtaccatcctcttagacctttagatttccaaagaaactaaatgaagatgtggtggtatggtctcaaaaaaaaaaaaaaaaaaggccccta

SEQ ID NO: 60013 - DNA, 349 bp, Triticum aestivum
  Clone ID: PAT_TA_60013
gccggcaggtttccggacctgcctgggaaggacatggcgttcgtgcagctcaagaccgtggcggccgccgtggtgaggaacttcgaggtggaggccgtgccggggcacgtcgtggagcccaagatctccatcattctccacatgaagaacggcttcaaggccaggattaagaggaggcacgtgatgaacagctgattcagagtaacaaagttagcctgtgtgcccgctctctgtctccatcgtaacaggcttatgactgtttcgaataaatatctacaaataatttcctctagaaaaagtctatctataaataatggtacccgaaaaaaaaaaaaaaaaaaggccccta

SEQ ID NO: 60014 - DNA, 360 bp, Triticum aestivum
  Clone ID: PAT_TA_60014
gccggccgggcctgccaatctacatgttgccttgctatctctgtctagaagaggaagagagaacggaccacatcctcattcagtccaatgtgtacactaagacagacttggcatatggttccctctcgtaatgatcccatcatccaaactcgatggacacccttgagaaccggtggttaagaactagaggggtgatccctaaagcctaaagagaacaaaggatggtttgacactcaagtgattccaattccctggaatttatggaaaaggttgaactctcgtgtctgatcacaataggtgtgtttgacttgtgagtggttgctttatcctatatatcattcacaatccctcctcgaaaca

SEQ ID NO: 60015 - DNA, 651 bp, Triticum aestivum
  Clone ID: PAT_TA_60015
gccggccgggaatcaataaatgatttacttgcccaaaacttttctatttttatattttgtccgcaatcatgccacctgaagttgtcttataaaccaatggtgtacatcatccgcaatccaatcgtagaaatgtaattacaataaatctctcaaagaaatgatggaaaaaagtttttctagggtaactggaccgcaccacacattactcttgtctaacaacaatattttttccatgtttaggacatgggagttaacttccccatggacgggagctgagataatggtgccaacgaagtttatagttggcgacttagatctaacatacaatattgcaggcgcaaaagatttcattaacaaaggtggcctcaagaagtttgttccattactagatggcgtggtgataatgaaagatgtcgggcatttcataaatgaagaaaagcctgacgaaattagtgcgctcataatcagctttataaagaaattcaacaaaactgaagtgtatcgaattataatgaataaggccaaaatgtgcatggttattggaaaatttatattttgaccactgtattattgtgttgagaaagtacggacatatttatgaaagtatatttttttactctccactaaaaaaaaaaaaaaaaaaggccccta

SEQ ID NO: 60016 - DNA, 620 bp, Triticum aestivum
  Clone ID: PAT_TA_60016
gccggccggtacacatcacacattccctctctcgacaatctgtccgactccggccatctctgcgtgaactcaccggacacgcgcgtccacggttcgtaacgacgagaagatgagttctgctgatcggtgcgaggcatagaggatgaaggcggagtccaacaccgtctcgcggtcttccaaggccggtctccagttccccgtcgtacgcatcgccaggcacctcaagatcgggaagtacgcccagacgcgtcatgcgatcggcgcccccgtctacctctccgccgtcctcgagtacctccccgctgaggtcctgtagctcgccgtcaatgctgcgcgcgacaacaagaagaccctgatcgtgccgcgccacatccagctgtagtcccgcaacgatgaggagctgattcggcttctgggcgcgtacaccatcgccgccgacggattgctgttcaacatccacaccacgctggtccgcaaaaaggacattgagggcaaggataacatcgtatccgcctcccaagagttctagagactcgcatattttatctacatcatcacacaagatctgaggactctgttatttatctagaaagtagatgctttaaggtgttagagtagtt

SEQ ID NO: 60017 - DNA, 452 bp, Triticum aestivum
  Clone ID: PAT_TA_60017
ggacggcggagttgagggcggccaagagcccctcctactacaagcgtggtgactatgtgcctggattgaaggtggacggaatggatgttcttgctgtgaagcaggcatgcaaatttgcgaaggagcatgccattgcaaatggcccaattgttcttgaaatggacacgtataggtaccacggccactctatgtccgatccaggaagcacttaccgcaccagggatgagatctcgggtgtaagacatgagcgtgatccaattgaaagggttaggaagttgctcttggctcatgacctagcaacccctgctgagctcattgacatgcagaaagaaattgggaaggaagtccacgctgccattgctaaagccaaggaaagtcctatgcctgatccttctgaactctttacaaatgtctaccctaacgctttcctcctccaaccactcccccgcccc

SEQ ID NO: 60018 - DNA, 671 bp, Triticum aestivum
  Clone ID: PAT_TA_60018
gccggcccgggtcgggataacagcttcaaccgatttccacaagaagagcccgacaatacctaagctacgacgccgagacttctgtactcttccggcctcatactaaaaaccatctttactacgctttgccgcgtcgtgcacacgcttgacaaacatcatggctactctgggcggatatcttaacaaaaaggtcctgattgtcacagccgactctcgcattctagtcggcacaatggcagcatgtgatcaaacaaccaacctggttttgaataacgctgtggaacgaatcatccgaacgcccgacaactctgagccctcagctcaagtgcccctgggactttacctcgtgcgcggtgacaacgtatgctcgattggcctcgtagatgaggcgctcgacgatagcatcaactggacagaagtcaagggttcagcgattggcggtataaaacatgtatagactacagtcgacacagcggaaagcagcttttgctacgcattctcaaccttcttattttcacgtatgttcgtttgtttggggtacagcatccacggctggagaactgggagtctcctgtccagtggcactgaaagggtcacaaggcgtttgagtacagggagttttagacaatttatcttggccttcaccatgacggaggctttttcttctttgc

SEQ ID NO: 60019 - DNA, 844 bp, Triticum aestivum
  Clone ID: PAT_TA_60019
gccggccggttcgggatcaagcaacaattactcacaacttcatctcctcatcccttcttcattatctttcaacagccctggtggctcactttaattcacaacaacttttaatttttccattcctctctacgatacccaatcctttcaatttaaacattcaaccaaacaaaaccaacaacatgcacttctacgctcttattcccgctttcatcaccgccgtctccgctcacggagtggtcatctcagtcgagggtgcgaatggagtctccatgcctggtctcagcattgccgatggaactcctcgtgattgctctagcaacggatgtggctcccaagctgacaccgcaatcattcgtgatcgcgaacttggaaccagcgaagccagcgccttgggcaggacccagggcaacggacctgttgatgcgtctgtaatgatcgccaacttccttggaactagtggcagcaacaatgttcccaccaacaatggcagcgactcgggtgttggtgttgaggatgatctctctggcctgaaccgaggtggccgcaacaacaacagaaagcagagacgtcagctaggaaacctcctcggtggactcttcggcggtggtcgtggaggtggaaacggcgaaaaggccgataagcccaacgagtccagtgtcgctgcgactgctggagagggagcaacatcgggtcttcccacttgctctgagaatggtgaaatcacgatgacttacagacagattaaccaggatggcgctggcccaatgagagctgatatcgatgctacctctggcggcaccgaccctgatgccttcaagtctgctgaagtcaccaatgacgttcc

SEQ ID NO: 60020 - DNA, 622 bp, Triticum aestivum
  Clone ID: PAT_TA_60020
gccggccgtactgcgcaaatacattccaaatttggagccacaaaccattccaggtccaccacgcaggtcaaccgtagggaacaacacagtccggatccgaaatctcccaggctcccactgctccgccgcggttcatccccggcgagcgaccttgaaatcgattccgtttcttgccgggtgcgagcgcacagaacatccatggacgacgccggatgaggagtgcagctgagcctgctcggcccgacggcctataaagcaacggatgagaacggagatcagtgcgtcgccggctggtgaagtgcggcaacgacacgccaaaagatgccgaacggcgaccccgaacggcgtgctggaggaacaccactaccgcactttgaggctgcaaccggacgcctccaggtgcgagggcaagaaggacttccaccgcctcgcgctgcaataccacccggactacgtgagccgccgatgcagagacggacgccaagacgacgccaacgacttcgagaggatcaacgatgagaaccacacgatgatgcgctacatgcatgaggaggaggcgacgctcgagtactgtagccacagatacagcctcgtcgacgagcacctcgaccgctaccgccac

SEQ ID NO: 60021 - DNA, 753 bp, Triticum aestivum
  Clone ID: PAT_TA_60021
gccggccgttctcgggcacgctgctgattcgtctccacacacattctctcgcgaagacccggcggcggcgactcgactctcggcgagggaggggcggagatgtcgtatctgctcccccacctgcactccggctgggcggtggaccaggccatcctcgccgaggaggagcggctcgtcatgatacgcttcggccacgactgggacgagacgtgcatgcagatggacgaggtgctgtcaggggtggctgagaccataaagaactttgcggtgatctacctcgtcgacatcacggaggttcctgacttcaacaccatgtacgagctgtacgacccgtcaacggtgatgttcttcttccgcaacaagcatatcatgattgatctcgggacaggaaacaacaacaagatcaactgggcaatgaaggacaagcaagagtttgttgacattgtggagactgtctacagaggagctcgtaagggccgtggtctggtgattgctcccaaggattactccaccaaataccgttactgaggtatctgtgcctgtgcagtgtgtggcctgctctgttctgtgaaatgcgctgtgtgacccttgatgtaatgtctgtcaactttgaaagtgtcgcgtaactatgtatttgtatcttgaatatcaacatgtcataaacctgtaaccctttgaaacaggacctgctgtctattggtattactgattaaagtgatatttggttcgaaaaaaaaaaaaaaaaagccccta

SEQ ID NO: 60022 - DNA, 589 bp, Triticum aestivum
  unsure (1)..(589): unsure at all n locations
  Clone ID: PAT_TA_60022
gccggccgggttcggggctcctctgttcagccggcatacggcgccgcgcccccgacccagggagcgggcgggtacggctcctctgctcagccgtgtacggcggcgcgcagccgggtcaggcggcggggtacggtggcacgacgggcgtgggcctggaccagagcggcgggaagacgaagaagaaggggatggggatggctggcgggctggcggtgggcgcggcggcgggcgtgctgggcgggctggcgctggcgggcggggcgagctacgtggagcacaagatcgaggaccacgtgacggagcgcgtggaggaggacatgtaccgcggcggtgggtacgacgactacggcggcgacgacgactactagtactagagcaaccatggatcgtcgttcccggggccatgcatgaatcggaccggaccggaccggagagttgagaagaagagaggttattctcttgtgcgtatcatcaagagatgaaacttagatcgttgatcttgcatacatctagttttgttaatctccatccatgcatgcatgcatgtggacgagaatcggnntgaatgaatttctttttggtgcnaaaa

SEQ ID NO: 60023 - DNA, 411 bp, Triticum aestivum
  Clone ID: PAT_TA_60023
gccggccgggcttcgaattatgccggaaaggttcttggattccacagttgactttagaggtgcggattttgagctccttccttttggtgccggacgtcggatctgccctgggatgacattggcaactaggatggtgcatttgatcctcgcttcgttgttacatcagtttaagtggagtctccctgctgagatggaaagggatgggattgacatggaagataagtttggcctcacacttactaaggtcgttcccctttgtattgtagcaacaccagtttgaattgatggaaaaaaattgtatgagtgctttagctgtagttaaatgtgtcactcatggaatgtatacaattatttatgtgataataataatgatgaatcttctaggaaaaaaaaaaaaaaaaaaggccccta

SEQ ID NO: 60024 - DNA, 615 bp, Triticum aestivum
  Clone ID: PAT_TA_60024
gccggccgggctccgattcattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgcaaaaaaaaaaaaaaaaaaggccccta

SEQ ID NO: 60025 - DNA, 763 bp, Triticum aestivum
  unsure (1)..(763): unsure at all n locations
  Clone ID: PAT_TA_60025
gccggccgggctgccacttgcggagccacgttcctgaccgagggcctcgccgccggcgccaccggcatggcgtcgctcagccgcgcccgcttcgcgctccctacgcagctcgccgccgccttccgcttctcccgcaagttcgcgctctgcctcacgtcgacctcggcggccggggtcgtcgtcttcggcgacgcgccctacgcgttccagcccggggtggacctctcgaagtcgctcctgtacaccccgctgctcgtcaacaacgtgagtaccgccggcgtctccggcgagaaggacaagtcgagcgagtacttcatcggcgtgacggccatcaaggtgaacgggcgcgccgtgccgctgaacgcctcgctgctgaccatcgacaggcagggcggcggcggcaccaagctcagcacggtggcgccctacaccgtgctggagacctccatccacaaggcggtcacggacgcgttcgcggcggagacggccatgatcccccgcgtgcgggccgtggcgccgttcaagctctgctacgacgggagcaaggtggggagcacgcgcgtgggcccggccgtgccgacggtggagctggtgctgcagagcgaggccgcgtcgtgggtggtgttcggngccaactcgatggtggccgccaagggcggcgcgctctgcctcggcgtggtggacggcggcgcggccccgcggacgtcggtgggtggtcgggggccacatgatggaggacaacctgctggagttcgatctgcag

SEQ ID NO: 60026 - DNA, 363 bp, Triticum aestivum
  Clone ID: PAT_TA_60026
cccttcgccaaatgcagatcttcgtcaagaccctcacggggaagaccatcaccctcgaggttgagagcagcgataccatcgacaatgtcaaggccaagatccaggacaaggaggggatcccggcggaggcggggcggctgatctttttcgttcgcgagcttgtccacgagcttgctggtctcgccttcctactagcgccgagtcatggagttgctctgcaaatggaaggagacgcgtgcccgtatgctcgctaagttgagactcccaaccttggtgcgtgacaggtcctcggtcgacgggttccagcgtggcttcgctgttttttttctccgccccccccccggggggttagtctgctttctg

SEQ ID NO: 60027 - DNA, 304 bp, Triticum aestivum
  Clone ID: PAT_TA_60027
caaccatgagagctgtcatcgatgagctgcatggaattttaaaggaagcgcctttttttttatctcccgcgagagagaatatttacggcctggatttttttttctcttcccccccccgtgggggggaatggctgaatggtgggcctcagccctgatgtgatgtacaaagctttgtaccggcgcacgctgcagaaaagaagattttcaagaggggagctgagattatcaatgagatcgctggtgagaaataacgttaggctgccttacgggtgaccagaacataaattggcagcaccacttattc

SEQ ID NO: 60028 - DNA, 793 bp, Triticum aestivum
  Clone ID: PAT_TA_60028
gccggcagggtctgcgagcagtcaagtcaagcaccaaccacacaagaaccgatcaagacaccagcaatggccggaggaggaagcgacgaagtgaagctgctgggcatgtgggcgagcccgttcgtccttcgagtcaagctcgcgctcagcctcaagggcgtcggctacgagtatgtcgaagaggacctcaagagcaagagcgagctgctcctcaagtccaaccccgtgctccagaaggtgccggtgctgatccacgacggcaagcccatctgcgagtcgtcggtcatcctgcaatacatcgacgaggctttcgccggcgtcggctcctcgctcctcccggaggaaccccacggccgcgccgttgctcgcttctgggccgcttacatcgacggcacgctcgtgaaagcatcgtccgaggcgtccatggccaagacggaggaggagaaggccgaggggaagaagcaggtggccgccgcggtggagaccttggagggggccctgagggactgctctaacgggaaacccttcttcgggggcgacaccgcggggtacgtggacgtgatgctcggcggcctcctcgcatgggtgcacgcggccgataagatgaagggcgttaagaccttcgaccccaccacgactccgctcttggctgcgtgggcggacaactttggatcgttggacgcggtggaggcggtcatgccggacgtgagcaagctggtcgagtttgccatggcgatgcacgctcgcgccgcagccgccgcagccggcgctacaaactaaagagacgtgccta

SEQ ID NO: 60029 - DNA, 290 bp, Triticum aestivum
  unsure (1)..(290): unsure at all n locations
  Clone ID: PAT_TA_60029
gccggccgggcctgcgcacccggtacaaatatagcagcagcctccttgtccttgacagcgtaggctcatatgctggggacgaggccgcctgccacagcaagctattttgtttcaaaagattgccgctatgcttttctcgttgaaactgtattctctctttcgtgttcccccgatagcgttcactatttagttttgttgttgttgaatgttgagtgagccacaaagntttattaatcatggaaaataatatctagggtttttatcaaaaaaaaaaaaaaaaaaggggagta

SEQ ID NO: 60030 - DNA, 577 bp, Triticum aestivum
  Clone ID: PAT_TA_60030
gccggccgggcctcgatcacctcctctcgcccccccaccgcgtctcgtcctcctcctccactcccgacccggcgaccaaccccgcgatccggcgagcccgagatggggttcctggcgacctccgccatcttcttcctcgccggcttcatcgcatgcctcttctcgctcctctgctgcaaccgcggcgcctccaccaacatattccatttgaccctggtcattaccgctacagtttgttgttggatgatgtgggcaatcgtgtacctcgcccagatgaagcctttgatcaaccccatcctgagcggcgagtgagccccgatctgccccgaagacaacttaagatccactgttgatgtatcattattcggttgagaacctctattcattttgttgccataactgaaataaagaacccgctgtgggattttgctactccgtccgtcctccggagacgcttccaaggaggcacgctgtgattagtgtatgcaaattgtattatatacacagtaataatgatgattctgtttatccaaaaaaaaaaaaaaaaaaagaaaaaaaaaaaaaaaaaaggccccta

SEQ ID NO: 60031 - DNA, 528 bp, Triticum aestivum
  Clone ID: PAT_TA_60031
gccggccgggctgggagcgcactattgctgaggtcccctactgggctgatgccctattccgcgtgcgctacatgccgtatcagtggcccaacatgaatcgtctcaagtctattgcgcaaccaaagcccaactttgaccgtgacggcaacaagactaagggattcagctatttcgtcgccctggttttcggccttggttctaagaaggctaagggtgctcttctcaggtgggcattccttgtggttgcagcggctgtcctggaagcaaagaaaggtactttgagccagctgctcacacgataataatctagttgatatccccgtttttcaatgtcaatatggtggcgatacatcgatgttatctggagctggcacacaagaaggcgactgccccagcactttaatcatttttctttgtttcgatgtactctagtcatatttcgacctcttgatctcgaatgtcgtttgtagttagccaatattaataatcatgggacaatcacaaaaaaaaaaaaataaaaggccccta

SEQ ID NO: 60032 - DNA, 411 bp, Triticum aestivum
  Clone ID: PAT_TA_60032
gccggcctggtctcgtgactatgatatgccagaaaaggttgtgagaaccagcctctatcaatcaagagcgatactacgcaccaagccgaccaagttacatatatctccgacagcattggcttacatcgcgtgcacaatccccatcccaccaacgtggctgtttctcttcacatctacacaccacccaatgctgcggatattggttacaacatctttgacgagtcgacaggcagagcgagctttgttcccaaagcacaagtgcactagagaaatttgtgagagctttactttgataccccagatattttagagattggagcggtgtattatttttgcattttacgttttaaatagctagccataatagacccaagtctcaaatactaaaaaaaaaaaaaaaaaaggccccta

SEQ ID NO: 60033 - DNA, 625 bp, Triticum aestivum
  Clone ID: PAT_TA_60033
gccggccgggtctcgatggggacaggctcacagccaggcccgcttctctattctcaagtgcttcctcgaggctgaggacgacttctgcaagctcgactacaagcaggatgacctttctgacttgaccatcaagcttgatcgctccaagattctcacagctggccgagatgccgttgccaagtatctccagaagcttcacatctacaagtcgactgctgatgtcaagactggtactgacttctacgtccatatgacaactgttgaccctgaattttggggcaagaaggttcgcgacattgttctcaagaacaagcagcctcgcaaggtctttgtccaggccaatacctccttggatgagtcatctggaaaggtttccatcaagcactacgaaccctcattgactggcatggtccagagttgggtggatcgcgccttgtaaaattgaaaaagattcacaaagacgatgatcatcttgggtctgtaagctgtacattagaagaacagataaagtagataagatgatggttgatatcattatcaagacccaagctggatctacctaaattagtcgacatgtcaataatacaatccacacacaaaaaaaaaaaaaaaaaaaaggccccta

SEQ ID NO: 60034 - DNA, 625 bp, Triticum aestivum
  Clone ID: PAT_TA_60034
gccggccgggttccggaagaagtccctcaacgcctaccagcatggttattgctcgtggtggtaagcccatcgtcatctgcaaccccgacgatgaggagttcaaggcttccgaggccgagaagatcgagatccccaagaccgttgacgtcctccagggtctcctcaacgtcattcctctccagctcattgcctactggctcgctgttctcgagggtctcaacgttgacttccctcgtaacttggccaagtcggtcaccgtcgagtaagcttgtcactgttttggctgcttgtcatgtacagtataagtttggcggttgcttgggttactcttgcttgtcaacaagagttttatgatgatgtttggagttgggttttggacagcactggcttgcaatgagcatattggcaaagtcttttgtgttttgtctacctggatagcagggaacaaatgtttggcaaaaataaatgaataaatgggaggccagggaaccaggccggtctggttcagttttagaagacatacctcgagatgaggttggataagcaagttggcttatttacgatacatagtccaggcaacataatcacgaatatttaagaaaaaaaaaaaaaaaaaaggccccta

SEQ ID NO: 60035 - DNA, 548 bp, Triticum aestivum
  Clone ID: PAT_TA_60035
gccggccgggctgcgaaccacacactcttttgagcttttcgcacaaagctccaaacggaagacgttcgcttgagagagaggatgtgattcttgtttttcgctcttgctatcttcgcgcagcagataatatggcttcacacactcaaaccgtccctgatgggatggagaatttcatcgtcggattgattggcatgggcgacatgggcaagatgtatgccgaaaggctgtctgccgctggctggaggtaagtctaggatcctttgcgattcgtgcttccagccctagcatcttttcttcaatgaacagaccctataccttatcctactcgtgactgcaaaccccgtaccgcacgccgagtggctaacggcggtcttttatagaatcttggcctgcgaccgagaagagaaccaggagagccttcagaaagaatatgctggaaatgtatggcttactgattcctgtctttctctgcctcgcgccagtcgctgaagctttacaatagaaaaatatagaaatttgtcgaaaaaaaaaaaaaaaaaaggccccta

SEQ ID NO: 60036 - DNA, 651 bp, Triticum aestivum
  Clone ID: PAT_TA_60036
gccggccgggcctgcgattcactctcgaagagcgacctgtgttcagacaaatcgcatatatgttttacatcaagaatgcctcctggaatacttcttgaatccgccattattggtgtcttcttccgtgagaacaccatccgcatgctgaaggactgcatggagtgaccttcgacactaggcctcccaaggacatcactggcagatcaagggacgttgacaccaagtattatgcaccatctccgatgttcgcatctgacactctctctacaaaagggtatgactatatggtatcaccgtggactgactaccgaataacaagtgcgaaattcccgatagatgaatccatatttaggtagcctgggagaagctgtacagctacgtccaggacgtgaccctaaaggaccccaaggtcctcaactagggtgttgctgaggaataaatataacaatttctcttgtaacaaggatctacgatgtcatggcatttgcagttacactcgtcattctgtattgtcgacgcatgacaatacactgatggacgatgtgattaaagcttgaagactgcccaaacgatgatcgtagcctacttagtgcactgactggactctgcccttatgctctttttatgaggacgaaaaagatttacgttctg

SEQ ID NO: 60037 - DNA, 234 bp, Triticum aestivum
  Clone ID: PAT_TA_60037
gccggccgggcctcgcagtagctttcaagagattttaattctagatggtgtaattgtcggcgttgtcgcttcctacttatctagccctgacatgtttcaactcttgattgaatcctcaagaaaaaaaaaaagggatttcaaggctagcctgtgcctgtccaagggcattatgatacgggctgcatagaaatcgacatgatcaatacctaaaaaaaaaaaaaaaaaaggccccta

SEQ ID NO: 60038 - DNA, 631 bp, Triticum aestivum
  Clone ID: PAT_TA_60038
gccggccgggtcgggctccatatgtggcaacctaaccttgatcccagcctaccggaggggcaaagtccagatagctggagcactgcatcgggacctggtcaagctgttccgactacactcaacgtagaagactggtgggtatcctaacattccatgttaacaagtttctaactagtcccctaggttccaattcttcggcatcaacggcacggatcccaattttaattttgacgtgcccctgggctgagtagtatggctgaacataagacgcaaagagtgtcgcccttggtcaacaacattgggatattgactcaaacattgagccatgaaccgggcctagccagttgtgactcggtagcagacccgggtggctgaacaattgtgcatggtcagaaatgtcttggtcagtccattggaagaagatcgaggcctgataccccgtaatagctttccttgcccttgggataagacgacggagcacatcagacgagacgttcgaagataacgagtaagacatggcagttttggcgttggttataaatacccaaagtcatctgcaacagtgcagagttaaaacaatatatactacaataattaaagcctccaaaaaaaaaaaaaaaaaaggccccta

SEQ ID NO: 60039 - DNA, 378 bp, Triticum aestivum
  Clone ID: PAT_TA_60039
gccggccgggttctcgaagactggaatgttctactttggcctctgcttcatctgggctgtctggatcttcttcttccttcctgagacgaagaaccgtagctttgccgatctcgactacctcttccagaagaaggtcaacgctcgcaagtttactactactcctgttgacttgtttgagattgttggacctggtcgggacgacaagctccagggtgtcgaggtcatcactcccgtcaacaccaacactgcgggacaagacattgagggtggcaagaagctgtaaagagcattgtagttgtttgaagttagcgtaatatccaaccagtcataaatggcataatgtttctcttccaaaaaaaaaaaaaaaaaaggccccta

SEQ ID NO: 60040 - DNA, 602 bp, Triticum aestivum
  unsure (1)..(602): unsure at all n locations
  Clone ID: PAT_TA_60040
tacacaccatagatttggtgagtcctcgttactgaccatctggtcatctatctcttttctttctttcttttctttgtataccttctttttctattactcgagatagcttcacttctgtttttattgttcatgtcttatacgaaccatcgtcaacatccgatagtggggttggcaacaggcgacatcgagtggatccctcagccgttgatccctggtttctcgggcttccttcctgcttcccctacggctacagctacaggcccagctcggggcgttttcgctagagtacgcacgcactgcagagtcgactcattcgaatgagcatgccacttttccatcaacaacagacaggcgaacgccggaacaatagaattggacgacgattgattccgataacatccttttgactcacctttcgccatggccttgtcgtcttgctttacttcctttctccaatccaaacgaaactcactaatgacacgcgcgaaaaaaaaaaaaaaaaaaaaaaaaaaaaaaaaaaaaaaaaaaaaaaaaaaaaaaaaaaaaaaaaaaaaaaaaaaaaaaaaaaannnnnggaaaaaaaaaaaaaanaagggccccta

SEQ ID NO: 60041 - DNA, 581 bp, Triticum aestivum
  Clone ID: PAT_TA_60041
gccggccgggctgcatcgatgctcacgccaacaagcccgagtctcttctcactggctgcaacaccttcttgaagaacctcaacgtcactttccgtcgtgaccctaccaactaccgcccccgtatcaacaagaacggatctcagctcgaccaagagcagaagatgagcggcaactacttcttcttggaagagaaccctgaatcgagctaaaggcctttacaacgagactctgcctccccttgatggtgcatctgcaggcgtttgtggtgttcaaaatgggaatcggcgaaagcagcgggacttgggaatagatgacgaccgcagcgccggcgaggatgacgatccagatgaataacgatggtgacggtagcgtatcccctgttgtctggtcctacgaaagccgttgggtttcttgattggcgtgttctggtttgtttcttgcctagtgttctctgggggttcataactccctagatccttgtagtacagaaactggatggcttcgtagattgagggacaatggatctagcaggatctctgccgccttgacgtttcctacctcgcgggaaacaacttccatag

SEQ ID NO: 60042 - DNA, 493 bp, Triticum aestivum
  Clone ID: PAT_TA_60042
gccggccgggctgcgaacagccgagccatttcggtgtgttgcagaggtccagaaaagtctcgagcgagggcgtactagtccgaggaaacggtatgaaaatgccatgagatagatctgtctggtctatgcagatgcagaccaatgtttcgccccccttctttttcttttctcctattgttttattttgcttgggtgaggatgacagcatgggttataggaaaggaaaccccacggatggggttgcttgttcagttttggagatccaaatcaaggcagttcttgagaagcagaacccccaagacctcaaagaccattgatggtaatgtcatgataccaaggaagaaatggggctgcagaaatctgaaaggctgtcatgaaacccttttttgtatgttttatatcaggacttgatgtctaaattgcggacgcagtactacaaacaaataccacgttattgatcattgtggaaaaaaaaaaaaaaaaaaggccccta

SEQ ID NO: 60043 - DNA, 421 bp, Triticum aestivum
  Clone ID: PAT_TA_60043
gccggccgggccgtctcccaaccatcatcatccgccgcgagtaccttcactttattcagaagtactcccgatacgagaagcgacacaagaacgttgccgcccacgtttcccccgctttccgtgtccaggagggtgaccaggttaccgttggccagtgccgacctctcagcaagactgtccgcttcaacgtcctgcgtgtcctgccccgaaccggcaagtctgttaagaagttctccaagttttaagttgggactatcctaccttctggcattttttcggcgtgataagcatcagggcaaatggaaagtttcccctgaagggtcgggcaccggatattgcgttgcaaatggttgtgctatagatgcaatcgcgaataaaaaaggattcacgaaggcaaaaaaaaaaaaaaaaaaggccccta

SEQ ID NO: 60044 - DNA, 221 bp, Triticum aestivum
  Clone ID: PAT_TA_60044
gccggccgggctgcgctatagaaggccggccgggcggggaattagggataaccctccctttgtgtaaactgccgccggtttgggtatggcaactggtcgacatacccacgcccccataatcggacgcgtccactcgtggtgacggttccttatgtatataatccttgaatcatcaatgaaagagacacttcgatcaaaaaaaaaaaaaaaaaaggccccta

SEQ ID NO: 60045 - DNA, 476 bp, Triticum aestivum
  Clone ID: PAT_TA_60045
gccggctggccctcgacatgctcgacctgaacttccaagtcttcttcatgaccgacctctcccagaagctcgttgcccgcaccaccggcgtcgagcccctcaccctctcccgcgacgactgcaccaactttgagcagtaccaggcccgcatcgcccaggtcctcgagattgtcgaaaaggctgacaaggccaccgttgacaagcgcgccgacgagatcgtcaccattggtctcggacccggaaagagcgctgacatgaagtcccgcgactttgttcagggtttcgctattcccaacatcttcttccacctcaccactgcctacgctattctgcgaaaggagggtgttgagattggcaagcaggacttccttggtcctttcattggccagtacctccagtaaattagggactatgggataaataaaagaaatgatttatggttgaactaagaaaaaaaaaaaaaaaaaaggccccta

SEQ ID NO: 60046 - DNA, 843 bp, Triticum aestivum
  Clone ID: PAT_TA_60046
gccggccgggctgcggagaaccatcaacaaacacttcagactcaatcacaactaccaacaactttcaaactctttcatcactccaaatttctaaaaatggcttccgctatgaccttccctcagcagcagcagcagagcctgcctatccagactaccaactctggcgcctctgttgacaacaacctcctttctgccttggcccagtatgtcaccactggtgctcacgctcgcagcaccaccgagcaggagatccaggaacttgcccaagatgccatctccaagcccggtggccgtgctcacctggaagctctgattagctacgactgccctgagcaccaggtctggaagaaccaggcttctgctgatggtaccatcaccatcaccaagacgaacctcaccgtcagcctcggagttagcactcttgagctgaactttgaggctagtggtgcgggtttctttgttccctacagtggctccctcaacgttggcaccctcttctacaacgagtttgctcagctcgcccccggcaatgctaccttcaagctctatgtttctggactcgatttctatgtcagcatctaccgcaaccaggtctacattggcaatttccacttcaccaacatcaccttcgtcttcccccctggtggtgtcaacctgaatggcaggatcatctaaatgttctatggagaatgtcaagagccgcgttgatcgctatggctcagtggactagaagtaatttttacttcagctgtttttctttgtcatcttgggtaggggtagctttgtcactcgttaatttacaatctatgtttcccgagaaaaaaaaaaaaaaaagccccctag

SEQ ID NO: 60047 - DNA, 638 bp, Triticum aestivum
  Clone ID: PAT_TA_60047
gccggccgggttccgtactaagggttgaggcatcgaatgttgtttgttaaagagccacgtctcggtcgagtcttttcaagacattcgatggtatcgcacagttgattggctctaccatgtttggtcagctttggctcgacttgtgagccccgtgctcaaagtcttaaaacatggtcaccagaactgattgcagcgccgcccacgtggcaatactttggccgagtacccgttgtgtattctggtcaccagcaagaaaccttgacatctcgccagggggtgatgcatttcgggggaggaacttgaacagcacgtccatctgctacgttgcatatccacgttgacgagtatccatgattgacgatcataacgtgagtgatggtaaaacaaaatttgagcttcaacttccctttcctgggtgttgaagtcttatgttgtcagacgaataagtataagcatgtaagccggcgttgaacttgattaatagagtcttgaagcccagtccgcaagagacgtgcaatgggcagcaggccacggtttcgcttcaattcaattcgcatgtaaatagataatagataaaccaagcagtcgtatattcattcattaattcaagaaaaaaaaaaaaaaaaaaaaggccccta

SEQ ID NO: 60048 - DNA, 649 bp, Triticum aestivum
  Clone ID: PAT_TA_60048
gccggccgggttcccagagtcctctcgcttgtttgctcatcgcagaaactaccaactgcatacagtctcggcctccactcatcaaaatcacgcaaagcttctcaaaatgtgccggtttgttccagctatttctcttgtccttcgtcatggattgatctgttgattggatctccccgtgtcccccgcatccgcctccccgatgtgttgcgccgggccccctctttcttcggtccaactcgattcgttttttcctttccacccggcttggcatctccgaacacgaatgagccatgttcatcacacgctctcgctcaccacaaaccacaaggcatgaaccataaacatgctcgcttatagtagctttctgctattgacgcgggatgcgacggcccggtttccaaagcagctaaagacctcgtgcgcatctaccttggtagataatcagtcagtcgtgagtcctgtctaaatccatgtctggtgagatccaactgcagactgcatcatggacctcatgcacacattatctcgcataaagtcataaagcagtgaatcaaccaacatcatgatagctttgaattaaaatccattctcaatagaagacattgccatcctaaaaaaaaaataaaaaaaaaaaaaaaaaaggccccta

SEQ ID NO: 60049 - DNA, 605 bp, Triticum aestivum
  Clone ID: PAT_TA_60049
gccggccggtttccagatcaccgcatcaattgacgacttctacatcctcaattcctccctaatacaacatcagcgacaccatgtgactcgaacgtgagatccccgctgaatacaggtacgatatccttgccgttacatccacacttcgtcatcaacacccataccacgtcactcctcaccagcaaggatccgcaagcaaagaggatctcaagcaccccatcccttacgcttccagcgacctcgccgagaagaacggcgaggtatacaagttcaactgtgtacagcgttcggacgccaacttcacagagaaccagatctccttcctgggagatctcctgatctctgggctgcgctaccccgctgcctctgctgtactcagtgctgtttgggctgtttctcgcgccttctacgacattgggtactctgctgaaacccctcaaggacgcatgtgaggctccattgactctgccctttgcgatgcgtctgtgaagataatgaacacctacacctctatcatgcatgctatgagtaactgagtcggacggaaatctgatataatataatattggtacctagaaaaaataaaaaaaaaaggtccctataga

SEQ ID NO: 60050 - DNA, 776 bp, Triticum aestivum
  unsure (1)..(776): unsure at all n locations
  Clone ID: PAT_TA_60050
gccggccgggtcgggaactacatacttacatttactttcaaaatggccactcctccgattcccgccaaccgtctcaagcagatcgccaccgatgcctgcaacagcgccatcggcaatgctgagttctacgaccacgctaagaccgagcaatggaactcgacaatcattagctccgtgctgaaggctgtcatctccgagtcgacccccgaaggtgcttccgctccttcattcaagtttgcctgcaacagcaccatcgtgcagcacctcgtcccaacatccgctctgaacaagccccgtggcggcaccgagacacaggctcaggagcctcacatctccaccagctccgaagctaccgctaccgacggcaagcctcacgtcggccgacgaggaatgcacagcgctaccggtgcctactgggacgagaagaaggacggcatgtggaccttcaagtacgacggcggcgagggcaagggcctggacgttgttgtcatgctcatctgggttgccatttgagctgcaaacaaaaagatgagcactcggggactttctccctgttctgaaccgagttagtttgcttctgacgtgcgcgacccctgattcagctatggcgttgagggacttgggaagcgtgacattangactacgaagtgtacgatcgagcttccgtttaagctatnctgccgacgactttgggtgttattggcagaccttgnatgtacaaaatgcgctggacttgataatattctacnatgcccagacggttggagccagcctcg

SEQ ID NO: 60051 - DNA, 438 bp, Triticum aestivum
  Clone ID: PAT_TA_60051
gccggccgggctgcgccgccgaggaaacgcacaagaagaggactcaaagaagcgaaagatgagagaacacagatatgctgagatcgttgggccaatggtctgtcggatagacgaaaaggaaaaaggcgcgagggatagggcgagaacggtggtagaaatgttcataatgcgtgatgaggggagctagaagcggccgggtcggaagattcgagctatgtgggcgagtgtttgaacaggatgctgaagatgcgctgggaaggtaactaatctgaggttttgctttttggctcgaatagaaggtataccagctttttcgatgtatcggtagggttgaagacaggatacaacaaagggtgtagaaaataaaaggtcagtgctagtctataacaatgagggatcaagttgcaaacacaaaaaaaaaaaaaaaaaaggccccta

SEQ ID NO: 60052 - DNA, 512 bp, Triticum aestivum
  Clone ID: PAT_TA_60052
gccggccgggctcccaattgcattcacctacgatacaacattagcccagttaatcaataacccccccttccgacgcgtgaaaaaaagaagaagaggagggacagcaattcgttcacacaaaagcagaaatacaaaaactgtcctctattctttaccctacggagaacacggtttcttcaccccatcagcgcagaacgaacactcggacgaagctggttgggctatttgcgactttaaatctgtacagtggtcgccaggcagcgaccgcttctgtccttacttaaataagaagaagcgagaataccacgtcgaaccgaagggggagaagacaaaaaaccttggttcatctcgttacataccagacaaaaagtctcactattcatttgcgacaaagcatacatacctacagtaggtattcttactcatacttgccgccgcgcgaaaatcccatcaacctactacccccccttgtcaataacaaccctgaaaaaaaaaaaaaaaaaaggccccta

SEQ ID NO: 60053 - DNA, 587 bp, Triticum aestivum
  unsure (1)..(587): unsure at all n locations
  Clone ID: PAT_TA_60053
gccggccgggctggggagaatgattgcgatatggtctcngggaaggacaaccaagtctcagtctgatctgagtctgagtccactcgaaacaggcccgagagtataattgcccgactggaatgttgaggcgagcgaggttaaggtgagaagaatcaggtcgagtggtgaatctcagtgcgggcctaagagtatgggcatcggctggtgatgtcaaaaaaaagctggtggcagggaacccaaagctgggccaaagctggaaatttggggggttggtgctgggagcagctgtggccggccgcctaccaggccaaggccagaaaagtccttaaagaaacgggccactaatgagggagaaacttgagattgcaagcacaatgcacgcgcacgcgatgcgtaaaatttgaggatactcggtggtcgaactttggttgaagtaaccaattgcttcgtgtcgctgattttgtaaaagcgacgcgacttgaatgcgcgcagtcgcatatgttgtagatatgatccaggcgcaaaagccacggcacgtctagtttgttcacccctctgcgcgcgtttggctgtgggtacttattgat

SEQ ID NO: 60054 - DNA, 439 bp, Triticum aestivum
  unsure (1)..(439): unsure at all n locations
  Clone ID: PAT_TA_60054
gccggccgggctgcnatcccacggtatcctcaccaagcgccctggtgttctgtccaacgacttcttcgtcaacctcctcgacatcagcaccgagtggaagcccgtcggcaacggcgacctgttcgagggtattgaccgcaagagcggcaacaagaagtggactggtacccgtgtcgatctcgtctttggatcacacgctgagctccgcgcgacagctgagacatatgctgaagctggcggtagcgagaagctggttcgcgactttgtcgctgcctggaccaaggtgatgaaccttgaccgatttgatgttaagaatggtaaagcgcctaatgtctctcctcgactgtaattttatgaatagcaatgtagcaaaaatacctttgagaatgaaatgattacgaatctgacttgataaaaaaaaaaaaaaaaaaggccccta

SEQ ID NO: 60055 - DNA, 413 bp, Triticum aestivum
  Clone ID: PAT_TA_60055
gccggccgggctgggtgacatgggacaggcgcaaggtctatggaaaagcgccttcgggccgtggctatcacgggacggtgctgtatgacagccggctcatcattattggagggtttgatggaagcgaggtgtttggcgatgttatgctgctagagctggctgttcatgcgtattactcgcagattagtcacttcaccatcgaagtgtaatcgtaagacgttgcagctctttttggatatatcacagtgtgttttactaattgatttgttgttatgggacggtaactggatccttgacgagggggctagcagggagtcgacggtgtagatcttttgtttacccagtatagaggaatttcagatgctggatcatcttttctgagtttccaaaaaaaaaaaaaaaaaaggccccta

SEQ ID NO: 60056 - DNA, 277 bp, Triticum aestivum
  Clone ID: PAT_TA_60056
gccggccgggtcggatacgcataggaaacgggagggagggaggtggcgtcgtgtcgagagaagccggcgtcgtgccggggcgtgccgttgtacatggagagcccggcgccggggcctggccggctgggttgattcttttgttcttactaccttgtactctcaatgcggatgtagctctttcttctaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 60057 - DNA, 168 bp, Triticum aestivum
  Clone ID: PAT_TA_60057
gccggccgggctctcgagattaaacaagtattgttggcactgagttggaaaaatgtatcgttgtcactgggtttttgtaattgtataagaggtgcggggcatctccccggcttatctatatagtagtaattgctcttttcataaaaaaaaaaaaaaaaaaggccccta

SEQ ID NO: 60058 - DNA, 329 bp, Triticum aestivum
  unsure (1)..(329): unsure at all n locations
  Clone ID: PAT_TA_60058
gccggccgggctgggccccaagtattgcgccaccgttgcgccaggaggataacggagcccccgttacgggagggaaaaaaacgacttttgagtcgacagagcaaggaaaagaaaggggacgtcgaagggggaagattagatagattgtcactccaaaaagagtttgatccatattttacagataacaacaccagatggcccttgactacaggaaagggtagcagattagacattttgtttggggaggatttttgatattggnaaccaacgggatagagatttgggagttgaatcgagttttactaaaaaaaaaaaaaaaaagggcccta

SEQ ID NO: 60059 - DNA, 159 bp, Triticum aestivum
  Clone ID: PAT_TA_60059
gccggccgggcctggatctcaacaattgacgacgaattacgatttgtttctgtttttgctcgaatatcatttgaacaccgtttcaagactcacgatcttcatgcaattttatctaaaatttcaacgataaaagaaaaaaaaaaaaaaaaaaggccccta

SEQ ID NO: 60060 - DNA, 217 bp, Triticum aestivum
  unsure (1)..(217): unsure at all n locations
  Clone ID: PAT_TA_60060
gccggncgggttgggacttgccatctcgagggtcccgtagccccatggggatngctgccgtctacggtgagaacaacgactctgtcatttttgcgctttcgtcatccgaggtcaggagcacgttcccgctttcgacgtcgcccccgagtgggagagctacgagttcggctagcacgaataatcgaagcctgacggaagagcgttcccttgaggatgc

SEQ ID NO: 60061 - DNA, 825 bp, Triticum aestivum
  Clone ID: PAT_TA_60061
gccggccgggtcgggtgtaacctactactacacagaccgccggcaggcttacttgaccaagcgctgatgaagcacaattgtcttgctccgctatctccaatagagaaactatcgctagagttgataagcagcatttatctataccttcacccgaccgactgcatcgccctcgggctttgctctcaaactctttggatccgagccatggattttattcgtcactctcgccgttcaacaacgtgggtggatacaccgatattcattgctagtggtaaacaactgcttgctcttcgggaggccagccacaacaatgaatctgaacttcaagaccctcaagatggaacccaggacgcggtttgcatgttgatgaagccacagagacctcacctgtttaacgtgctaaagcaggcgaggagtcaaaaccagttatgcgactatgcttccttgaattcttcggatattaaccccccctacctccaagagcttatccggctatcaccaacgagtggtatttcgaaagggtttcaccggctgatggagtcgtgcctgtttcccgaagaatttggtggccaaggccagtggtgccttcgtgattttaccaccaacgaatacatccgaatggaacctgtccgggatcgtagcatctctgagcatcctactatctcgctgactcgaaacccttggatgactctggatattttacttatatggcttattacatgggaagcaggacggaacagatcaccagaaaatgtcaccagagagatcttaagagatcagatcaacaagataatgagcaaccgtggtgccagcgttaccgcatcc

SEQ ID NO: 60062 - DNA, 465 bp, Triticum aestivum
  Clone ID: PAT_TA_60062
gccggccggtccgggggtccatagcaaaaaaaaaaaaaaaaaaaggaagggaaattgtataagattaagaaagataagattaagaaagctcgtgggttagagatatagaaaagaaaaagtagaaaaggattaaaaaagagggaattcctaatccaatcaaaaaacccattttggtcttagtgtggatagaggatcttcctatgttatactatataactctcatccgtgaaatataactctcatccatgaattgatttgatagatccgatattcataatattgagtaaatcaagttaaaaagatatcccggttgcttgcgcttactatgcgaccatttttggagtcaacatcgttttgcattgcgtatctatagacgtcttagggtagtgaacgaaaccatcgaatcatctttgctaaaaaaaaaaaaaaaaaaaaaaagaaaaaaaaaaaaaaaaaaggccccta

SEQ ID NO: 60063 - DNA, 542 bp, Triticum aestivum
  Clone ID: PAT_TA_60063
gccggccgggccgggatcccccacatcccatcccaccgagccaggcccccagacttcaagttgacccagagtcccagactactcactcccctcctcgccgatcctccgatctactcgcaagctacagcgcaaggtcgtgatggctccgcgcatcgccgtgctgatcctggccgtggccgtcttctttgcctctgcgtcggcgcaggacttcatggggccttcctcggcccccgctccggcgcctgacgccggcgcggccgctggcgtgtccgcgttggccttggtgtcctcggcactggtgtcccttctcgcggcggcggtgatgcagtagatggatgtttcatggtcgcagctttgggttggatggccggacgccggaacagagagtttttcctttgagaggtcggcggtggtttgacgagtgttgctagctcttgcctcttttgtttgttcgacattcttttctatcatgttgtccatataatgttatgaataaagcttgttggattctttggcaaaaaaaaaaaaaaaaaaggccccta

SEQ ID NO: 60064 - DNA, 573 bp, Triticum aestivum
  Clone ID: PAT_TA_60064
ctgtgcggcgctcgaggcggccggtcgggacaatttccgccgaacagaaaaagatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgccgaggcaaagcatccgaagagcgagctcgtccagtgcttccctcacctcaagcagtgatatctgcccaatcagacagagagagagataaaagagagagagagagagaagctgtcataatccacctactattatcatgttccgcaatgactgattgttgacctaagcttggggtctgaactcggtgtgctgctgtcccggctgctttggttgtgtgcccatctactatgtaatcgtcctctatcagcctgttgtgctacattaaaaaaaaaaaaaaaaaaaataaaaaaaaaaaaaaaaaaggccccta

SEQ ID NO: 60065 - DNA, 574 bp, Triticum aestivum
  Clone ID: PAT_TA_60065
gccggccgggtcgggattaaagcttcaccatccgcacgagtgccttcttgcccctatagagggtcgatgggtgcaacgcggccaagcggtccaggggcctgggagagggcggggctactcgacacagcgaagccctccgtgacaacagccagggctgcaccaagacgtggatccgcacgatggagacgacgcctgcctcgaatcgcatctccggtctcatctacgaggagacccgcggcgtcctcacatcttccgcgagaacgtcatccgcgacgacgttacctacaacgagcacgcccgccgcaagaacgtcactggcatggaggacggctacacgctcaagcgacagggccgcaccctctacgggttcggagggtagattcatgtagaccgccagcagtgggggaacttcctcgattgctctctgtgatgtgtgctgtggtagatgagatttactggcttgcgtgtgttgttgtgttctgacttggggttcagtaggctctgtaatagctttgttctgttcaatgcaatcagttcgattctgaatcaaaaaaaaaaaaaaaaaaggccccta

SEQ ID NO: 60066 - DNA, 645 bp, Triticum aestivum
  Clone ID: PAT_TA_60066
gccggccggtccgggtactctaccagaagagcccctgtggcaagtatgccaacggcaaggacccctcaactggcgagaagtgcgcccccgccgacatcaacgtctgggctcagtgccttccctacatcttcattggtctcggtgagatcttcaccaacgttacctcttacgaatacgcctattccaaggcccccgagaacatgaagtccctcgtcatgagtgtcaacctcttcatgtccgcctttgcctccgccatcggccaggctttcacacctttctccgacgaccctctcctcgtctggaactacgtcatcgtcgctgtcattgcctttgtcggtggtgttgctttctggttccagttcaagcatctcgacggcgaggaagacaagtggaacatgctcaaggcctcagagtaccagggtgaataccaacccaatgctactgagaacaaggttgccgatgagcacgaggagcctaccaacgctcctcgggatattgagaagatgtgactccctaaggagtgcaagagttgctatcgctttagttaagataccactagtttaatgacttggattactctattagataattgaatccatttacaatatcacactttggtaaaaaaaaaaaaaaaaaaggccccta

SEQ ID NO: 60067 - DNA, 759 bp, Triticum aestivum
  Clone ID: PAT_TA_60067
gccggccggttcgggtccgcctcaaccttcgtgacttccttgtttccctcaaggagtttgctggtgacaacgccgtgctgttcgtcgttgagaaggagcagcaagaacaggaggccaagaacgccgatatggagcgacgacagaaggttggaggtcttctcaagccctcggagctggacgacgaagagctatgactcaacgaagaactacggactgagtttgcgccccaagttgctgatgaagccgggtcggcggatgcagctggggatggatgggagttttatggactttgaagacttttctagagtcacggcccgccaactgattcctccaccccacgcacgccgaagcacctcgttcaagcgaatttctttcctgttatgataccatattccttctatagaagagtggtcggtcgcctgcctatgcctagtgcgacgccctagtctaaatcgaccccccttggaagtctcaaaggggaagagttataaaaaagagagacaaagatcaaggagccctggttgagttcttagttggtgatggctgtttgagttcacgacccgacgttttcagcggtcgacgaaggtatcacgcgctctgttgtgaaccgaataaagagaaatgatatattgatacagatccagaatatggtttctgcggataggaaaagacgactagcacttgtagatattgtttcagcttacactatgtatggataattgaattgtccaagagaaaaaaaaaaaaaaaaagccccta

SEQ ID NO: 60068 - DNA, 669 bp, Triticum aestivum
  unsure (1)..(669): unsure at all n locations
  Clone ID: PAT_TA_60068
gccggccggttcgggaagnnggtctctctgttctctctcgcaccggccccgatctcggcgatgccgcctctcacgacccccaagtccggtgatgccctcttcgccagcgtcgagcgcatactcttcacgctcacgtatggcaccatcgtgcggcagctgctcacggatctcgaagaggtcgaggaggtcaacaagcagctcgatcagatgggttacgatattggaactcggttggtcgatgaattcttagccaagtcaaatgtatcaaactgtgctgacttcaaggagactgctgatactatagcaaaggtttccgtgaagacggaggttacatgggtccgtgatatgcttcgcggtgatgatgcctacgagatgcgggtgaagctcaccaagcaagtcccggaggaatacccctacaaggatgatgactagtttcatctcaaggggtagctcttccgcacggtggcgcttgttgcgcttgtttgcttgtctggatatctgttttgctttccctgtgggtgtaattctggtacaaccgtcatgttttacatgaggcacctgtgcattgtattttgcagctgcactgtgtaccgcagatgtattgtagagatcttgtatggttttcctgctttggaacagtgcctgggaatgaagtgcttttactctgat

SEQ ID NO: 60069 - DNA, 303 bp, Triticum aestivum
  Clone ID: PAT_TA_60069
gccggccggtccggcgcgcccgccagaattcattacactagctacatcaaatccgttccagatatatgaccgacattgttctattatctgcggttgatcgcactacacgagcgacttataatatgatgagtggcctcctccctgcacgtgcaagacatcggagagacctaaacaggcacgctcctcttcttcttcagtgtaccaaggatagaacttaaatctggaactactaaataaataaaacccagaatcctctcttgcttcccatgtaggagagagatgcggacgacaaagatgccccta

SEQ ID NO: 60070 - DNA, 648 bp, Triticum aestivum
  Clone ID: PAT_TA_60070
gccggccggtccaggctcatcaaggctttgcgacgactgtcatacgcagcacagccgtgagataggaagccaaagcacaagctgcctccctccaaattaaagcagccccatccttgcaacatgaggcctcaagcgctgctcctcgcgctggccgtcctcaccgacatcacagctctgcccctagcacatggacaagggacgaggccgcgatcttgctgcaagaagtgcggtacgtgcaccaagtccattccgacacagtgtacgcgacatgacgtgtcaacgaccgggtgcaacacgccttgcaagagatgcgtcagggccaccgctggcttccaatgatgagatagcatcaccaacttctgcgagagccactgaacatgggctgtgcgattgcacgctggctcatgaactgtctactactagcctgaataatgccagtgacaatacttttctctccatcgttcggagctcctctggatgcatcttgcgctacatggatgcacagaataaattagcgactgatgcttacttgtcatattttactaccgctgaaatacataaagaacatatacgatgatcaatattgtcgtgaccgggcctctggtatgtcaagctcaggccctaatgacatcgtagatctacaactaa

SEQ ID NO: 60071 - DNA, 540 bp, Triticum aestivum
  unsure (1)..(540): unsure at all n locations
  Clone ID: PAT_TA_60071
gccggccggtccgggaaccagaaaaccgccggccgcaaccaccaagaaccttcatccatggtgaccctgttctgcgcagccgctgccacctcgtgccgcctaaccttcccgcttgccgcgccggcgccggcgccaggccttggccgcggccgggtccgacggggcacggtggcggtgcgtgcggatggagacaccgccgctgctgggagcgggataaacccggccatccgaaaggaggaggccaaggtggtcgacaccgtcctggccggggagctctccaagccgctcaccccgtactgccggtgctggagatcgggaacatttccactgtgtgatggaagccatgtgaagcacaacaaagcaacgggagataatgtagggcccttgcttgttaagaagtagaatgagttatttttcctcaatttgtgttgagtggaataatgtgtataacgtttttctcaaatgtaataatgaagttccatgctgcannaaaaaaaaaaaaaaaaaaaaaaaccaaaaaaaaaaaaaaaaaggccccta

SEQ ID NO: 60072 - DNA, 689 bp, Triticum aestivum
  unsure (1)..(689): unsure at all n locations
  Clone ID: PAT_TA_60072
gccggccgggccgggaaccaaccagactctcgaatcccaatccacgccgccgcagccgccgacgcaacaggtggtaaatctcggcgagcgagggcgagatgcagatctttgtgaagacgctgacggggaagacgatcacgctggaggtggagtcgtcggacgatcgacaacgtcaaggccaagatccaggacaaggaggggatcccgccggaccagcagcggctcatcttcgccgggaagcagctggaggacgggcgcacgctggccgactacaacatccagaaggagtcgacgctgcacctggtcctccgcctccgcggcggcgccaagaagcgcaagaagaagacctactcgacgcccaagaaggtcaagcacgagcgcgagaagaccccgctcgccgtgctcggctactacagggtggacgacgcgacgggcaaggtggagaggctgcgcaaggagtgccccaacccggactgcggcgccgggaccttcatggcggcgcacgccgaccgccacgcctgcggcaagtgcggcctcacctacgcctacgccgaggcccagagcccagagatcgacagtgattgatcaggtggtgtgattcgatgacggagttggattcgcgccatggattcagtgtacgtctggtaatgaatttttcaaagaaaaaaaaaaaaaaaaaaggcccctan

SEQ ID NO: 60073 - DNA, 396 bp, Triticum aestivum
  Clone ID: PAT_TA_60073
gccggccggtccggggatgactcggatgaactacagaaccagagccgagtttctacggacactagcagaactagctagctaggccagttcctggtttagatgaagttcctcaagcatggcgagttgccatggacattgtttcgcaagtctcaagggaggataagaagaataaatattaagtagtgcccactagttacagatcctctgttgcgttttaaggctaataagctcaggtgatagccggtcgaccttctgcgtgtgacaaaaaagactgtccattcagttaatattgtaaacagccaacgtttggtagtttagacttcagacacgtacggatattccaacaaaaaaaaaaaaaaaaaaaaaaaagaaaaaaaaaaaaaaaaaaggccccta

SEQ ID NO: 60074 - DNA, 590 bp, Triticum aestivum
  Clone ID: PAT_TA_60074
gccggccgggtccgggaattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaaaaaaaaaaaaaaaaaaggccccta

SEQ ID NO: 60075 - DNA, 775 bp, Triticum aestivum
  Clone ID: PAT_TA_60075
gccggccggtccgggaatacgcccctcgccggttccagctggcccgtccatcccgacctttctcgcagccacgagccgccgcactcaggccgccgccctagccgccgcgccgtccgtccccgccggattccagtggcaaccagcctccggcacccccttcttccaccctccgtcgccgacagtcactgaagcatctccttgcgatggctgcagcggcgatttccggcggtcacctcgtcctctccacccctacctccacccggcgcccacggtcgctccccctccgtccgccctcagcgcgaccaatcgacgcatcctccgcctccgcagcccgccgcggggtcgcggccgccgcagtgtccagccctgccgcggtcccctccactgggaaagatgcaaaacagcttcctaaggattttcttcatatcaatgattttgacaaagatacaatcatgaagatccttaaccgagcaattgaggttaaggcaatgataaagtcaggagacaggagcttccaaccgttcaaaggaaagtcgatggcaatggtcttcgccaagccgtcaatgaggacccgtgtttcgtttgaaacaggattcttcttgcttggtgggcatgctgtttatttaggtcccgatgatatccagatgggcaagcgtgaggagacccgtgatggtgctcgtgtactttctggatataatgacatcattatgggcagggtttttgctcaccaggatattttggacttggcaaatatgcacctgtacctgtcataaat

SEQ ID NO: 60076 - DNA, 574 bp, Triticum aestivum
  unsure (1)..(574): unsure at all n locations
  Clone ID: PAT_TA_60076
gccggccgggccggaatcatcaaatgggttctcgatggattcgacccgaggtgtacccgctgttcgcgacgactggcgtggccgtcggtatttgtgtgatgcaacttgtgcgcaatatcaccaccaaccctgaagtcagggtgacaaagcagaacagggcagccggggtgctagagaatcatgatgaagggaagaggtactcccaacacggggtgcgcaggttctggctctccaagcgccctgactacatgcatgaactagacaacccgcccaccgaccggaagtagatccaatgacggatcgtccatgagaagaggccgccgtgtttgctccatccatcactcatatatgcatactacaagaacaaacgtgcttcgtcgcgcctgctattattgttgttttcctttgtttactatatccgtgtagtcatacatgtatgtttttgtggttgaaaagaactattttgttgttttctttgataanaaanaaaaaaaaaaaaaaaaaaaaaaaaaaaaaaaaaaaaaaaaaaaaaaaaaaaaaaaaattaaaaaaaaaaaaaaaaaaaaggccccta

SEQ ID NO: 60077 - DNA, 630 bp, Triticum aestivum
  Clone ID: PAT_TA_60077
gccggccgggttcggaatagagcacttcgccccacagcgcatacccttctccatctctcgccactctctctccctctctgcaagcgtgcacggacgccatggacaatcctccgcccgcggcggcggccaacaacgtggccaatcctccggcggcggcagcagccaacgacgttgccaatcctccggcggcggcagcagccaacaacgtggccaatcctccggcggcagcacctgcggctgctccagcagcgaacgaccccgctgcagcgcgcgccgcgcggcacaccgcctggaagaagaaggacaagaagcttgcaatcatatctctgtcgttctggcgatcgtcctggttctggttgcggtgctgtgcctccaaccctggaaaaagtagagaatctatgcatcaagatgcgtggcgtgctctgagtgcttctgtgggatcgagggacctgatcgtgtgcgtggttaaggagtactactacgtacgtccaacctatatatgcagtttgttcttcgtaccatctatgtagttcattgtggaccaagtaaaatttcagattggtgtgccgacggtgaacatgcaacagctgcttaattagagcacaaaaaaaaaaaaaaaaaaggccccta

SEQ ID NO: 60078 - DNA, 671 bp, Triticum aestivum
  Clone ID: PAT_TA_60078
gccggccgggccgggatcctctcctccatatatcggagatgcgatgcttgtcaagctcaacagccttcttttgccgagagtgtgctgtgttcggattttagctcacatccattctcatggctgcagtgggcggcgcctggttccgccgctcgccacggcaggcgtcttcgggggcataggcagaggccgaggccgccccacggggacgctagccgccacgccctgctcaccgtggagggcgaggtaacggtgcggagctgtttgacgaggacttggttcaggacgtcctccacttctctccctatgcgaagcgcatcgctcgtgctccgtttcgccgccgactgatgcgcccactcaccggcggcgtgaggacgctcgtgactcttccaagagccgtacataagaggcgcggagcatcgacgagagtacctcataccttatgtagtgtctggttgcctgcttggtgcctgacgctctattttcatctatatttcgcgtgatggtagaattctatttcttgcctccctttgccccgtatttccatattatgcgcggcctgtcgactgtgctgtatcgtatactagtgtcctatgtgcactgactgtatccattgaatgtatgaatttgtgaccctatatttgcaattggattgccctgatggccccttgcgt

SEQ ID NO: 60079 - DNA, 387 bp, Triticum aestivum
  Clone ID: PAT_TA_60079
gccggccggtccgggaactttcagagatgaagcttgtttacgaggttattgtaccttctcaggcacgaaaccccatatatcagtatctgctgtggtttggtttggctatttatgtccctgcattttatatcctttttggacacatgctagctcagagggcaaagttgaaccgatctatgtccaagaagcagtcttgattttgtcagttgacttcgtgttcaagtttctgatatagaaatactttataggcaggccacatcatgggttggcggagaatataaagaccaaggtcttgtattgtcagaggaagctgtctgtctatagaggcaagattcatataatgatatcaaatttcaattttaaaaaaaaaaaaaaaaaaggccccta

SEQ ID NO: 60080 - DNA, 409 bp, Triticum aestivum
  Clone ID: PAT_TA_60080
gccggccggtccgggaactcggcagtttcagcgcagtgcactcggcagccaggaccaacgacgcggcgacgacggcgagcgtgaccgcgagcgcgccaagtctccctacagatccgcgcggcggccggcaagatgtttgacgatcaagacttgggtttcttcaccaacttcctggggatcttcatctttgtgttggtcatcgcgtaccactttgtgatggcagacccgaagtatgagaactgatcgccttttgtttagcaatgagaccgtattatactcggagcaaatagggaaatgtgtcggttaatggtaacagagcgcttgacagatcttcttaattgcaattacctggcattgtgacttgaatcatgtttaatctgtagaaaaaaaaaaaaaaaaaaggccccta

SEQ ID NO: 60081 - DNA, 535 bp, Triticum aestivum
  Clone ID: PAT_TA_60081
gccggccggtccgggaaaggaagctttctaccctagcagagaaaaaaaaaaagcagaggagaggaagcggaggcgacgatgtcggcgatgacggcggcggtgcccttctggcgcgcggcggggatgacctacatcggctactccaacgtctgcgcggcgctggtgcggagctgcctcaaggagcccttcaagaccgaggtctcctcccgcgagaaggtccacttctccctctccaagtgggccgacgagaagcagcagaagcccactgtgcgcacagatgatgaatgaagatcgggtgccatggtgatgttttgagaagttgttgatttatggtcagggcttaagaacttgagaataaattcttgcggtgacaatggatctattccgatactatgttgttatatttactaattgctcctgttctacttgatgaaccatgtgaaactcttgtcttgtgctgctcgagtgagcgtgtttttatgcattatatcttctgatgaaaaaaaaagaaaaaaaaaaaaaaaaaaggccccta

SEQ ID NO: 60082 - DNA, 650 bp, Triticum aestivum
  Clone ID: PAT_TA_60082
gccggccggtccggggttgacgcatatcacaattctttttgctcgaattgtacaacctgcgaggttcgtgttgcatccaactattacatcagttagtatggcttccggtttgtttgcaaacttgtccggcatttctgcatggcatattcctgctatatttataggtactgccttcaccctaggtggtcttttaccttttcgatcacctgctcgggccatgcgtgaatatggactaccagagggtatcgccagatcggaaccagcacagacagcctttgccgtctacggcagccgtgtctcagcttacggtcttgctatatggctgttctatctacgtcgccaatatgatgttgtcgacacattgctcagtttgctcgtctggtggggaacagctgatttatggatatgtatgagagctggtgcactaagtacggggatctggaggtttactagcagtctgttgcttggaggttgggggtatctgggattgactgcaaagggagcgttgtaagtttcactcatactggtatccccaatgttcatgttgccgtgagaagaacatgtatcgacagcatatattaagtgattaaattaggaaacacaataaaaatcggcatacgcatcaaaaaaaaaaaaaaaaaaggccccta

SEQ ID NO: 60083 - DNA, 808 bp, Triticum aestivum
  Clone ID: PAT_TA_60083
gccggccgggtcgggaactgtgctcttctcctgcttgattcttcaggcatagcactcgcagcaccaagtttccagggtcgcgcccgtgtgattgctgatcaatggacacggcgcggcgctcaccggtctgcctcgacctcatggtcgggcttcccatggtctgcgagccatcttcagcgaggtgcaccggaatgagagcccaagccgacattgcaagctcggcctgtggcagagcaacttccatgaccagcagcgaggcaaataagattatggaggcgaagttcacggaggtgaccgaggagaaccggaggctgaccgagatgatcggctacctgtacgctaatagccagaatttcgcgcgacagagtcccgaaggcgagggcgagcagcccgcaagtactgctgcgtcgccgacatcgccggtgggcaagaaaaggagcagggagagcatggacacgtcggattctggcgatgtcaacagcgacaagaaaatgggcacggccgaggccgagcatatcgacgtcgagagcccgctgagcaacggcacttgccggagaatcaaggtcaagagggtctgcacccggattgacccatcggacacgagcctcgtggttaaagatgggtatcaatggcggaagtacgggcagaaggtgacacgggacaacccgtcccccagagcctacttccgatgcgccttcgcgccgtcctgccctgtcaagaagaaggttcagagaagcgcggaggacagctcggttggtggaggcgacgtacgaaggcgagcacaaccacccgcgccccacgggggccg

SEQ ID NO: 60084 - DNA, 417 bp, Triticum aestivum
  unsure (1)..(417): unsure at all n locations
  Clone ID: PAT_TA_60084
gccggccgggccgggtcacatggatatctaatgctacatgtcttcaagaccnttggaaaggaagttacctacagcaagaggatgaagacatgcaagagctacgcagcaggattaggcatgaaccagcggtcaaatcacttaccgaggacatgcaacaagatgatagccaagaggccctcaaaaagttcatttgcttgtcaaatgtccagagcaagcagcaccaacctcttgtacaggagtgccaatttacctgcacaccagaacaaggaagatgtacaaatgcatatgaactcttaactagctacaactataatgccaggactccacttcccatgaacatacagtacttactgtacactttcacatggaaattcaaactaatttctcatccaaaaaaaaaaaaaaaaaaggccccta

SEQ ID NO: 60085 - DNA, 699 bp, Triticum aestivum
  unsure (1)..(699): unsure at all n locations
  Clone ID: PAT_TA_60085
gccggccgggtcgggatcttgacacatccctcaattgcttactcttcacactctcatccatcaaaatgacagactcgacagccaaaccaaagaacgaaatgaaggttctatccctaggccttccccgcacaggctctgcctcaatggcagaagccctcaccagactcggctacaaaaacgtctaccacgccatccaagccatcgacagcccggaagactggaaaattttagagagagcctgcgacgcttcgttccctaatctgccgtcttatacgggaaaaccgttcacccgcgaggaatgggatgagctctggggtcactgcgaaggcaccacagatgtagcatctattttcgcaccgcagctcataaaggcctacccggacgcaaaagtcatcctcgccatccgtgactttgagccatggttcaaaagcgtcgaccagagtgttttccatcacctctggaatccaatggcccatttcagcgtcaacgtcatcgaacccctcgtcggatccgtagccggccgctcagcgcgaaaacaattactcggcttattccaagcgcaaaccgttgacgaagcacgcgccaacgcaagagagacgtgggagagacatcatcgggttattagagagatggtgccagagggacagttgctagagtatcgcatgggacagggttgngggcctgtgtgtgagtttttgg

SEQ ID NO: 60086 - DNA, 699 bp, Triticum aestivum
  Clone ID: PAT_TA_60086
gccggccggttcgggtcagtgcgattcctctcaacgttctcaacgacgtcaaatttgatccgcctctagcaacagggaagaaggcagctgctgatatcgggcacgtcaaccaatgtatcaaagtccacgccgaagtctcagataaagatctacggtctatgactagtatcagctatcctcacaataaactggcatatggctttggtgacggaactacaccagcgggaaatacgcacatcgtggctttcggaggacaaaacaatcacttccatcctgaagagaacattcaaactacactggatgctttccaaggatttactccgatgaagattgagcgtttggtcttccacaactggtccaaagatgaattcgccaagggcgcatggtttttctcacgacctggtcttttggctgatcatctaggtgacatgcgagctagtcaaggaaacatcatctttgcgtgctcagactgggctctcggatggcgtagtttcatcgacggtgctatcgaagagggaacgcgagcagccatggttcttcgatctactttgtctgagagaagccatctgtgatgctatgatttgggagtttctgtatagcactgtatcaaaagttagcattagacattaccgttcaatagcttactcgtatcatcatccaatcatctttaaagaaaaaaaaaaaaaaaaaaggccccta

SEQ ID NO: 60087 - DNA, 735 bp, Triticum aestivum
  Clone ID: PAT_TA_60087
gccggccggtccgggattcaggttatccaaaaggtgggtaatgtggcgtacaagctcaagctgccggagacaagcacggtgcatccggtgtttcatgtctctcagctccgcagtgcactgccaccatcggaaaatgctctggaagagttaccacacgaagcggcaccgcagccggaaccggtggaggtgcttgacagccgcattcatcatcgcgcaggcgtagacgtaccgcaagtgttggtgcgttggactgaccagccagcagcgctggcgacatgggaggaccgagaggagttgcggctgtacttcccagctgctacagcttggggtcaagctgcgtctcaaggaagggggaatgttacggcccctcctacttcttcagctacaccaggcgctgctacttctacgaccaaggcccagacggagattgaggcccatggccgaccgacgcgggctcgcaaggggagtgagcggtacccggcccatagctgggtcactggctgatcgagagggatatgtacctgcgagcgtggagagggaggcaggctggaacaagacacaggcggcggctggcttcctcctacccccaattcccctttctcctaccctagaacccgagcttgtatcctaaaattcagtcctgtaatcgaagaaatatcctgaaccttagatcgagagcataacacaaaatgtatatgcgagatgtgacattaatgttgtgaacaaaacccacat

SEQ ID NO: 60088 - DNA, 523 bp, Triticum aestivum
  unsure (1)..(523): unsure at all n locations
  Clone ID: PAT_TA_60088
gccgtttcggaccgtgccaggngnggcttcttcccaacacggcctcggctcccggnccgacccgntccggcgatagggtttttagcaccggggaagaggaaggaatggcggacgtctagtaccgctgcttcgacggcggcctcacctgggccaccgacaaccagtccctccagaacgccttctccaagtacggcgacgtcatccactccaagatcatcactgacagggagacgggccgatcccggggcgtcgggcacgccacctacgcgtccaactaggcgaagcaccgggcgagcgacgccaggaacggccaggatgcttgaaggtcgtgtcatgccgcgacacgaggcggagtaccgacggtccgtcggaggaggcggaggcgagttcggcggcgggggcgcgggctagagggttcatcgcccggacgccgcatatgccctgccctagggggccttgggtgcatgcgtagtgcaggggcccccgcaattgcttcatctatctccactatggaagcagcgat

SEQ ID NO: 60089 - DNA, 769 bp, Triticum aestivum
  Clone ID: PAT_TA_60089
gccggccggttccgggaattgtgaattctggcgtgagaacagactctgactctgctgttgctctcttggccgaccatgagaagctaaaccatcctgatcctcttgttcggacagcttgcatcatgggtctgggactggcgtatgctggatcgaacagggaggatattctcgagcaccttcagcccatgatttccgactcttcttgcgatatgcagatctcagcgatggctgctctatcttgtggtctcatctttacaggctcctctcaccctgagatcagcgaagctattgtcaccactctaatggacgacgaccgcaagagccaactgactgataagtggacacggttcttggcccttggcctgggtcttcttttctttggccgacaagaagaggtcgatgtcattcttgaaaccctcaaagccattgagcatcctatggccaagtctaccgccgtgatggctgagatctgcgcttgggctggtacaggtgctgtgctcaagatccaggagcttcttcacatctgcaatgagcaccaagaggaaactgacgagaagaagggcgatgagctactacaggcatatgccgtcatcggtattgcccttgtggccatgggcgaggatattggccaagaaatggttttgcgacagtttggccaccttatgcattacggtgaagctaatatccgtaaagctgtacctcttgcaatgggtcttatcagccccagcaacccctcaaatgaaggtctacgacactctgtcaaggtaca

SEQ ID NO: 60090 - DNA, 531 bp, Triticum aestivum
  Clone ID: PAT_TA_60090
gccggccggttccgggacaagtctcctaaacgagtggagccgagcgcggtgtgcagctaagctagctacggtctttcttttttgctgtgcgcgcagtgcagctacgatctacgtaccgtgccgtggccatgggcgcgcaccccgacgccaaggacgacccgcggttcccatgccgccgccgagcctgcgtgcacccaccaattccaccgaacacgccgccacaggtgcccaagcccaacaccagtcggctggtggacgcgccgtcgagctacgccacggccggcaaggtcctgttcgtcgcggccggggcgttcgcgggcgtcctcctggccctcatctttttgcacctctacaacagcggccggcgccagcgcgcccgagatcgtcgccgcctcaaccgcagcctggccatctacgtcggcgacgcggacgaggaggcgccttcgccgcgggggctcgaccccgcggtgctccgcgcgctccccgtggtcgccgtggccgtaggcgccgagtactgcgcggtctgcgtcg

SEQ ID NO: 60091 - DNA, 650 bp, Triticum aestivum
  Clone ID: PAT_TA_60091
gccggccggtttcgggatctgcaattccccacctccaagtgtaaacacctcccactccctctcccacctccgaagcagccgcagccatggcccccaaggcagacaagaagccggccgccgagagcaaggtcgagaaggcggcggagaagaccccggcgggcaagaagcccaaggccgagaagcgggtgccggcgggcaagacggcggccaaggagggcggcgagggcaagacgaggggccggaagaagggcagcaaggccaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcgcgctacaacaagaagcccaccatcacctcccgggagatccagacctccgtccgcctcgtcctccccggcgagctcgccaagcacgccgtctccgagggcaccaaggccgtcaccaagttcacctcctcctagactgaatctctgattgcgtcgccttgttgttccaaatgtagtagttggctgctgctgactctgcttatctctctgcaagtaatggtagtggtggatgaactgccc

SEQ ID NO: 60092 - DNA, 616 bp, Triticum aestivum
  Clone ID: PAT_TA_60092
gccggccggttcgggaatcagagcattccgatacagcgcaaccgccgccaacaccactcctagcgagtcctcgccgccggagaagcagcaagaagatggccggaaggaagggtggcgacaggaagaaggcggtgacccgctccgtgaaggctgggctccagttccccgtcggccgcatcgggcgctacctcaagaagggccgctacgcccagcgcgtcggctccggcgcccccgtctacctcgccgccgtcctcgagtacctcgccgccgaggtcctggagcttgccggcaacgcggccaaggacaacaagaagacccgcatcatcccgcgccacctgctgctgttcgtccgcaacgaccaggagctcggcaggctgctggccggcgtcaccatcgcccacggcggcgtgatccccaacatcaactccgtgctgctccccaagaagtccgccgccgccgccgagaaggaggccaagtcgcccaagaagaagacctccactaagtcccccaagaagaagaccgcggccaccaaagagtagcaggtcccatagcttaaccagcgttgtttatatcccatttctcatggattataatgagatcctgtctgtaatgcctg

SEQ ID NO: 60093 - DNA, 578 bp, Triticum aestivum
  Clone ID: PAT_TA_60093
gccggccgggccgggacattcccaccgctcctcaacctcctccgtccgctcgcagctcgaaccaagcagagaccgtcagccatgtccggccgcggcaagggaggcaaggggctcggcaagggcggcgccaagcgccaccggaaggtgctgcgcgacaacatccagggcatcaccaagccggcgatccggcgcctcgctcggaggggcggcgtgaagcgcatctccggcctcatctacgaggagacccgcggcgtgctcaagatcttcctcgagaacgtcatccgcgacgccgtcacctacacggagcacgcccgccgcaagaccgtcaccgccatgttttgtcttctacgcgctcaagcgccagggccgcaccctctacggcttcggcggctaggctcttcctcgccaccccactgcagatcccgaaagtttgatgataccgcgacttgtgtagttcgctagttcctctgtagttcgctatttcctctgtatttcgtactgaatcgtggagcaaagttattcgcagtttgttagaaatcaaacatgtctctgaaaaaaaaaaaaaaaaaaggccccta

SEQ ID NO: 60094 - DNA, 524 bp, Triticum aestivum
  Clone ID: PAT_TA_60094
gccggccgggccgggaattccattgactctcttgctgcaatcccaacaagtttctcatccacgaaagacaccgtcgatcaagatgagagccaaatggaggaagaagcgggttcgccgcctcaagcgcaagagaagaaagatgagggccagatccaaataaacgcatcgcatctcaacctgacttgactcatctatcatgatgttacgacctcgcacgcctcaacgataccttggccgaagcagggcacttgccgttctggcgcctctgggatctcccgcaacgcattgagctgggatttgactttgggaattacgtcagggtggttgaaccccgcacttgagcggctgatgtggcacacaatgaatattatggtggatgggattatgacaatcagatggtcaggtacaaggcggtgttggatcgaccactatcaaatgctcaccaacacaaagcatcacaacaacattcaaagataaagaaatacagagattcctccgaaaaaaaaaaaaaaaaaaggccccta

SEQ ID NO: 60095 - DNA, 515 bp, Triticum aestivum
  Clone ID: PAT_TA_60095
gccggccgggccgtgagcccgcatctgccatccccgggttcccctccgcggttccctcatccggcttcgccgagtcgtcgcgcatcttcgtcctcccctccgtggcgtccttcgccggtctaccctccccgatgcggtctgcacctacggactcccctcctccgtcagcagctccagtcgccacccccgcagtggaatgaatcactcccacgagatggagggaggcacgccgtcgaccatggcatcaggggcggcccagaagacttcaagttagttggttcctctccccgatggaacacgcacatgcgcgcgcgcacacacacaaaggacgggattggatgcatacgcccccaccggtgggttggtcatgcttattgggttagggccgtgtgatgatttctttaacacaggcatgtttgctagtaattttaaagtgtaccaagaaaaagaagagaagacaaaacgaataaaatcacttttgttttgcgaaaaaaaaaaaaaaaaaaggcccctaa

SEQ ID NO: 60096 - DNA, 414 bp, Triticum aestivum
  unsure (1)..(414): unsure at all n locations
  Clone ID: PAT_TA_60096
gtgcgccgctcgagccggccngtcgggattcattcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgttttcttacgtacgcacgtgtgatggcgtgagagtatacttgaccaacgagcgcttgatctgat

SEQ ID NO: 60097 - DNA, 148 bp, Triticum aestivum
  Clone ID: PAT_TA_60097
gccggccgggccgggatataaaaatcttcctgtagcggtttttctcggaggctaacgggaaagccggtgttcgaccggtttcaaaaaatcgttctggattatcaactaagtatgtgccgtgaaaaaaaaaaaaaaaaaaaggccccta

SEQ ID NO: 60098 - DNA, 765 bp, Triticum aestivum
  Clone ID: PAT_TA_60098
gccggccggtccggggagcttgttgccttgaaccattccttttcctttgttcaattaagacaactgggtcaatcaagggcacaaggttaacaatctactggataatgcagtctttttcaatcccttgaaacctcccatacacacacacacacaaccagctcatcatggccgacgattctgcccccctcgcttccctctcggtcacgcatgtctactatgaccccgaagatcacctctcgctcgtatgcgcctaccttgctctcctcccccaagcgctatgcgtcgtctatgctacactcgtgctcttcacccgcgaggtcgaagtcggcctcatgttccttggccaactcgcctgcgaagccctcaactttgctctgaaacgtcttatcaaggaagaacgaccacgtcgtatacacgggaaaggctatggtatgcctagttcccacgcccagtttgtcgctttctggagcgtctctcttgcgctgttcctgcttgtccgtcacaagccccctcgcgtgctcaagagccgcgcggacagcggtgtgcaccgaccatggagtgttatcgaaaggatggcagtgagcatggctggcatggcgattgcggcagcgacggcgtggagtagggtatatcttaactatcatacccctaagcaggtcgttgtgggctgcgctgctggtgctgtgagtgcgattggatggtttatcatcgtcgccattgtgcggcagacgggcttgttaggctgggccttggagacccctttgg

SEQ ID NO: 60099 - DNA, 568 bp, Triticum aestivum
  unsure (1)..(568): unsure at all n locations
  Clone ID: PAT_TA_60099
gccggccggtccggctgattgttactgtaatgacattgatcaaccttgtgccagggggttgcctcgtcggcacacctttactgtgcgtgacggctgcgatgaccttgtactactcctggcaagtggtggggcagagaataacagagcaccaacatcgacagtcttaacagctagcgctttgccttgtgctcgtcgcatcgcatggagtttccttgtgggctaatctttgtactaggacaactgtatgtagatttagcggtttcgccactagtggactcgtcatcttatgaaagcccatgcggccgtgagatattgactcccttatgaagttatgatgggttgtgtatggtacttgtactgagacggtctacttgtaatgagatgttttcagtgctatctggtcaggcaagagattgccgtcagattggtgctcggttaagttaaatactactgctagttagtaaannnnncaaaaaaaaaaaaaaaaaaaaaaaaaaaaaaaaaaaaattgtaaaagttgatattattttttaatttatttctccaaaaaaaaaaaaaaaggccccta

SEQ ID NO: 60100 - DNA, 365 bp, Triticum aestivum
  Clone ID: PAT_TA_60100
gccggccgggtcgggacagatgtgaagtggttgattggttatcgttctatactctaggttgctgttcgcgggatcgaatcacagatctggcgcaatttttgcagtttaggaaacaagaaaaataaatcaaaatgggtcggcccgaccgtgatgagggggtgtgcgcccgttagtagaatgaacagtatcgggcgctgagggcgccgaataggatttggctccgtgtcaggcctcatcttggcggaaaacgggcgtgccacgggccaaaaacgggccgttgtcgcatgcctggtcgggtccattacgtgtcgggcacgcgtcatcgtgggtcgacccacgaaaaaaaaaaaaaaaaaaggccccta

SEQ ID NO: 60101 - DNA, 464 bp, Triticum aestivum
  Clone ID: PAT_TA_60101
gccggccggtccgggaagatctcattcctcattcctcatatcaaacagacatcatgaagttcactaccctcgccactaccatcctctctatcactcttggggctgatcttgcttcagccgcttgttgcgacctcaaagtctgtgatggcttcaacctcaagggcaggtgcaagactgcttgctacccctacaccaacacaccagtcgctatcaatggagacggattgagagggcctatcgcttctggcaagactgacacggattgcaaatgtaccttgggaaaggaccacggatcctgcatgctcgtcaaatccaacaaaaagggcaccaatgctcctaaccattgccttactggcattgcatttgctcaatgtcaacgtgcctaagctatagaagtgcataagtttagtcttcaaaaacattaagctattgttttccaaaaaaaaaaaaaaaaaaggccccta

SEQ ID NO: 60102 - DNA, 829 bp, Triticum aestivum
  unsure (1)..(829): unsure at all n locations
  Clone ID: PAT_TA_60102
gccggccgggtcgggggaacgcttaggaccacacaatggcgtctcctcctccatcatccaccgtgatccagatgcctccaagtccacaaaccaacggccagccgacggccgggacagtcccggccatgcctaatgatgccggtgacgtgaccatagcacctgcagcagctgccggaccagcatccaaggcaacggacaaggtcatgtcgagcgccgcgaacctcgcgcagctcctgccgacgggcacaatgctcgcgtaccaggctctatccccgtcctttaccaaccacggcaagtgcgaggcctccaaccagtggctcaccgccgcgctggtcatcatcctcgccgccctgtgcatcctcttctccttcaccgacagtgtcctcggccgcgaccagaagctctactacggcgtcgccacaccacgcggcttcaacgtgttcaatttctccgacgaagaggagaagctgaagtggactccagctgagttccggaggctccgcatcaggccactggactttttgcacgccatcttcacagcgctggtctttctcaccgtggcgttcagcgacgtggggctacaaaattgcttcttccccaacgccggcaggaacaccgcagagctgctcaagaacctgccgttgggcatcgcatttctgtcgagtttttgtgtcatggtcttcccacaaagagnaagggcatcggttacaccgacaccactcctcgcaagaagctcacttgatggttagatgatcatatccacttttttttggacatttagatacaacgtaatcacgatatattttaacttgtgggatacttatttttg

SEQ ID NO: 60103 - DNA, 195 bp, Triticum aestivum
  Clone ID: PAT_TA_60103
cgtcttccactcccgtcgacattacatcagacaaaatggcccccgccgcaaagaagcagaagaagaagtggtccaagggcaaggtcaaggacaaggcccagcacgccgtcgtcctcgacaagaccacctctgagaagctctacaaggatgttcagtcttaccgtctggtcaccatcgccaccctcgccgaccgaa

SEQ ID NO: 60104 - DNA, 805 bp, Triticum aestivum
  Clone ID: PAT_TA_60104
gccggccggtccgggacgtcctccccatggagaagagtgtgttcatgcttcaccggctcctcttcctaatttgccttattctagcagcccgcaccatcggagagggcaatggccagctcctctactccggtttcaccggcgccaacctcaccctggacggcgcggccacggtgaccccagacggcctcctggagctcaccaacggcacggaccagcagaagggccacgccttctaccggactcccctccgcttcaccggctctcccggcgccgtcgttcagtccttctcggcctccttcgtgttcgccatccagtccatcttcaccgacctgagcgcccacggcatggccttcgtggtggcgtcgagcaccaacttctcgtccgcgctgcccggccagctcctgggcctcacggacgtccagaacaacggcaacggcagcaaccacttcttcgccgtggagctggacaccatccagaacaaggagttcggcgacctcaacgcgaaccacgccggcgccaacgtcaacggcctcagatcgctgcagtcctactacgccggctacttcgacgacgaggacggtagcttccgcaacctgagccttgttaaacacgttagcttctgtatcagggtacggtagttagtatctcttatctacccgtagtcattatcccttgtaacaaacttgtgtgtaccggactgccggctatgccctagggcatcgatatatatagactccgaggccacccccttggggttgtgccgttcccatctctcgaaaaaaaaaaaaaaaaagccccctagggc

SEQ ID NO: 60105 - DNA, 297 bp, Triticum aestivum
  Clone ID: PAT_TA_60105
gccggccggtccggaccctcccaataaattacctgagctctcttcgggttaatggggacgtcgtagcttaaaacactatgcgtcctggtgaaaaggggaaaatttaaaatggaagctctgtcgtggcacagatgtcttctgaggattgggtaagaagactgaggcgtataagcgattgatatacctatgttttcctcccactgttctaccaccatagacttggaaacgagtcttgtctgtaccatagccataatgaaaaaaatacccaactaaaaaaaaaaaaaaaaaaggccccta

SEQ ID NO: 60106 - DNA, 565 bp, Triticum aestivum
  Clone ID: PAT_TA_60106
gccggccggtccgggcacttactacttcctctccctcttcctcccttcgtcttcctcctcccatctcgcgtacacaacgagataacgtgcgaggtctctcgttcttctccgccgatttcggggagagctcagctgagctagcagccatgatggaggcggccgcggcgacgatgctggaggccggggtgggccggttccgggggccgagcctcgcagcgctcgcgacgctgcccagcctgctcggcaggctgcaggtgctcatcctccgcctccgctcccgcgggaaggaggtcatatcgtcgcacatctccacctactactcctccggggacgacgagtccgactccgacggcgagggcgaggacgaggacgagagctccgatgaggcggccaccagctcctccggtgaggaggaggctgtgaggaggatcgggtacttcgagggcgccgccgacggtctcgacggctgcttcccgtggggcggcgctgtcgtgcggacgtggcaggacctcccgcggcggttctccggcgtcggttgcgggggaggagccaggttcccgtccgg

SEQ ID NO: 60107 - DNA, 572 bp, Triticum aestivum
  Clone ID: PAT_TA_60107
gccggccggttcgggaacgacgacgtcaacagcctcactcgaaccgcgcgcacgcttttctcgactcgctagacctctcctactccctacgcgaacccgataccaacttcatcacaatggcccccaagcgcatctccgtcgagcctcgatctcgccgtgctcccaagggttttgtcggctccacctatgacgctcttacctctcccgagaacgccgctgtcgtccgcagcatcgctctctttggtgctgtcgtgacattcctgtccagctcttggggcgagatccttctgcctccccagtaaatgacgccgtaacgatatgcgaccaaagaatctgcgtgggaatggaaaaaatcagtttaggagctagggatgcgccatcatccgtctcccatctgtgcattatataatcgaatcacttgtacattagttggagtcagtgtacgttttagacaggaagggatttcaaggctagcctgtgcctgtccaagggcattatgatacgggctgcatagaaatcgacatgatcaatacctacgggttggacaaaaaaaaaaaaaaaaaaggccccta

SEQ ID NO: 60108 - DNA, 532 bp, Triticum aestivum
  Clone ID: PAT_TA_60108
gccggccgggctccgggaccaaagtcgcatctattcacgttttctgttaaagcaacctgtttctacgcttcctccgtctctcaatggtgcttcactgtgagcctctcggttaacgtttgtttgccatctgccagcgtcagctcgcctcccgaggaccacagaacgtgctttctttttttttcttcctggaggaaaagtcgggtgatgatgggaggcgtcttatggggaaccccggggtatatgtacagtcgtcaaatcgggtgtcgtgtttgttctttgaaaaaaatgcattatttgcagattttatacgaatactctcgcaaaccgtggcgcactggtacatctattatttgctgtttttttccatttcctttccatatcgctttggggaacatgaccatgatgatcaactcgagtaacgaggagtagaaacgaggcatgaattcggggccactatgagattaagtcgttgtagagattctaactgttttattccatctttatacaaaaaaaaaaaaaaaaaaggccccta

SEQ ID NO: 60109 - DNA, 480 bp, Triticum aestivum
  Clone ID: PAT_TA_60109
gccggccgggttggccttactcctattgccaccgctggtatcagttacggttatggtttcgtctttgtcggaacaacttggctgccgctgcccttgtttggttcttccttttcgaatctcgcgccctcagtctggagaacgtcgacctcatgtacggccaggagggtctcaagccttggaacagtcacaagtgggttcctcctggatacatcacccgcgagcagcgagacgaagtccacttccaacgtggcaacgagaagcccaggaacagcgagtctcactctggagaagactcgagagtcgagtcggttatggcttaaagcaggctgcgtggaaattagcacttgatgcatacgaggcgtttttagttttatcactgtataactacggtactggagtcgttggcagtctaacctggaaattgttagatgaattatgattatcgtttgttctgaaaaaaaaaaaaaaaaaaggccccta

SEQ ID NO: 60110 - DNA, 465 bp, Triticum aestivum
  Clone ID: PAT_TA_60110
gccggccgggccggtctctatctctctgtacgagcgcaacctccaggataccaccagtatttcaccttgactttgttgcattgggtcaggtgtcggtctggcatttcaagtttccttatctgacgaagtcatgagcgtttcgtccattcttgtatgccacgaagcatctgatatttcggtggctggcgaagggggtggcagttccatctcatggatttccatctgtgtatttagcggtgacttttctttcttaacgggatcatcttttctctttttcactttttcttttcacactgataattcttgctcacgaaatgatgggactacgacgatttgacgactatgtaagactgatgacaaaaggggagggcctggggaagttgaggagaggtggaaagtccaagcttcaattgaagatgctcaggcattcgtacatatgaaaaaaaaaaaaaaaaaaggccccta

SEQ ID NO: 60111 - DNA, 313 bp, Triticum aestivum
  Clone ID: PAT_TA_60111
gccggccgggccgggacgcgacacggtttcttctcaagcgttccgtgtggaaggggcacacttggtgcccctccccattgtctggcccaagtccaccagcgacaaggtgcctccggtccgaacacaagcccgatcagccacgatcctgcccaactttgtcggtctcaagttcgaggtgcacaatggaaaggattaccacgaggtgaccattactgaggatatggttggacacaagcttggcgagtttgcaccgtaagctagacatttcaaaacgaattaacaagacgaaaaaaaaaaaaaaaaaaggccccta

SEQ ID NO: 60112 - DNA, 850 bp, Triticum aestivum
  Clone ID: PAT_TA_60112
gccggccgggtcggaaactgagcttcgagcttaaacatcacatcaatacttctcaacactacctacaacatcgaagcttatatataccttatagcaagcacggcatcttctcactccatctctttatttaattatggcgcagtccaccgcccaccgccgccttctccaagagtaccgcgcgctcaccaacaatccaccagagggcatcaccgccggccccatctcagaagacgatctcctccactgggaatgccttatccaaggtcctgagggtactcccttcgagggcggtgtcttccccgctgagctcaagttccccaaggactatcctcttgctccgccatctatgcgcttcctcgccgatgtgtggcacccaaatgtttaccccagtggtctagtctgcatctctatcctacatcctcccggtgacgaccccaaccactacgagcacgcttcggaacgatggtcacctattcaatctgttgagaagatcctcatctctgtcatgagcatgcttgctgagcccaacgacgaatccccggcaaacgtcgaagcagcaaagatgtggcgagagcgacgcaccgaatacgagaacaaggtccgtgagggtgtcaggagaatgctgggactataaggtacccgtcgttacagcgcaagaatatacaactcagagtggcagggggagtatccgggcacatcattttggcatggttatggaatagaatggtgatcggcaagcggatggcccccaaaataaaactgtttatatactctccccttagagaacgcttcaattttaaacgtcttataaactccaaaaaaataaaataaagccctaggaccccgcccc

SEQ ID NO: 60113 - DNA, 818 bp, Triticum aestivum
  Clone ID: PAT_TA_60113
gccggccgggccgggattttactttcgtatcgctttttgatcatctcgatctgtctcgccggctgttcgatatacctgggatggacacatatatcgatggtcgcttcgagcgcctcgaagaaagcacttgctattttaatatgattcagacaccaagtttcatccttctatacaccatggtgatgaactcaacgcagcggacaaagagctaacgaagggcttggaagaagtgcaaactcaccagaacgactacctacgtatacaacagactgcgcgaatcctcaacagccctcgatacccagatccgcgaaacactctccaacctcgcgaccactcgcaaggatattgtcacgacgcacaccacaaccttccccgctggccctacctatgccatcgcttacgaggagctgctcaactatgctaggcgtatcagtaaaacgactatgccccctgctggtaccataaaggctgtgccagcaacagtagcacctcctacgcccgagggccaaacgcctggcgttcagacccctggacccgattcgcaaaccgcgtctgtcatgacaccctctgcacctccgtcgtcccaggttcaaagcccggcagtcatgaacggtacaccgcatgtttcacaagaccctgcaacacaacagtctgcaatgtccgccaacactagccttcccagcgagtggacccagttcttgaaccccttgaccgatcagatctttcttccatggccaaacgatcttcaacttggcgcaggcgctctggctgcccatcaagtcttgctagagcaaggcatcaacccccagggatacgat

SEQ ID NO: 60114 - DNA, 799 bp, Triticum aestivum
  unsure (1)..(799): unsure at all n locations
  Clone ID: PAT_TA_60114
gccggccgggccggggccattcttctcgtatcaatttctcactgcttcaaaaatgcactgccttcttctcctgaccgctgcgtctctcgctgcggctcacgttccttcagtcagcgtgcccgcatgtcccaaatacggcaccatcaagttttccaaatctgttcccgacggtgatcctttcccgcgtaccgaagtcgacctctgctacacagacaccgctttgtccctacaattcacggcctttgacgagaaatacttctactttaacgaatcccaaggaaccaacgacgatatctgggcttacgaagtcgttgaggcgttcatctacaaaggaaccgacgatccgcagacctatctcgagtacgaaatcaaccccaacaacgtaacctaccaagcctttgtctacaatccctccaaggttcgagccgagggcgctccgttcgaccatttcttcatctcagaccctgaaggcgatggattcacggcagagacacaactaaacaagcgggcgaaaaagtgggtgagcaaggcacagatcccgctgggtctgttcaacgtcgatccgggatgtgcatggggtacaaagtggaggatgaatttctttcgcacggttacgagccccaagatgtttcctgaccaagaccttggtggctggagctcaccagataaagccagcttccacattacgaagttctttggtcatgtcaactttgtgtagntggaggagtaatacgagaggaggntaccctgatatcgaaattgattccattcccagaaaaaaaaaaaaaaaaagccccta

SEQ ID NO: 60115 - DNA, 631 bp, Triticum aestivum
  Clone ID: PAT_TA_60115
gccggccgggtcgggagaacctgttcgttatcaaggctatgcagtcgctcaactctcgcggctatgtcaagactcagttctcttggcaatactactactacaccctgacccccgagggtctcgactacctccgcgagtggcttcacctccccgctgagatcgttcccgctacccacatcaagcaacaacgatcgcacgctcctccccgtggcatgctcggtgagggcgagcgcgagcgacgacctttcggccgtggccgcggtggtgaccgaggtgaccgtgagggtggataccgacgaagggatgctggcgagggcaaggagggtggtgctcccggcgagttcgctcctcagttccgtggtggatttggccgtggccgtggcgctgcccccccttcttaaacgaacccattttatcatctaggtggtcataaatgagaagcatggcgaagggtatcggcatgtactcataaaaaatggagggcaatttctaccatgggtttcgctcgtgtgacaggggttgcgtgggggatccgtgggagtttgagggttttagaacctcggaatcatttgcatcaaggaaaaaaaaaaaaaaaaaaaaaaaataaaaaaaaaaaaaaaaaaggccccta

SEQ ID NO: 60116 - DNA, 530 bp, Triticum aestivum
  Clone ID: PAT_TA_60116
gccggccgggtcgcggacgacacatacaacactaccaatccgtctcaacaagggcctaaactcttgttatattatctcaaaatgaccacccgacgtattgttgctaccgaaaagaccttcctcgataaggatgatcctattgacgaaacctcaagcacagcccctgctgtacctagccaagtcatctacaagctcctagcctttacctttgctatggtctttataccaattggttcatacttccttaccgtcaacactgtcttcaatggcaactcttctttcgccggtggcttggccgctgtgctggccaatgtcgtcctcataggatacattatcgttgccatgaaggaggaccagtcggaccaactaaaggcggaaaacaagaaggacaagtagacgccaaccagcggtttcttactaccgctaaaaagatcacttcaaacaactgtgaatcttgcacatggctattagttgagtcattaatgtcaattattttctcatgccaaaaaaaaaaaaaaaaaaggccccta

SEQ ID NO: 60117 - DNA, 359 bp, Triticum aestivum
  Clone ID: PAT_TA_60117
gccggccgggttgggaaacgcctcggcgcttagaagagctacctatagagatcaagggcctcataatggaagaggtttcattgctgccaagcccttacaacaatctcctcaatttggcacaaacgtgcaaacagctttccagccatgccatttctcaactttacctcaacgacgtcagagactcaatggaagttgaccctgaatccaatatgcccctgatccttcaatgggcttgctggttcggagccttggaagcagccaaaatgtcgttagaaggtctacgaagagctggtgtggatgtcaagtgcaaaatcaaccaatctttcaaaaacgaaaaaaaaaaattttaaaggccccta

SEQ ID NO: 60118 - DNA, 306 bp, Triticum aestivum
  Clone ID: PAT_TA_60118
gccggccgggtcgggcctgagatggtggtcactacctcgctgagttctctatctcatacaagcccgtcaagcacggtcgacccggtatcggtgccacgcactctttcgtttcattccccttaagtaagaaggttgtggtcttgggtggtttctgcattcacggacattttgggcgaaaaggactggttttggtagatgggcttttaaaacatctaccaaaattactgatgacaatgggtactatgatagtacaataaaggggcattgtccgcttgatgacaaaaaaaaaaaaaaaaaaggccccta

SEQ ID NO: 60119 - DNA, 127 bp, Triticum aestivum
  Clone ID: PAT_TA_60119
atcttgtggccctaaggtgtcggagacatctacatccaaaccatagaggtactcatcgactaagagctcgacgcctaaatccgcgtaatctgcacagaactgaaggcaaaatagccaaacgacacgg

SEQ ID NO: 60120 - DNA, 404 bp, Triticum aestivum
  Clone ID: PAT_TA_60120
gccggccgggccgagatctggattcttttttacatcacatcacatctcgcactttcatattaattctcttctcgtctctctcatccatctctgtatttcttgttggtcaattcccaatacccttaaaataccaagactccaaccaatacgactccctccccccgacaagctctgctattcgtccaactctctgccccagccagctacaccagctgcaccagcatctttcggtgctgccgagaagccatcatcgccacagcacacaaccacccccatatcttgccctatcaccaaccgacccattcggactcgaattgagttgaacttaacaaaaaggaggcgacctctaaaaataaagaatactactttggtcatcggaaaaaaaaaaaaaaaaaaggccccta

SEQ ID NO: 60121 - DNA, 513 bp, Triticum aestivum
  Clone ID: PAT_TA_60121
gccggccgggtcgggaattaacctgacatcccgtttggtcaacctgtttccgctgacactgctctccagacatctgattactacctcatgtcgcaatacaccggtcccggagctaccatactccgcaatctccgcttcaacgtcctcgtgtctcttgtgacgaaggatgagaagccagccttgcagcttcgtttactccccagagcgaaagacggctttatcccaattgataaagttgacaatatcagtttcttattggccttggcggatatcaatcgctgggatggcaaaactccaagggttttgcagccgaagagtgtgcagccactggatgcggtgtcgtttaagcaattgcactacaaggacggggtcaaggcacagtatcacccaaggacggaatcaaatccccccaggactcaagcgttggatatttcggtgttttattcagattagctgccaaattgaagtgagatgatccaaaaaaaagaaaaaaaaaaaaaaaaaaggccccta

SEQ ID NO: 60122 - DNA, 720 bp, Triticum aestivum
  Clone ID: PAT_TA_60122
gccggccgggtcgggacagcgacgggatgaactgacgctgcacggatctcagagaggaaccggatcccttcctccctccgaacggcagctcggcagctcaactcaaccccaactcaacccagcccagccgtcgtcgaccctagagaatctgcgaggagcagcagcggagaagaagaaggagacggtggtctctctccgccatggccagctcgtctgccgacccggagaagctcatggccaaggccgacaaactaacaaaactgagcttcacaagatggaatgctgattggaagagtgctaccgccttgtacgaacaagctgcaattgcttatagattcagaaaggacaatgagaaagcaaaggatgcatttgagaaggcttcaaaaggacaagaaatgatctcatcaccgtgggatgctgctaagcatatggaaaatgctggtgctttagcaaaggagcttggactctggaatgaagtttcggacttttatcgcagagcatcagaattttaccgtgaatgtggaagatcgcaacctgcctctgatgctcttgcaaagggtgccagtgccttggaagataaagctccagaagaagcaactaaattgtatgatgacgcttgcacacttctagaagaagatggaaaggactgttcgattatggtgtatgctattattattatgaagtaactaaaactaatttgacaattcaacaactgtttcg

SEQ ID NO: 60123 - DNA, 221 bp, Triticum aestivum
  Clone ID: PAT_TA_60123
gccggccgggccggggtatggtgtgttgcagttggtgaataaaggagcaaacagaaggggatgtgtgatgtgtttcccttatctgtaacatgtatgatgtttcattgttgcgtgagttctcgtggtgcaagtaccaggacctgctatgttatgagcttctaacgtgctcccccgttcactattaaaaaaaaaaagaaaaaaaaaaaaaaaaaaggccccta

SEQ ID NO: 60124 - DNA, 674 bp, Triticum aestivum
  Clone ID: PAT_TA_60124
gccggccgggtcgggaaacaccacactttgctcttgcgcagacccaacttcttcctcccaccccccagctcaatcaacacaatcagatacaatggctgaccgaggaacttctcgcggtggaggctttgcttcccgaggtggtgaccgtggcagaggtcgcggacgaggccgtggccgcggtcgcggtaagaacgaggagaaggagtggcagcccgtcaccaagctcggtcgtctcgtaaaggccggcaagatcaacagcatggaggagatctacctgcactctctgcccatcaaggagtaccagatcgtcgacaacttcctgcccaagctcaaggatgaggtcatgaagatcaagcccgtccagaagcagacccgtgccggtcagcgaacccgattcaaggccattgtcatcattggtgactccgagggccacgtcggtctcggtatcaagacctccaaggaggttgccaccgctatccgtgccgccatcatcatttatgaactgatgggagctggaaactggtgccgcggagtcacgaatcaattgtgtttcattgcataggttggccggttaggacacttcagatcgtataggctatggtgactgatggcttaacggtctgaaatgaaaaagaaatttcatccttcaaaaaaaaaaaaaaaaaaggccccta

SEQ ID NO: 60125 - DNA, 458 bp, Triticum aestivum
  Clone ID: PAT_TA_60125
gccggcagggccgggcggatgggccgaccttgctgatgttttcgagatcgagaactgcgctggcaagacacctgagtttgaccctgccactcttggtatcacatgtcttgctactcacggctactgcgagtgggattactcaggcaagcttccctccactaccaggaagcagtggacgaactgcgacaacgacagcaagtggggtacactttgcagcagttttgccgagggtaaacttgttcccgaatcttacctcggccctctattgtccaacagtgcctttttctgcaagaggcagtaagcataaaccgttattgggaaacccggactacccagttgagcttggagaacatgagcttggaaggctagcctgaagggtgataggggaatacacctttatacatatagatgacttgaatttaaagctttttgaaaaaaaaaaaaaaaaaaggccccta

SEQ ID NO: 60126 - DNA, 613 bp, Triticum aestivum
  Clone ID: PAT_TA_60126
gccggccgggtcgggtcgacccgtctggacgactttgtcacgacaaagctttgaatacgattcttctttttgggaacatttcccacacaaaaactagcgaattaacccgcctttcatggctcgaccttgccattcagcaaccggagagtcacggcaattttcatgacccgttactatatacccgtttacgctgcggtctaatttttcgcattgctacctatcagtggccatccctcccccatcatacttttgcatatctcgatttccctttagccgactcgcataactactacaacgctactatggtccaaggtccgagagaagggcttaatcagttattgtttattaattggagaggggtggtagtgcaccccgaggagaggccttggatcactctggcagttgatggatagcatgggccaaagcaaaacactacatttagcaattcttatatctattctatgggggttgggccttgggacattacgcatggcgcaccttggagtagcaaccatctatatctatatctatccctaactagtctagttgatagtccatagtgtataatttcttatcctactatcatgaaaaaaaaaaaaaaaaaaggccccta

SEQ ID NO: 60127 - DNA, 724 bp, Triticum aestivum
  unsure (1)..(724): unsure at all n locations
  Clone ID: PAT_TA_60127
gccggccgggtcgggaatcaatcccttctgctcccatccactcaaagcagatttgtcccaggcctctcgtcgaaaattaatttgatttgatcgagctgtgtcgctattatcctctggccattcacaattcacaagcaatctcaactccggtcttgattggatcgcacccgcgcgcaagtcgtccattaacaaccacaaggcttaaacgctctgtccgcgctgccagctttggttggccgacaaaacgacgacaagctctgactcttgtcattcgctcagcgccttgtcaaatcaccttaacaggcaacacacaactaaagctacagccacttcattcagccttatcgacagctgcatagcaacattgacttaaccgtctggaaattcaatatcaatatttacgggttctgtctcggtattatcgtcacttcatcacaagtcggcttgtcacttttcgcccctgctcacagtccgacccctcagctcaagcttctctaatacccatcgcactataacctcctcaacataaacctttttttctttcttttttcttccttcattttcgccttacccagcccccctgcattaccattgcctattgttgtacgtgcataggtagagactttgttagcttttggcattgtcacacaagatcacaaaaaccacccaagacnnnnnaanannaaanaaaaaaaaggaaaaaaaanaaaaaaaaaggccccta

SEQ ID NO: 60128 - DNA, 657 bp, Triticum aestivum
  Clone ID: PAT_TA_60128
gccggccggtccgggatcatatttcgtagttttgtattgtttcgctatcaatcaatagtcatgacggaccttgagagcgatcgacagcggaccgatccggtttgtgattcctcagaggatgaactgccccaggaatatcgctcccgcgtggaagagtacgaggacaaacccgattggccccgcccgcctctctatcgcgtcaacgaagtcgtctacgtccgtagttcaggccaagctcagcctgctggcccgtacattatcatttcggcaaacttggaaaacaaaacatatggcctcaagaagaaaaatacgggccaaatccttccaacagcggtggctgaaagagatctgctggtggcggcttgagcgaattcacgtaattcgctctccaagaggcagcctgagggggcgcaggggtgatgtgttttcatgcatcatcccccaataggaggaagggaaagcatcctcggttgaaacatgcataaatcacaaagttaggcaaggttgaccttggaatgagataaaagagattccttatcaatgctatctctctccaaaagcatcattatagcccgcaaatagtgtagtcgtattatctacgccaagacagaatcatgacaacatcaaacgcaaaaaaaaaaaaaaaaaaggccccta

SEQ ID NO: 60129 - DNA, 493 bp, Triticum aestivum
  Clone ID: PAT_TA_60129
gccggccgtctcggaatcttcctatctttttctccccatctctctgtcaagcagagaactactcccacgcagtacacttcctcaacatctgccgctgtttctaaggccccccgcagatcgatccatatcgggatcgaggacaccaccgagccgactcccctcctccgacctccacgtgcggtctcagcgtccgatccaccccttcctcgacctcgcgcacgatagccctgcatctctcgcttctgtccgtcgcaagttcatttctctttcgcttggcagtgcagaacgcagggaggctggcggtcgctaccacagccggatgtcctcgggtcaccgccgtctccgagctcgtcgggcgctggcgcccgtcctcccctttattgtggattcccaagtgttggcacctgactcagttgcaaattgggatttttcatgcaagcatctgatgattcggattgtaatctgccaaaaacaaagaaaaaaaaggtcccta

SEQ ID NO: 60130 - DNA, 809 bp, Triticum aestivum
  Clone ID: PAT_TA_60130
gccggcccggtttgggaagccacagcgagtcaccaacgaccactccactccacatccaaaatggctttcgaaggggaggtctccaggctggctgctcgcatagcggccagctcgccggcgcgggtgaggatggcggtggggacactggcacgcagcagcgccgcccgcgccgccgcagatgccctggtctatctcttcgttggcaccatctgcgtcctctccgccgcaacattcctctgcgccgtcgcattccgcgcctgcggccggaactgcagcgttgccgccgcgatcttgttttattctggtatgctctccctgctactcatggtgccagcgatggtactcttcttcctgcgcgcagccggcagcgaggtcaagtatgatgttgtggaggaccgcctccgtccgtggccgctacaccggacggctgtagcgatctggaggttcttcgtcgtggcgacgtcggtggaattcatcgggctggttctccaaatctgtggatttccaaaggtttcttaccttctccgcgctgcggctctgctgtgcatgctcctagtcatcgccctcttctgcatccgtgctgctgtggcgctgtggaggatgaatcctcgacagtcggctgcagttgctgctgttgtgtttgtgtacatggtgtagtgtgtgtgtacggagtagtaatctatctagtgtagttgcctcaccttcagtgcttcttagttcagtgctgcctatatgacttgacgtatgctctgatgaatttcagtatatatatgtaatcaggtccctcatttcactacctatatgacttg

SEQ ID NO: 60131 - DNA, 533 bp, Triticum aestivum
  Clone ID: PAT_TA_60131
ctgtgcggcgctcgaggcggccgggtctgccgatcatggtctactccgcggggctgaagctcaacaccgcctgcccgatgtgcaccatctgcctctcggacttcgaggccggggagcacgtcaaggtcctccccaagtgcaaccatggcttccacgtcagatgcattgaccggtggctcctcgcgcgctccacctgcccgacgtgccgccagtccttgttcgccgagccgcacaaggcgtgtgggtgctccgaggccagccaggtcgacccggcgcgtgtccactctgtgcttgtgccgctcaggcctgaaggtttgatcaccacgtatgatttttagttgcttcaagttgttgcatgaaagatgacggagcggggtgtaaagcaacagaaggttgtgttcactcggtgttgttgccaaaaactggcttgtagccctcttactcctgcacaatgtgtagtccctagctagtagtggaagaaattgtacatttcctccgtgtttcagcaaaaaaaaaaaaaaaaaaggccccta

SEQ ID NO: 60132 - DNA, 809 bp, Triticum aestivum
  unsure (1)..(809): unsure at all n locations
  Clone ID: PAT_TA_60132
gccggccggttcgggctttcagaatctgcttcttccttcatccgatagcagcagcacagcccaaaattccccaatctagcttgactgccagccgcctcctggatcaaccctctcgctcatcgtcctccagcttgccgaccgtggcggaggtccagatccggtgcctacctgtgcgagtacggccagtagaggtgccgttccagctcctggtcgtctcgtcaccgtcggtgctgctctggcggatctcgccctgttccaagccgcgaccttgtgcgaacaagcacttcaggatactctgctccggcggtcagaggttgacctcgccccttacttcttcctaccccaacccgccattctccacacgttgcgccctactcctgtgcggctagctcggccacccaccgacgccagagaagaaatctcgggtcttaagatcggagctcgtcgactagtgctaagctcggcctccgttgttctgctgttgcatctcaatctgaaatgcagggaagtagtattttacatatgtcatggcctactggagcgtccgaacaatagttgttgagctcttttcagcaaaaaaaagtttgtgttcgtctctttcttaggtggattgaaccgatgaagtttatatagagtcgccttcagaaaaaaaaaagtttatatangagtccgtggaggttgtcatctattccagcagatgaaggtcgattagcaagtcactacaaaaggaaggcaagatcatagatcttttctgtcatacatcaatccttaatactttggtttccctggaatgtactaaaaatgatcta

SEQ ID NO: 60133 - DNA, 716 bp, Triticum aestivum
  Clone ID: PAT_TA_60133
gccggccggtccgggcctcgagagggaacctcgtcgccggagaagcagcaagaagaagatggccggaaggaagggcggcgacaggaagaaggcggtgacccgctccgtcaaggccgggctgcagttccccgtcggccgcatcgggcgctacctcaagaagggccgctacgcccagcgcgtcggctccggcgcccccgtctacctcgccgccgtcctcgagtacctcgccgccgaggtcctggagcttgccggcaacgcggccaaggacaacaagaagacgcgcatcatcccgcgccacctgctgctggccgtccgcaacgaccaggagctcggcaggctgctcgccggcgtcaccatcgcccacggcggcgtcatccccaacatcaactccgtgctgctccccaagaagtcccccgcagccgccgagaaggaggccaagtcgcagaaggccgccgccaagtcccccaagaagaagaccgcagccaccaaggagtagccgtccccattcccatagcctagccagtcttgctgctctgttccatttctcatggacaagatgagcagtagtcgtgtggttggcagatctgtatgtaatgcctggtagtctgtagtgaccctttcgtcagattcgtcgagcaagtgcgggcattgtatctctgatttatgtgggaaatactagtactaaagatgaaaaaaaaaaaaaaaaaaggccccta

SEQ ID NO: 60134 - DNA, 760 bp, Triticum aestivum
  unsure (1)..(760): unsure at all n locations
  Clone ID: PAT_TA_60134
gccggccggttcgaaagaaccacagttccatcccaacctagtctccaagtccccaaccagagaggcagagagctagcagcagcagcagcagcaagccaacaagttccataactcgtcggggcaacgcaagacaaggcagcatgtgcaacgtcatcacgatcccgtcggtcgcctggctgcgccgcgccgtgcgccggtggcgcgcccgccgctccgcctccgcgccggtgccggcggggcacgtggcggtctgcgcggagggcgcgcggttcatggtgcggctggcgcacctcagccacccggccttcctggagctgctccggcaggcggaggaggagtacggcttccggtccggctcctccggccccgtcgcgctcccctgcgacgaggcccgcctccgcgacgtcctccgccgcgtctcttcctcgtgcgactcagaggagccgcgccgccccttctgccgccgccgtggcgactcgcggccgctgctgcaggcggtggccgtggagaagctcttcttgtgagcgatcgacctaccccgcgcgctccgcggcaccaaacgatcgagcaacgcagcgcccaatttctgcgcgccaaagcaaagtaactgactgaagaaggcgacgattttttggattgttttctctgtgtaataaccattctactcgtttgtgcaactacttgccgaggcatacgagtanattaattagtaaattggttgttcttccaaaagaaaaaaaaaaaaaaaaaaggcccctan

SEQ ID NO: 60135 - DNA, 774 bp, Triticum aestivum
  unsure (1)..(774): unsure at all n locations
  Clone ID: PAT_TA_60135
gccggccgggtcgggatcatctcatagcttctgatagccattgagatctgtcgtcatcatggcagagaaatcaggcgtaaccggcctcgacttcgagttcgttaaaactcccgcctttcccaagcctgactttgacaagcttgagaacgttggtgttcctactaccaggtacccagccatcaagaacgctcctcttcccgccgatggctctggttctgacaccttcaacaactatgtcctcatctctatcctgaccatcgtcccctggtggctcagctggaaggtcggtggtggcttcaagaccaccctgttcttcgccatcattgtcgatcttcccatgctcgctgcctggtggttgaccatttccgccatcagcccccgcaagaatgagaaggttcgccttcccaaccgtggtgtcgagcactacctcgaattcaagaaggaggccgatcgtgccaagtaccgtggcaccaacaagattcctatggagactttctacgaaatgtactnttgacggcgatgttgacttcaagggtgactgccttgaggtcatggagcagcgccacgactgggttagcttccgctttaccattggccttatcaagttcttcctgtttggcaggatgcccgaggttatcatgcacactcgttctcaggacgaggagcaggtccgcgaccactacgaccgtggtgatgatttctacggctggttccttggncctcgcatgatctacacctccggtatcatctctgacatcaaccgcgaggagactc

SEQ ID NO: 60136 - DNA, 237 bp, Triticum aestivum
  unsure (1)..(237): unsure at all n locations
  Clone ID: PAT_TA_60136
gccggccgtttccggcagaacctactttntatccatggtggtgcagacatatgtgccaataaacacaaataaatttgaagtgctatctgtctaagcttatcgtcgtattgggtgtaattacgttgaacaagccccgcctgtgatatttgagtttacgccatgattgattcatgtatgtcttgtcttgttataagatggtttttctttggggaaaaaaaaaaaaaaaaaaggccccta

SEQ ID NO: 60137 - DNA, 728 bp, Triticum aestivum
  Clone ID: PAT_TA_60137
gtgcggcgctcgaggcggccggtcgggccctccttttcttcctcctccatccacatctctttctctatcggttcttcctccatctcctccccacaaaggagctgctgcctgctgccctgcgcactactgctgctacaagctgctgcccacgcgcgcggccctgttcagcgtctccatgtgcccgaccacacacctccgatgaaagtcgctggtcctcgccgcgtgttgccattgctgcgagtggggcggccatgggaagtaggacggccctggttttttggggtgacccggggctgccgcgaccatgatacaaccacgtcggaggggagctgcaaacggtgttcggcgggaagctgcaaacggcgacggcgacatcatacatgctgcggcggcgctgcgaccatggactggtgagctttttctcttttttgtgctaccacgggcaaggtaaagtgctaccatgggcaaggagaggtgctgctacaacggcggcgaggggaaggtactgcagaatgatgccactgcatcttgtctgtttttcgctggaaccatccagtttttttgctggaaacatgtacaaattttgctggaaactatatcgatcctgctgagaccatatcactttttttgctggaaccatatcattttttttgctggaaccatgtacaatttttgctggaaaaatgtaaatttttctgggaactaaaaaaaaaaaaaaaaggccccta

SEQ ID NO: 60138 - DNA, 647 bp, Triticum aestivum
  Clone ID: PAT_TA_60138
gccggtcggccccctcaaaagggggccgggcgaggcgagcgagcagcaactccaagctacgcagcacacaactctctccacccccagcaatccatccacccccacccccctttcccctcccctcccgagctcggcaatggcaaacgcttcgtcaggagctgggatccatgatgactgcaagctgaggttcgtggagctcaagtccaagaggatgcaccgcttcataacctacaggctggagaaccagaaggaggtcattgtggaccaaactggggagcgcgaggccacctatgaggacttcaccaagaccctgcctgagaacgactgccgattcgcagtgtttgacttcgacttcaccaccccggaggatgtgccaaagagcaggatcttctatatcttctggtctcctgacaccgcaaaggtgaggagcaagatgacgtacgcgagcaccaacgagaagttcaagaggaccctggacggcatccagattgagatgcaggccactgacccgagcgaaatcagcctggacgtgatcaaggagcgcgcgcactaaggcaaatcatcccaatgcctcgcaatatggatttatgtcaactatagatttggcggtgtgactcttgaaactttcttgatgatttgtggctttg

SEQ ID NO: 60139 - DNA, 495 bp, Triticum aestivum
  Clone ID: PAT_TA_60139
gccggccgggtcgcttgcccgcaccgtacgaccgcaacaacctcccctttttccgccggcgagcgaccgatccggcggacggaccatggccgcgctcgtcggcgacgccgcctactggctggcggagcacccggacatcgtgggcttccgttggagcccctcgggcctctggttctccacctgggccttcctcctcggcttcctggccacctacgtgtccctctgcctcgccgccgacgcgctcctccgccgccggaagcagccgctccccctggggcccctcccggcagcgcacgcgctcctcatggccgccgtctcggccgccatcttcgccggcacgctgctgtcggcggtggcggagatacgggacacgcggtggtcgtggcggggccggagccggaccacgccgctccgctggctcctctgcttcccgccggggacccgctcgtcggaccgcgtcttcttctggtcctacgcctactacctctcccggta

SEQ ID NO: 60140 - DNA, 316 bp, Triticum aestivum
  Clone ID: PAT_TA_60140
gccggccgggtcggaacatggcaggatgagggctttggcggcgttcaggtttagctattgcattaaaaatgggatatgattacaacaagtccttgaaatgtccagcagaccttgagcttgaaattcggtgatgacgagtgcgcgatactctccggtcgacaggacaggtagcagtcaaaccatgggcacacgaccagacatggacctttgctcgaccatcgacttgcaataatatttagcttactcgattattcagacatgattaaactttatctcctcgcacgaacaccaaaaaaaaaaaaaaaaaaggccccta

SEQ ID NO: 60141 - DNA, 616 bp, Triticum aestivum
  Clone ID: PAT_TA_60141
gccggccggtttgggtttcgactgggcatcgagcatctttcaagccttgcatacctcgagctcaaaactgattgcattggcgaaagtcgtcgtggtgtggaggctttggaggattccgttagaaaagcagtcgccttgcatcccaaccgtcacgctcttcaactcaatgtcagtagaagctttgaaagtgatctacattagtgacatcgctgcaagagcttcggtctgtctcgcacggcagcagcaagaagaccgccatgtgatgtgagctacacgtttgttccgttgtccaactctgtgctcagccagcgtatttatgtactttcagacatgtagtaccttgtgatttctagctagaacctttcattgctttgcgtgtttgtaataacagggtttggtgcatcaggtttttcgtctcatggtctgtattcgagtgcgagtatggacagtgggttttcctgatgtgcttcaaacccgtgatctattttctagttccattcgtagacccgttgttgtttcccttattcaagcttgttttgcctgtatctggatcatttgaggtgttttcatatatgctatttggagaagacaaaaaaaaaaaaaaaaaaggccccta

SEQ ID NO: 60142 - DNA, 850 bp, Triticum aestivum
  unsure (1)..(850): unsure at all n locations
  Clone ID: PAT_TA_60142
gccggcccggtccggaaaacttttcatcatcattcaaaccatcgcttcaaaatgccaaggaaactatcaaagaaccctctccctccgagctcctccacgctgtcctcgatgtcttcagcatcaggagcttcctctctcctcccatcatccctcgccgatccgtcgcttccgctaccaaaacttattgtcttcgatcttgactatacactctggcctttttggattgatacccacgtcacgccgccgttgaaacccaattcctcccacacgagcgccacggaccgctatggtgaagattacggcttcttcagtgatgtgcccgccattctctacgcgcttcctcgcgcaggcataaaaatcggtgtcgcgtcgcggacaagtgcacctagtcttgcgcgcgatctgttaaagatgctgcacatcactgcgcccgaaggcaacactaaggaaaagcctaagaaggcgctcgatatgtttgatggcttgttggagatttaccctgggtgtaagatcaagcattttgagagtttgcagaagagaaccgggattaagtatgaggacatgctgttttttgacgacgaggcgaggaatagagatactgagagtttgggagtgacaatgtgtcttgttaaagatggtgttacatgggatgagcttgagaggggtgtaacgcagtggagaaataagagaggatacatcaagaggcctgatgccatagagttggaataaattggtgctttggtagaacagactggtttattgnggtggagtttgactagagggaattcggaaatattatggaccacaaactagaacattatttacaatagaaatagaatcgactgtatac

SEQ ID NO: 60143 - DNA, 491 bp, Triticum aestivum
  Clone ID: PAT_TA_60143
gccggccgggtcgggatttttcctctcgcctttccccaccttccttcctcccccgtcgtcgcggctccagcttagggtttctcgcccccgccctcccgcctcaccggcgggcccgtacgccttgtcgaagcaatgagggagcgccaacccgttcaagcgggccaaggtctgcgagaaggactatgaactacaatgacctggaatacctccacaagaacaacgtcatgaaaatgccctccgactacctcaagggcgagtccggccgagaacggagacgctgcggaggatccgagcgtcggatgagagtgaacaaacgggtatggccacccttactgaatgctgctcatgatggtaattgatactatctacctatctgtgtaggccttcactatatgtgagtgcaaagaactaccttacaactggatgagcattaaccatcaccaccaccaccatgatgaaacctatggtgtttgcgcacgctcttctgctta

SEQ ID NO: 60144 - DNA, 824 bp, Triticum aestivum
  unsure (1)..(824): unsure at all n locations
  Clone ID: PAT_TA_60144
gccggccggtccgggacaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgnctgccgggcggtgtcccccactgaagaaactatgtgctgtagtatagccgctggctagctagctagttgagtcatttagcggcgatgattgag

SEQ ID NO: 60145 - DNA, 648 bp, Triticum aestivum
  unsure (1)..(648): unsure at all n locations
  Clone ID: PAT_TA_60145
gccggccagttcatcgtgaacgtggttgtccctcgcgccagccaacagtggaaggtcgccgcctccgtcctcgctcgcctacggcttcaccatgtcattcgagggacctgccgggctgccaggctcctcgccacttcagcagctcgactcatggatctccacatccgcatcgacgcacctgggcctcggttgttgcccctccggcggtggcgaatcccagcgattctgttgttgctgatttgggattgcttgaacctctccttgctgctcagatggaagtgttgcgctccgagatgcaggccttgaccgtctcacgtttggaggaggtggtccgaccccttcatgacatgatgactgctttggaggggtggacgactctactctgggatacttggagcgaatggaggttgttgttggccagctgggctactcgccggcctcgccacagtcgtctgagatgaatgttgcaggttctgttgggaatgttgctggtgttgaggattttatcgagagtgatgtggctaannnanaaaaaaaaaaaaaaaaaaaaaaaaaaaaaaaaaaaaaaaaaaaaaaaaaaaaannnnnnnnnnnnannnnnccccanaaaaaaaaaaaanggaaaaaaaaaaaaaaaaaaggccccta

SEQ ID NO: 60146 - DNA, 360 bp, Triticum aestivum
  Clone ID: PAT_TA_60146
ctgtgcggcgctcgaggcggccggtccggggaaatgaacgacatcctgatgtaactttgaggagctggctcgttcaactgatgatttcaacggtgcacagctgaaggctgtttgtgtggaagctggcatgcttgctctacgcagggacgctacagaggtgatccatgaagatttcaacgaaggcattatccaagtgcaagcaaagaagaagtccagcttgaattattacgcttagtttcccttgagtaatcagaacgcttggtccagtgatgacctctgtttgtaacactcggctaccatttttatttggaatatagtttaattctcgaatccaaaaaaaaaaaaaaaaaaaggccccta

SEQ ID NO: 60147 - DNA, 834 bp, Triticum aestivum
  unsure (1)..(834): unsure at all n locations
  Clone ID: PAT_TA_60147
gccggccgggccggggagaagcgaatcttgcattcatctagctccacgatcaatcgttcgaccatggcaacgctctacaccatcatctacgtcctcgtcgtcctactacgtacttagtatcatctcgctcatcgccgctgccagcaagaacatcaagaagcgtgcatcgacaccccataccctgagtactgctcatcagttctctctgcggaccgcaagagcaaaggcgcatatgcgatgcaagctggataatgggccaatcatcctccaacccatcctcatcggcaccaaggcttcataggcgcgggcaaagaggtattattccgtggtttgtcctgggctgaggaggtatgccccagcacatgcaaagaggagttgagtacaacaccatcaagaatttgagcatcgcagatgagaagtaccgagacatagtggggctacttgcatctgtggtgctcaacgtcttcttaaacttctctttgcgggtgcatactttttttggcatcggtcgaatcactgaatgatactccctctgtaaataaatgtaagagcgtttgaaatactactttaatggtctaaacacttttatatttctttacggagggagtatcactttgctcgcgaccaatgacttatcggtgctaatgcggataggtgtgaggaccgcatgtgcgtgtgcgtgtgcgtctttgtcctctgatgccacaaaaagaactgatgtgcacgtctccgggntatggtngtgagacacgctgcttgatatttttgctgcaccttttacgagggacacaaatatgggtggcagagaacgtcggcaagggtcaacaatcgact

SEQ ID NO: 60148 - DNA, 571 bp, Triticum aestivum
  Clone ID: PAT_TA_60148
cctttctatgtgcacaagatacctgctgagactcgagaggcagtaaaacatatagctagatgagacactgattatggtcctccgatgattaagccagtaagatgtaaaaacgcttgagaaaatgccaatattctattgtgtttctttccccactcctcatgcaggaatctcttatcaagcttgagtcgataccgtctgacctcgagacggaccccgtgacccaatccatcctataggagacggtattacgcacgctgaatacgcgcgccacctaccacgcccctgcactggcgagaacacctgctcgcatacctcacacctgtagatacgcgctatggagcgacatgccccgcttctctccgaggtgatcgtagagtacgcgacatcaggccacgcactatatcgctcttcccaccattcgcgctcactgaatggctactgaaaattgcaattcgacgaatattttgttaacactcgcggtcaactttcgcgacatccatctcctttgtctgacccataatgcaaaatcggcactatcttcttatgaatcagaagaatacaccgagatagg

SEQ ID NO: 60149 - DNA, 691 bp, Triticum aestivum
  Clone ID: PAT_TA_60149
gccggccggtccgggagtggagacccggaggagatggctccagggaagaagcgaggcagcaaggccaagggggccccggcgccggcggccgcggccgcggcgggcggtgctggtgccggcggggagttcccggggtgcctccgcctgatgccgccgtccaccgtcgcgatctccgtccacgccaagcccggctccaagatggccaccatcaccgagatcggggaggaggccgtcggggtgcagatcgacgcgccggccagggacggggaggccaacgccgccctcgtcgacttcatcagctcggtgcttggggtgaagaaaagagaggtgtccatcggctcgggctcgaaatcgagggagaaggtcgtgctagtgcaggacgcgacactcaaaggcgtcttcgaggccttgaacaaggcgtgcggcccttgatgatgtatgttaactgcgagtatgtaatataacctggctgagcagagtgtatcagctgtaggaaccggtgctctttctccggtataaatcgtcaccataccggtgagagcgaacctggtaaaaggctgaaaccatgggggcacggccagtcttgtcactgcgatcgtgatggggaactgctcttttctgaagaaactgtaacagagatgtatgtatagtgtgcatgacaggctgaaaaaaaaaaaaaaaaaggccccta

SEQ ID NO: 60150 - DNA, 461 bp, Triticum aestivum
  Clone ID: PAT_TA_60150
gccggccggtccgggaatggagatgagaggtcattggagggctcacccggttgaaacgcttttgacactaccaaagtttggtgatacaagtccaaccaagaaatgaagttttactgatattgatgtgggagtctgcagttagcaggcacattcgctgatgttttggagatgagagccttattggctatagagagaagtgcatatttcaatcatgaactcttgccctaatttaatttacaaccccgaactttaataccgtctaaattacaacccccaagtctcaaaatcgggtaggattcaaccctcccctctctgttgaccggttttgacctggggtgaccagttttgactagtcaacgggtccaatcagcatgccacgtcagatttttttttcaaaatttcaagaaaaagtaaataaaaatctgtaagattaggaaaaaaaaaaaaaaaaaaggccccta

SEQ ID NO: 60151 - DNA, 539 bp, Triticum aestivum
  Clone ID: PAT_TA_60151
gccggccggttcgggtcgggagctcgatgaagacgatgaggactaatgcttttggtttgaggtgtttgcttctcctccatctttgtcctctgataacaattggtggttctgtctggaactcgaagtgccatttggacatgcttgtgaaggcctagagcttctccaaactcgccgtctgttggtcttttgccagtaaacatctccagcaacagtaccccatagctgtacacatcacctaggattgaaactttgttgcccaaaccgtactctgcaaacatcataataaaagaattagaagcactgaacatgcttacgcatttaagctgaagacagctgttagaacgtatttatgtatacctagagcagcatagccaattgttcctctcattgtagcccagccacttgatttctctaaacagccgcttgggtgtttaggcagggctcttgcaagcccaagatcacgaacatgagtaaccatgtcactatcaaggagaatgttgcttggcttgaaacaaaaaaaaaaaaaaaaaaggccccta

SEQ ID NO: 60152 - DNA, 806 bp, Triticum aestivum
  unsure (1)..(806): unsure at all n locations
  Clone ID: PAT_TA_60152
gccggccgggccgggaaaaaaaaaaatccaggtttcctctttggcacaacacaaggcagcaacaactagctactagctactcaaaggctccatcacatttcaaagtcctcttcaaacttcaaagcaaagcaggcctagagatccgtgcacgtacacacataacccattagaagaacttatttagaaggcagatggatcgcgtgatgaagctggcgtcggagagagcggtggtgatcttcagcctgagctcctgctgcatgtgccacactgtggcgcggctcttctgcgacctgggtgtcaatgcactggtgcacgagctcgaccaagaccccaagggaaaggagatggagagagctctcctcaagatgctcgggaaaggcccgtctgttccggtggtgttcatcggcgggaagcttgtcggcgggacaaacagggtcatgtccatgcatctcagcggcgagctggtcccaatgctgaggaatgcaggtgccctctggctttagaggaatgcaggtgccacttgggaaaaataaaattttgtcaaagagtgtcaagtatatgcatttccttagaataacttaactaatggcctggttagtgtcgatcgaacaggttttttcaatcctgttccggcaatagcaaggcttatagctcgctaggagcgagttttacgtacgggtggatgttcgtgttgtaatcccagtgctatttgtgcactcaggtgtacaatcatcgttttttaaagagctagctgataaatataaacagntcaaaaaaaaagaaaaaaaaaaaaaaaaaggccccta

SEQ ID NO: 60153 - DNA, 342 bp, Triticum aestivum
  Clone ID: PAT_TA_60153
gccggccggtccgggattctcgacacctgagccgcaaactgtcagagctactttgactgatcagcagctgcctcctgcttctggaaccaacccaaatgcagggcatagttgatcttatccactgttgtgaataatgatcatacatctaaggatagtgatgcaactttgtcagtagaactcttctttccatcttatcgatcatctatctggatgaacaacagggtacaaagtttgtggctactttgacatatgatttgcgctcatttcactttgcttcagtgttatggctaagtcaaccccatgtcttactacacttaaaaaaaaaaaaaaaaaaggccccta

SEQ ID NO: 60154 - DNA, 270 bp, Triticum aestivum
  Clone ID: PAT_TA_60154
gccggccgggtcggggctccgatctactatggtcgtcgcctgcatctgctgtcttaagtttactatatgctgccgctgatgctgctgctgctctaaaatattgatgctgttgctgctgctgatgcgtgtggtgtgtcgtgtgctagacgcgtgattttttttacctgtacacatgaggccgtgtggcctcattgccatgtttaattacctgtcgctactctaagatgctggcaaattgtttgcgaaaaaaaaaaaaaaaaaaggccccta

SEQ ID NO: 60155 - DNA, 666 bp, Triticum aestivum
  Clone ID: PAT_TA_60155
gccggccggtccgggaatcttgtgccccaattccacaacaatctctcactcaacataaccaaacaaccttcatcatgcagctgaccaacctcttctgcctcgccagtgtcctgacctccgtgtcagcaatcaccggtaacaaccaacccctctctcaatacaaccccaaccccgctaacacttgacctcagtatcctacgacccaggctatggcgaagctggccgcgccatgacagccgtttcctgctccgatggcacaaacggcctcatcacgcgctacggctggaagactcaaggccagatccccaagtttccctacattggcggcgcgcaggccgtcgctggctggaactccccgagctgcggcacgtgctggaagcttacctacaagggcaagagcatcaacgtcttggccatcgaccacactgctgcgggcttcaacatttctcccgcggcgatgaacgctcttaccaacaaccaggctgttcagcttggtcgggttgatgcgactgctactcaggtcgctgttagcaactgtggattgaagaaataggtgtgaggctttgggtgatgagatgggacgggatacgtttatgatcgtaatgtttagtagtacattaattgatattactttaatcccaaaaaaaaaaaaaaaaaaggccccta

SEQ ID NO: 60156 - DNA, 839 bp, Triticum aestivum
  Clone ID: PAT_TA_60156
gccggccggtccggcgcggcgacgggggcggaacatcaggaactcgtcctgacgtttaaaaccgcccctctcctcgctttccagactcggcggtccctccgcacctggtaactcatcatgttgccttcatcagtgcgccgcgtcgtcgcctccgccgtctcgacccctcagaccggtgttgtgtcgtcccttgcctcagccactctcaagactactcctgtctttgttcgaaatcaccagcgacgatgctcctcctcgaaaccctccaaatctgataacggtcccaacgacatctcagccggccagtcggttcctgctactacaacgcccaagtcgggcggcgagaagcgaaaacgcaagagcaacaaggatgcctccgatcgagctgcttctatgaagaagctgcccagcgtccccagcacgcatcacatgtcacaagaagcccttggtctatcaagtttcttctcactacacagaccgatctctgtcacccaaactatgccccgagccgtgaccgatgagcactttgcctccatctttgctgcacgaagcagaaacaacaagctggccgacaccgaatcgacactctccagtactatcgaacagttggagggtcctatggcccagatgaccattggtggacaggagggacaggaggttatgcacaaggttgatatcaagaaccccgatggtaccgagtcgagcatgtacctccagatcgacaccatgtctggcgaatttctcccctttcgacctcctcctttgccacaagtcgaggccgctggcaagtcagagagtgctgttgcggaagcggaagccgtggaggacgttcctcagca

SEQ ID NO: 60157 - DNA, 527 bp, Triticum aestivum
  Clone ID: PAT_TA_60157
gccggccggttcgggaccaatcaaagcctctttctgtagtggagtgagcgagcccaaaccatggcctccaaggtgttcgcaatgctggctatcgttcttgtcctcacccatgggcatctccctgctgtgatgggccagacgacaccgccagatcgtccaaaatacttcgcacgtcaagatgctgcgccagcggctgggaatggtgcagctgcaggctctggcttcactgaggagaagggatggttctttcagcgtccactagcaaggccgacacctcttcctccttccttaaagctgtgaagtaacatgcagtccgctgcaaattatcctgctagagtttgtatgtactcattgtaatgaagcagagtacgcaaggcgaataagtagtccactactggctacaaatgggttgtgttccccgctatggtatcgttatatgatgttttctgccaggacacgcggatgtgcgtgggcaaaatagtgtactgaatatctcagataatatcagcgtctctgttctgaacaac

SEQ ID NO: 60158 - DNA, 741 bp, Triticum aestivum
  Clone ID: PAT_TA_60158
gccggccggttacgggaatcagtccagcgacgaacacccgttcgcgaaatcccaaatctccaaccaaatcccctcctctcccgcgtgccgacgagcaccagccaccagacatggacgcctcagccaccggagccggagcgaaggcgaagaagggcgtgtccgggcgcaaggccggcggccccaggaagaagtcggtgacgcggtccgtcaaggccgggctccagttccccgtcggccgcatcgggcgctacctcaagaacggtcggtacgcgaagcgcgtcggcacgggggcccccgtctacctcgcggccgtcctcgagtacctcgccgccgagctcctggagctcgccgggaacgccgccaaggacaacaagaagtcccgcatcgtgcccaggcacctgctgctcgccgtccggaacgaccaggagctcgggaggctgctggccggcgtgaccatcgcgcacggcggcgtgctgcccaacatcaacccggtgctgctccccaagaggacggcggagaaggagtccaaggagggcaagtcgcccaagaagaccgccaagtcccccaagaaggccgagaagaaggcttagatagaggcttgcatcgattagcttaagctttgctgcaacagtgatcgctgttttactaatggtgtcgatgtagatctgtgctgccaggaaaaaaactactcagaaatctctctaaaaaaaaaaagaaaaaaaaaaaaaaaaaaggccccta

SEQ ID NO: 60159 - DNA, 248 bp, Triticum aestivum
  Clone ID: PAT_TA_60159
gccggccgggtccggtttgcgctagaatattccgctctagagttgtcccaccctaaacagctcatgtaccttacaggcttgcattgcggtggtccttaaggatgtagattatctcaaataaaaaatcccgaagatctttgccaaaaaaaaaaaaaaaaaaaaaaaaaaaaaaaaaaaaaaaaaaaaaaaaaaaaaccacctaaggttccaccaactccaacgaaaaaaaaaaaaaaaaaaggccccta

SEQ ID NO: 60160 - DNA, 250 bp, Triticum aestivum
  Clone ID: PAT_TA_60160
gccggccgggttccggtgccatcgtttgagagcttgtttcaagctgtgagactggttatataatgtcagtgtgggttttaactgttttgcctgggaaatagtggaactttgcgttgctctgtttgtttggcatcccagttcttagtgaacagaagcctgcctgtctacttagtttaacaactgtaacttcgttgccagggaaaatggtgaaccttgcgtatcccaaaaaaaaaaaaaaaaaaggccccta

SEQ ID NO: 60161 - DNA, 427 bp, Triticum aestivum
  Clone ID: PAT_TA_60161
gccggccaggtcgggctctgtctcggaaaaaccaagagaaaacctctcctcctcctccttcttcctcctcctcatcctcttgggtggatctcatcttcagatcacatccaagcagcgcaagcaagagaggacaacaacgtgtccttggtcgagtttgagctcatcaccgtgatgcagtgattgaagaaggctcctcctcctcctcgcctatgaggaggaggaggcacaggaggctcagcagctgttaggctgagcacaaagcaataaaccggccaatcatggctcatgttcttcaccccctccccccctctctctgtttactgtttatttgctggaagttttgctagtcctgctaccttggattaattgtcgttagtaatacaatatatgtttgtttgtgcaaaaaaaaaaaaaaaaaaggccccta

SEQ ID NO: 60162 - DNA, 684 bp, Triticum aestivum
  Clone ID: PAT_TA_60162
gccggccaggtcgggaccattcctcccaccttcaagctcatccacacaagcacctctcggctctcccggtcgaagcatccgcatcctcatccatggcccccaaggcagccgagaagaagccggtggagaagaccccggcggggaagaagcccaaggcggagaagaaggtgccggcgtccaaggagggcggcggcgacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgcgagatccagacctccgtccgcctcgtcctccccggcgagctcgccaagcacgccgtctctgagggcaccaaggccgtcaccaagttcacctccgcctgatctggccgtctccgtttgtcttctttgatggatgtatcggtgttgctctgtagtagttagctgttcgtgctctgtcgtgttgtagcttgtgctggttgttttggatcacatttcatgatccggagaaatagtaatttcagttctttgaaaaaagcaaaaaaaaaaaaaaaaaaggccccta

SEQ ID NO: 60163 - DNA, 852 bp, Triticum aestivum
  unsure (1)..(852): unsure at all n locations
  Clone ID: PAT_TA_60163
gccggccgggccgatctttacttacaccatcagtcagctcttgataacttcaacgtggcactttttcaccttttgtttttcattacaactcttccttgatacccccttatacgaaatctcacaatcatggcgcaagaccctcgagctctcctccaaaaggctcagaagcagctccagagcgccggtggtggcttcagcttctttggagggcgagaggataagtaccaagaggctgccgatctctttacccaggccgccaatgccttcaagatgcaacaacagaacctcgaggccggaaaggctttcgaacaagccgccaggtccaaaccgataagctcaaggagcccgacgatgccgccaacaccctcgtcgatgcatttaaggcctaccgcaaagacgacccacaggctgccgcgagatgcttgaacgttgctgtcgatcgatactgcgccaagggcaacttccgtcgcgcagcctctcacaaggagaaccttggtgagctgtatgaggtggatcttggtgatgcgaagagcgcgattgaaagctacgaactcgctgccacttggtacgagggcgataacgcagctgctcttgccaacaagctatggctcaaggttgccgatgtggccgccctcgagggtgactactacaaggccatcgaaaagtacgaaaaggtggctgagcagtcaatcaacaacaacctcatgaagtacagtgtcaaggactacctgctncaggcaggcatctgccaccttgccagcgncgatctcgtcgctgctcagcgcgccctcgagaagtaccgcgatatggacccctcattcggcgctcagcgagagcaccagctctatgcga

SEQ ID NO: 60164 - DNA, 603 bp, Triticum aestivum
  Clone ID: PAT_TA_60164
gccggccgggtcggattctatcacgcgacccaccaggcggcggcggcgtctcggctcgcaccccacagcacacccatggcggcggagggcggcggcggcggaggaggagggaaggtgtcgttcaaggtgatcctcacctccgaccccaagctccccttcaaagtgttcagcgtgccggaggcggcgcccttcaccgcggtgctcaagttcgccgccgaggagttcaaggtcccgccccagaccagcgccatcatcaccaacgatggagtaggcatcaacccacagcaaagtgcaggcaacgtgttcttgaagcatggctcggagctgcgactcatcccccgcgacagagttggagcgactgcggcgtctttctagtcagtcattgttagagccaacaatgaagaaacctatataacaggaataaaagcatgtccatgctcggttgtataatggatgcaacatggtcgagtataatttaccatcaacagccagccagccctatgattgacaggatgaatatagcttggcaggcagtgccatgtgttgctgtctttgtttgcaaaaaaaaaaaaaaaagaaaaaaaaaaaaaaaaaaggccccta

SEQ ID NO: 60165 - DNA, 806 bp, Triticum aestivum
  Clone ID: PAT_TA_60165
gccggccgggtctgggaagagctttcatcactctcaacttcctttacctctcatctctctcatacaccacactacttttcacaactaccacccacgaatagtagccatggcttctactcctccccaagctgactacggcaaggaggccgttctcgatgtcagcgagaaccaagatgtcgagaccggcgaggtcaagaacggtggtctccagcgagatctcaagaaccgacacatgcagatgattgccatcggtggtgccatcggtgctggtctcttcgtcggttcgggtggtgcccttcagaagggtggccccgctgctctcctcatcggttacctcatcatcggtatcatgcttctctgcacatgcttggccctggctgagatggctgtcctctaccccgtcaacggtgccttcttcacatacatctgccgcttcgtcgatccttcttggggcttcgccatgggttggcaatacgctttggcttggttgactgtgctcccctttgaactgatcgctgcctccatcaccatcaagttctggagagaagatatcaacatggctgtctgggtctccgtcttccttgtcactctcattggtattcagttcttcggtgttcgaggatacggtgaggtcgagtttgtgctctccatcatcaagatctgcgcctggtgtggtttcatcatccttggtattgtcatcaactgtgggtggtgtcggcgaccagggctacattggtgtcaagtactggcaggaccctggtgctttcaccagcttcaagggtttctgcgctgtctttgtcgtcgct

SEQ ID NO: 60166 - DNA, 379 bp, Triticum aestivum
  Clone ID: PAT_TA_60166
gccggccggttcgggaaggtcatgctgccatccgtgctgatcccaccatggccaaatcaaccaaggcgcctcccaagactcacaagaggtacaaccccaagaagctgacctatgagcagaggaaggccagcctcgtcgaaaggctcaacgccctcaacaactctgccggtgccgccgatgacgacgaggacgacgacgagtgaaatgcgtttttgttaaagtctggcaccctgcacaacggacctgttcctttgagttttggttattatcttgctggagttatagattgtgttatcgggattatgtgccgtgctggcatttggatattgatcttaatccgttcgtctggcaccaaaaaaaaaaaaaaaaaaggccccta

SEQ ID NO: 60167 - DNA, 234 bp, Triticum aestivum
  Clone ID: PAT_TA_60167
gccggccggtccggggaggaaggaaaaggcgctctctctctgtctctcccacacggcggcgcggtgtagccggcggcggcgatggctttctggcaggcgcgcgacttcctgggttctgcggcgtggtgcgggcaccctcctcgacttcaactcccaccgctacgcctcctgccctctctgcggcttcaagcgcaaggccaaagagatcgaagggaaagaaactcgctacgcggt

SEQ ID NO: 60168 - DNA, 399 bp, Triticum aestivum
  unsure (1)..(399): unsure at all n locations
  Clone ID: PAT_TA_60168
gccggccggtccgggaagnaccaccacttgcaacatttaatctgtgctgcaaaactttacaacatgaatcctcgaaaatttatggccccaggggctgcctttaccatggcctgtgtcttgtttgtatacactcgctcatccatacactctgcccgagaacaagcacgttcatcaagattgccagcgaatggtgaacgtactacaaggcgtagttcatcataaacaaagacaaagagcatacaacggcgcacggagcgaatcgctcaccggctggatttcattgactttcaagggcatatcgtaatttttatgatttgttgtctaatttctcaagcaatatgaaaacaaactcctcttaatgccagcgctgcacaaaaaaaaaaaaaaaaaaggccccta

SEQ ID NO: 60169 - DNA, 700 bp, Triticum aestivum
  Clone ID: PAT_TA_60169
gccggccgggtcgggatcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcgacggctacggcggcggcggcggcggctacggcggcggcggtggtggctacggcgggcagcgtgggggcggtgactccggcgggcagtggaggaactgagcggcgtggcccccagttatcgatctatctaccatctc

SEQ ID NO: 60170 - DNA, 701 bp, Triticum aestivum
  unsure (1)..(701): unsure at all n locations
  Clone ID: PAT_TA_60170
ngccggccgttccgaaaaaaaaaaaatcccaaatcaccaaccaaatcccctcctctccctcgtccggacgagcaccagccaccggacatggacgcctcagccaccggagccggagcgaaggcgaagaagggcgcggccgggcgcaaggccggcggccccaggaagaagtcggtgacgcggtccgtcaaggccgggctccagttccccgtcggccgcatcgggcgctacctcaagaagggccggtacgccaagcgcgtcggcacgggcgcccccgtctacctcgccgccgtcctcgagtacctcgccgccgagctgctggaactcgccgggaacgccgccaaggacaacaagaagtcccgcatcgtgcccaggcacctgctgctggccgtccggaacgaccaggagctcgggaggctgctggccggcgtcaccatcgcgcacggcggcgtgctgcccaacatcaacccggtgctcctccccaagaggacggcggagaaggagaccaaggagagcaagtcgcccaagaagaccgccaagtccccaaagaaggccgacaagaaggcttagagagagacgcgcgtcgattagcttaagcttggctgtaacggtgatcgctgttttactaatggtgtcgatgtagatctgtactgccatgaaaaatcaattcacaaatctgaaaaaaaaaaaaaaaaaggccccta

SEQ ID NO: 60171 - DNA, 785 bp, Triticum aestivum
  Clone ID: PAT_TA_60171
ctgtgcggcgctcgaggcggccgggtccggacaccgcctgccgcccaagcctcctccatggagaagcgactgccgccctcgctgctcctccgggccatgccccttcgtcgcgctcctcctcccggctacgggcctgccgcctggtcctcctcccttctacgcgtgtcgcgccaagcaaacccccggccgccgctccctcttacctactcccggcgacgagcggcacgcccggcacgcgcccgaccaccccctcctcctgcctcctcctggggatgcacgccactcccggcagggcttgcttcctcggtcacctgcgccgtggtcgccagcccgttctacatccctccactaggcgggcgctgatgttggtgctcaaggattccatggagaccatgaaagggtggcaccgccggcgggcgtggtccttcaaggtgagggtcctggacggggcgccatggaaggagcgacatctgcgacgccgagttgctggtcggggcgaacgagtccatgtgtgtgtccactagggcgtacccggagctctgggcctgctgcgttctttgagtagatgagcacggctggtgttcacggctggcttgctgctgaagaggtaaaattctacagaagttgtattcaccgaactagtagtatgtagtatctcaatccggctgtaagagttgctcaagaattcgtagctgacgagggaggataggttaatgagtggaggcaggcaagtagttgcttttcgctagggttagagttactcacaaaatcagatggcacttgga

SEQ ID NO: 60172 - DNA, 859 bp, Triticum aestivum
  Clone ID: PAT_TA_60172
gccggccgggtccggaacccaactccggcggcctcctctccctccagcgccgccgctccaccatcaccttccttcctctccaaaggaagggaagggaaggggaggggaggccccagatcgagtggagcgacgcccagatccgcagcggcaccggcaccagcgcgccgtcgtccacctggactcttccttctggcggatgcgcggggcatcgccggccagagaggacggggaggagatatgtcagcgagggaggcggctcaccttggaccggccatggcgccggcgttgctaactcccacgggcctctcatttcccatcttttctggaagtgatgaaacaagcaaggaggaagggcgtagtgttggatatttgaccagtatatccatattataattagaggagaggagttgtaccgccttgcacataatgcattttaattccttatttctcacatcccggaagtcacattacatctatgaaccagaagaactagagagctgggtcaacataggaagatgcgagagctaaagaaaatagactgcgaggtctgaccaacacaaggtggcaacagcagtagtggcgaaggcatgaagaggcccacatctgaaaatccgttctgctgactgatcaagggagatggtcttagcatccactgtgacaatgttgtccagaacatggacgactctggaaactgaaaagtgcacacaaaggccaccgattggatcagtgcgaagaaacccgttcggaccgctgccgcaagcctcgcctcagcaacggatcaacctctacacctacatccacttcgacagagcttcaaatcactacctacgaattgctgacagtgcagcttcctaaatgc

SEQ ID NO: 60173 - DNA, 650 bp, Triticum aestivum
  Clone ID: PAT_TA_60173
gccggccgggtcggggagcgagcgatgcaggcactagcacgagcggcgcgggggttctggccggcggcggccgcggccgcggggagggggaaccgcgggcaggtgcagccgtcccgggggatcgtggtgcatgtgagggatggcaacctggagcgcgcgctccaggtgatggagcgcaagatgcggtccagcggcatcgagcggctcatcaagcgccggacggagcaccacgtcaagaactccgagaagcgcgtgctcgcgcgcaaggctctcatggcgcgcgtccgctcccaggagctcggcaagaatctccgcgatatcctcatcaagaagatcaggggtcagtaagggcatctctcaatgggcagcatttcagcgacattcgacggtactacagcagggttacaatgctatttcttcgtgggtgcatcatgttgaacatgtaatcaatcttcatggtggaatttagtaattgaactgactattttctttttccaactatggatctgtttagagctgcgttgataaatgctcacatgtgtgccaggaatctgttcatttcttggatcacacacaagtttgcgataaattattgagggaatttttgtggtacaaaaaaaaaaaaaaaaaaaaaaaaaaaaggcccctag

SEQ ID NO: 60174 - DNA, 405 bp, Triticum aestivum
  Clone ID: PAT_TA_60174
gccggccggtccgggagaggggattgtgtgaatatgtattgggggaggcaaaggcaaagagaaagcagataggcagcgtatctgaggcatgtcacttcttattttttagttattcgtcttttttattttttttcttgtatcttggaattcgcgttttattttactgttgcgcatgtgttttctccttttttttctactggtgagaggcgcgccatctctttgccttttatgtattcttcctaatgatatggcagccttttttctttctacttttggtgatgtgagaggttggaggaggctgattagggagggtatgggatgggatagtatagattggtctgggacggaagaatggaatgaaagatgttgtagatacaagaaaaaaaaaaaaaaaaaaggccccta

SEQ ID NO: 60175 - DNA, 469 bp, Triticum aestivum
  Clone ID: PAT_TA_60175
gccggccggttccgggaagctttctaccctagcagagaaaaaaaaaagcagaggagaggaagcggaggcgacgatgtcggcgatgacggcggcggtgcccttctggcgcgcggcggggatgacctacatcggctactccaacgtctgcgcggcgctggtgcggagctgcctcaaggagcccttcaagaccgaggtctcctcccgcgagaaggtccacttctccctctccaagtgggccgacgagaagcagcagaagcccactgtgcgcacagatgatgaatgaagatcgggtgccatggtgatgttttgagaagttgttgatttatggtcagggcttaagaacttgagaataaattcttgcggtgacaatggatctattccgatactatgttgttatatttactaattgctcctgttctacttgatgaaccatgtgaaactcaaaaaaaaaaaaaaaaaaaggccccta

SEQ ID NO: 60176 - DNA, 318 bp, Triticum aestivum
  Clone ID: PAT_TA_60176
gccggccgggtccggattcctacagtgtatgatagtacgattgaggaactgtataatcctgtgaacaagatctatggaatggatggacacatctcggcgatttcatgccgccaaatccatgagatctgagtgctgtgcggcaccgagaagaagcactgttactgttagttttgcagataatacttacattttaccatgcagtaatactactagcagcgctttctgaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 60177 - DNA, 313 bp, Triticum aestivum
  Clone ID: PAT_TA_60177
gccggccgggtcgggtccctcctgtgggtgaagatcgacccgttcatatccgacacccagaaggccgtcgccatggggcagtgcggcgtcaactgctgatcggatcaccggcgctcaagagtgagtatctgccctcctcgtgtaaataccggagggggttagatgggattttttggttgtagatgaagacggacggagtttatctaaattaattgttgcccctttgttagtcgcttatgctgctgctgagaaccactgcctacgaagcctgcagcagcgtacattgtgattttttttctccttcccccccccc

SEQ ID NO: 60178 - DNA, 724 bp, Triticum aestivum
  Clone ID: PAT_TA_60178
gccggccgggtcgggcgtattgtttgcatctttattccagtgaagtataccatatgcagttgaggctatcatgctgaagggtaggaagatggaggagtggattattttagcaagctggtaacctattggtttgtgagtaatcttctgtatatactatttataggactgttgttgtggtgttgacgacgacaacgaagtgtgcagatgtttggtatggagagaaattcagaaggacagggagaactcatctcttcagaactaaagtacacctctgaatctatttgtgagcaattcttatgcactcaattggcctatatacatgtctgatttatgccaatgaagttgaccaaatgagaaacctcaatgataagtaattctttaataaaacatctaactataattatgcttaagatattctagctttctacatggttaaattattattctattacatcattatacactatcctataattttaaatggctagaaatttcagtcttcttctggctaattgttttttaaagtcaagtgttaaagtcactctgacgcggatactgtatatccattgatagtttattaggcgaggcgttgtatttttcttttgtttcttcgggctattttgtaatgaaagttactctcaaactgatgattccatgttttggatgacatcaatcataagcatatatatgttccaaatcttcagccttccttggttgacaaata

SEQ ID NO: 60179 - DNA, 483 bp, Triticum aestivum
  Clone ID: PAT_TA_60179
gccggccgggttccggccaagaaaaagaagaagcgagaggaggaaaaagcgaaaccctaaacccccgtattcccaaaccttcgatccgatccgatccgacccgaccggcggcgatggcgtctgcgccggtggagaagctcaagagcttgtggaactcgcaggtcatggacgaggagcagtgggcggtcaactatagagtgctaaaggctgcggggatatttgctggatccatctttttgatgcgcgcctttggtgacatgatggtagtttaaggacgtggtagtggctgagcagggtaatggtggttccatgcccattttcgttgtgtgccttatgatcaggcttgtggattatttgtactcagacttgtgggtttcttgttaagttggtgtttgaagcatttctcggcagggctatgagacgttctttttgagttgagcacttgtgttctatgagtaaaaaaaaaaaaaaaaaaggccccta

SEQ ID NO: 60180 - DNA, 589 bp, Triticum aestivum
  Clone ID: PAT_TA_60180
gccggccgggtccgggaattcaattgtgatcatcatcatcctcgacaccaaagctcatcttcttctccttgaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacccaaaaaaaaaaaaaaaaaaggccccta

SEQ ID NO: 60181 - DNA, 615 bp, Triticum aestivum
  Clone ID: PAT_TA_60181
gtgcggccgctcgggccggccggtcgggaaggtaaactttattcgcgaacatcctgatatctgcttgcttacccacctggaaaagagtataacctcgtgagcgcgctagtacttgcaacgccctttccgcctacttcaccaatagccgtcatatgaagggcatccccccagaccactggctagtgacctctcctgcattattattctatgatgctcgctccatggcacattactctctccagaacgtatacaccattcatgctgctctccgtctaccctgacgaacgttctgcctttgccttaagaaggtcttcaccaccccccagaagatcaagcacaagcgcgcccctaccaacctggctgttctcaaacaatacgaagcccactctgtatgggaaatcgaatcacttctatccaaacggcccacctacacttgcggccctggagccttcatggctgacatggaggaccatcactactgcgtcctgtgcacctgatctaccgcttcgactgcaataaacgtgttcaacaccaaattgatattcatgacggacactccccctttgccaaaattgcgcaataacaagctggaccacaccgcacgtccttcccctg

SEQ ID NO: 60182 - DNA, 647 bp, Triticum aestivum
  Clone ID: PAT_TA_60182
gccggccgggttcggaaggcaaggcaagcagatcgcactgaaggcagtagtgcagcagaccagttctacacttccaacgcagaaacaaaatcctccaggatcatctacagcatagggagcgaggagatggaggggagcagcagccggacgccggagataaccatcgtcccggcgcctaggccggcggcgggcggtggcggtggcggtggcgccgtcgaggcggtgaaggcggcgagcaaggagcccatcagcccgggctcgccttccccggccagcagggagcgccccggcgccgtctccctgcccgggtggaagctcgactccctctgcaaggagtccagctcgccgccggccatgatggcgcgcttcccctatttctgaagccacgcgggcatctttgccatcctttgctagtactgtagtattttccgtctggtatatgtaagtttgcagcggcagttttgttgctcgttccttccggcgatgtcatgtagaactcgtatcgtggttgtaatcgttctcgcaagagttctggcgtgcctttctggttgctttgaacttgatcatgcacgtgtatattttggtctcggagtttgtgtatgatcatgtgaactttaatcctcccaataatgtatagatataaccac

SEQ ID NO: 60183 - DNA, 598 bp, Triticum aestivum
  Clone ID: PAT_TA_60183
gccggccgggtcgggagcaccactcgcccaacatcgtcgccgatcgcgcgatgggcctatggcgctcccactcccgcgttggagctggaccagctgagcaagaccgagatgactcggtggacacaacctccgcttccgccaccagagcgacgacctctcctgccacatgaccttctccctcttcctccccgcatccccggactccaacctccccgagctctactggttctccggcctcgcctgcaccgacgagaacttcatcatcaaggccggcgcccatggcgctgccgcggcacacagagtcgccctcgtcgccaccgcacacctccccgcgtgagactaaatgtataaagcgaggcagatagatgagatgatggcggtggcgctgcatattatgagaatgccacagaaggataactgagaaaacgtggccagggatgactatggtgggaaggagctgccaaaagttctaactgacaactatgaacagcttaccacgtcatgtgcatcgatagtcgctcactctatgcgagggcacagtgtactggctatctacttgaagaacactgacaaatacgagtacgtgtctgcatttgct

SEQ ID NO: 60184 - DNA, 655 bp, Triticum aestivum
  Clone ID: PAT_TA_60184
gccggccgggtcgggatctccacaagcgccatcaccacacaagctaatcagggtctcagctccttccgggctccacgatttccagcaagcaagccgaagcactagatcctcgatggctcgcgtggcactgctcgccgtgttcgccgtgctcgcggcactggctgtggcggagatggcgtctggggcggtgacctgcggcgacgtgacgtccgccatcgcgccgtgcatgtcctacgcgacggggaaggcgtcggcaccgtcggcggggtgctgcagcggggtgaggaccctgaacggcaaggcgtccacctcggccgaccggcaggcggcgtgccgctgcctcaagaacctggcggggtcgttcaagggcatcagcatgggcaacgccgccaccatccccggcaagtgcggggtctccgtttctttcccgatcaacaccaacgtcaactgcaacaacattcactaagttatcggtcagcatcatcacaccaggctctacatggatagctagccgacgcggtgtgtctactgttgctacttctgcatatgttcgttgctgctttccgcatgtgttcgacctccatcttttgcccttgttacagatcgagcagattactgatcgaatcatcaaaaaaaaaaaaaaaaaaggccccta

SEQ ID NO: 60185 - DNA, 214 bp, Triticum aestivum
  Clone ID: PAT_TA_60185
gctcgagccggccggtcggaaaagttcacggcggcggggactcctcgtcgtcatcctcggactcggacgacgagaagaaggggtcggcggcgggcgtcaaggccaagatctaccgcctcttcggccgcgagaagcccgtccacgccgtcctcggtggcggcaagcctgctgatcttgttcatatggaggaacaagataatcccgtaagaggtgc

SEQ ID NO: 60186 - DNA, 767 bp, Triticum aestivum
  unsure (1)..(767): unsure at all n locations
  Clone ID: PAT_TA_60186
gccggccgggtcgggagtttgccgctctcggcacctcctctcgccccggcagctgctctgctctgcttccctcccctcttgcagatttctaggtagagtgactctgctgctaatctcaagttctttctgttcttcttctgctgctttctagtgttattttcacctgtatgtgcgctaacacgcaactgattaccaccaaccatcctccttgttgggttgttgattagtactcctaatgaaccctcgatctaaatctcgggttatttggaaatcggaacgaatcatgtatttactcgagcgttaaattcaatgcctatgcagaaacaggaaacacagggggcagaaatggcttccaactacgtggacaccacgggggaggaggggaggttccacgcccacggccaccacagcaacagcaccacgccgaccggcgaggccgcgtcgcccaagaatacgcggaggagatggcccgggtcggcatcggcgccgtccggcgcaggccacagactcgcttccaaatgcgtctgtgcgccggccacccacgccgggtccttcaagtgccgcttccatcgtaccaactcccagggccacggccacggccagggccagggaagccgtccttcttcgcctccttcaccggccgcggncaacacggtggcgcggcacccggnctcgccatcctcctcctccggnatcgtcgcgacccagtgacgcagcccaagcatcggtctcaagaatcaagaatgctcgatgatgaagaaagaagg

SEQ ID NO: 60187 - DNA, 502 bp, Triticum aestivum
  unsure (1)..(502): unsure at all n locations
  Clone ID: PAT_TA_60187
gcncggccggttttccngaaaaaaaaaaaaaaaaaaaaaaacccatacaaagcttgcaaagctccatcgaacttgttatcaagaagcatagaaatggctgcaaagtacccacttctccttggcgtcgtattggtcgctctcctgctcgtctcccaggatgtagcgcatgcagtagaagaaacgatgcctgcgcaacgtccagacgggtatagtggatatgggcctgggtacggtggtggctacgacaacaacggcggaggaggagccggtcaaaatggtgatggtggcagcggctatccttgagatgaatattgtggggtggcggtcaaaacggtgtctgtcactctagaaaccaaatatatatggtctgtatccatatatcaaataaggagcgtcttcatctgctcgagcgtttacttactagcagggacgatatgatagtattgcgagctannaaaaaaaaaaaaaaaaaaaggaaaaaaaaaaaaaaaaagggccccta

SEQ ID NO: 60188 - DNA, 674 bp, Triticum aestivum
  unsure (1)..(674): unsure at all n locations
  Clone ID: PAT_TA_60188
gccggccggtccgggcaacaagtcggatgtttatagttatggaatgatgctgctggagatggttggaggtaggagaaacgtaaaatcaattgttgcaaaatccagtgaaaagtattttccagattggatttatgaccactttgcgcaagatgagggattacaagcatgtgaagttacaagagaaattgaggagatcgcgagaaagatgatcataataggcttgtggtgcatacaagtgttacctatgtatcgacctactataacaagttctagaaatgtttgagagaaggttagatgatctggacatgccgccgaagcagaacttctgtgaactacttgaaagctcagctcagaatttggatgtaaaaagttcatgttctaccaaacctgaagagatcagccttgtgaattcaaaaatcctacaacaatcgccaactctttgagcagataggccatgtgaatcaaagaacctacgttcatctccaacactgtgagaagttggcctgtactactgtacattcagaaattgaattcggcattgtacttgtagtaggatatattccatatatgcatgacctagagtcaagagcagccgcatgatagcatcctaagttaccaaccacggaagggatacaatttattctgatganaaaaaaaaaaaaaaaggcccctan

SEQ ID NO: 60189 - DNA, 431 bp, Triticum aestivum
  Clone ID: PAT_TA_60189
gccgtgcggagaagcatggtgtagtccggcgtggcagcgtgtgcagtgctcacccgatgcgattcagtattttctggtgtgtttagttttacagtgtggtgcagctcactcttgttttgttttgcagctcacttttttttctcctagaaatcatctacaatgcaacactcactaagaaagagaagagaacatcaatgttcatttgaagtttgatttgttgtttatgggaaacgcatagagaaaagggtagtaagaatggatggtcattttgtataagcaactctttccctagtggagttttgttgggtactgcaacattgattccgctgtgtactagatggcagtgtggctgtgtaaaaaataatgaatggatatgtatgtttttaagctccaaaaaaaaaagaatataggtacaaaataaaggcccctta

SEQ ID NO: 60190 - DNA, 669 bp, Triticum aestivum
  unsure (1)..(669): unsure at all n locations
  Clone ID: PAT_TA_60190
ctgtgcggcgctcgaggcggccgttccgaattcattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaaaaannnnnnnnnnnnnnnnnnnnnnnnnnnnnnnnnnnnnnnnnnnnnnnnnnnnnnnnngaaaanaaaaaaaaaaaaaggccccta

SEQ ID NO: 60191 - DNA, 559 bp, Triticum aestivum
  unsure (1)..(559): unsure at all n locations
  Clone ID: PAT_TA_60191
gccggccgggttcggtaccgcgccgtgctgcagcggctctcgtcggcgttcgtcggcaaggaggaccggctgcgcctgctggtggccgccgccgcagactcctcgcgcgccagcctcaagaagcgcggcctccaccttgctccgtggcggaagcccgagtacatgcgcgccaagtggctgtccccctacgagcgcgaggctcctcctccggcgccggatgcctctgccagtgagctcgccgccatcggcgagggaggcgaagatggagccaaagtttgattaatcaaggatcggccattagttgattttttttctcctggggaatttgcagcgcagtccccgggcgggcagggaccggatgcagatgtttttgctatattttcgtccttttctctctcattttgacccttttgatgggtaacggagtactagcagtaacttccagtaagtatgtaccgggaagcaagagcaactaaataaataaaatttgtagtgtttagttcaaaanannaaaaaaaaaaaaaaaaaaaaaaaaaaaaaaaaaaaaaaaaggccccta

SEQ ID NO: 60192 - DNA, 574 bp, Triticum aestivum
  unsure (1)..(574): unsure at all n locations
  Clone ID: PAT_TA_60192
ngccggccgggttcagacaaccacaacaaaaccatcattcaatgagtagatcgacaggactgggaagagatttgctccacaagttcaggaccaaccaacgatgaagaacagcacgcttgtggcgatcctggtcgtcctccaggccatcatggtcataggaatcctttcacacgccgccgatgacaatttccccaagtgctgcgaccactgcaactcctggtcggggtaccaattctgtgacgacgtcggccccaggtgccgcgacggctgcgtcaactgccacgtggtggaaacgagccccgtgaagacgttccggtgtggagatggacgccccgtcctcggcgggcaaggcacgcccacgccctgcccaccaccgtgcaaaaagcattgatcgctagagctcagacagtgagatcgatgttgcgcctaaaacataaaataaaaaggctccgatgagatgagcagagccactcccagcgttctctttcctttgagagataatatagttgatgttgctttaaataaataaacacgggtatcagtttgcgaaaaaaaaaaaaaaaaaaggccccta

SEQ ID NO: 60193 - DNA, 722 bp, Triticum aestivum
  Clone ID: PAT_TA_60193
gccggccggtccggggctcttgctcagttctccctctcagcccgttgcctttcatgtcgtgcggcgcccacacagcaccctacagctggctcttcgtcccttcgccggcggtgcagctcccgccgccgtcggggcacccgcgctgccgcctctccgtcagggccacatgcgctccgacttcctccagcgtccccgccggtggcggcagcgcgcgccagcagacccggccgcgcctcgtagcggcgcactcgatacctccgccgccgccccctaccgccagaaccgtccggagggacgccgcgacggggctcgctttcctcctcttcgtgctcggcatggtgatcagctcagctctatcactagttatcgtctcatttccagcatggagagctctgcagcagatggaaatcgcagctcgtaaattgtcgaaattagcagcacaagaggtacccggaactatatcgtcactgaagctgtcattcatggagatgaacgatctaaccagccagctaaagaaaattaggcacattttcacaacaaatagatctgggaaggatagatgactaatgtggcagcatgatcacggactggattccaaaacagggacgtgtgtgaattctttaatctgtagcgatgtcttaattgttagtacgtgctactttgttagattattacttgtgcctcgatttcttgaccatgtgatgcatgttgtcagtattgct

SEQ ID NO: 60194 - DNA, 743 bp, Triticum aestivum
  Clone ID: PAT_TA_60194
gccggccggtccgggagtcccaagatcccaaccccatctccaaccttcccccttcccctgttcccaaatccgcagtcccgcgcgccgcgatggaggcgagcaagctcaaggcggccaggctcctggagcagatgagcgctcacctcgccaccgacgccggcaaagagatcgccaacaaggtcggtttcgtctaccagctcaacatctcgcccaagaagatgggcgtcgacgaggagatcttcgtcgtggacctcaagaagggcgccgtctccacagggaagtacgaagggacgccggacgcggccttcaccttcacagacgacgacttcctcgccatcgccagcggcaagctgaacccgcagatggcgttcatccggggtaagctgaagatcaaggggagcataagcgccgcgcagaagttcacgccggacatcttccccaagccgtccaagttgtagaaggccggattgccatgccttgccctggtgatcggggagctccggtgatcggttaataaaagaatctagttgtgttcgcggtgacaatttggtgggattgttactggtaaggagtttgtttacctagaaccaccacacgaacaacagaggtttcagtcagtgtctggagtgaaattcgttttctttggttgagaaggagaatactaggtacgaatcgatgtgtattgtgacgatgatgataacctttctcgatggatcgaaaaaaaaaaaaaaaaaaggccccta

SEQ ID NO: 60195 - DNA, 767 bp, Triticum aestivum
  unsure (1)..(767): unsure at all n locations
  Clone ID: PAT_TA_60195
gccggccgggccgggttgctggggttctcacaatgaggccatgggaacgtgtcattgacccatcttttggtcatcttgtgctggatgggaataataccgatcattctgaaatgcagatgtatgctaacttgtatttcccacaaatctcggagctcctcaggagactaccaaatgtcatcttgctgatgcttaagacgaatgactgtttacgtgcagtcaatcatgccctggttggagggtctaccccggaatcatttgagatcattgcacgagcatcttctgaagctgtgtttgaagctaaaaggatggagaagaggttctttctatacagatttataatatggctggaggagcttttgaatgaacttcacctatttggaatgaagctgtggttgcattatcaacaaccaaggaggatactggctgggtaaaagtagctcggcacatcgacagctttttgactagtgtaaatgcgaaattggcatctagttccatgagaggaatatacggcatttggcgtaacattgccttgtttttcatgcattattcggcatatcaaccatgattgatcttaagatcttccttgaatgtacacttccctatagaagatgacagttttgagatagcatatgttcattttggtaggtggataaagtatacaaattcccatcactgtacagtgtgaatgatcaaactcttgttccatgatgtggtctctctcttcactgcctgttacatttgtgaatgatncaacatcgataagtggg

SEQ ID NO: 60196 - DNA, 482 bp, Triticum aestivum
  Clone ID: PAT_TA_60196
gccgcccggtccggatataataactaacattgctgatattccaaagaagcctggtaccactatatggaaccgatggttcctcccccaagaatttatccactggaataaccgccccccccgggtggccaaatccctattgactattgaccaataagccaaaaaatatgcgtggcctgggactcctggggcctggtggttcctccaatggcagaaatttccccaaaatattaaccaatggggcggtttggtgaccccgctccctggaactccaattttttcctaaaaaatccaaaatccaacctccgggtttaaatgggaaaaaatattccaagattccaaaaaggaaaggataaggggggaaaaaatccagccgttggaaaaccaaaaaaaaaaaaaaaaaaaaaaaaaaaaaaaaaaaaaaaaaaaaaaaggaaaaaaaaaaaaaaaaaggcccccaaggcccccgcccctccaaaaacaag

SEQ ID NO: 60197 - DNA, 319 bp, Triticum aestivum
  Clone ID: PAT_TA_60197
gtgcggcgctcgaggcggccggtcgggagggagaagtccccgccgaaacctctggccatgaaaattcaaccgggaccccgttccggcaccctgccggagtgggaaatcatctccggaggccatcttcatcatcccggcggccaccatgatgaggagggggtagttcaccctcggggctgagggtatgtaccagtagctatgtgtttgatctctctctctctcttgtgttcttgatttgaaatgatcttgatgtaccgtgatctttgttaatatatttggatcatatggtgtacaaaaaaaaaaaaaaaaaaggccccta

SEQ ID NO: 60198 - DNA, 787 bp, Triticum aestivum
  unsure (1)..(787): unsure at all n locations
  Clone ID: PAT_TA_60198
gccggccgggtccggattctgattcttccccttccccctccctcccgtggctcgccgccgccaccgccagctcgcgccccgtcttcctctccccgaatccgcccattccgaccccctgatccgccgcgctgcaggtccgcgatgctttccctgtcgaggacgctcgcgaggcggctcttctccaccgcggccgccgggtccgagggcgccgccgccgcgtcaacttcggtggtgaggaaggcgcagaaccccctcgaggagttcttcgaggtcgagcggagcaccgcggacgaccagcccgctccccactacggtcgtggttggaaggcttctgaattacgcctgaaatcttgggacgaccttcataagctatggtatgtccttctaaaggagaagaacgtgcttatgtctcaacgccagatgctagcttcagagaacatgcatttcccaaacccagagcgcatttccaaggtgaagagatcgatgtgccggatcaagcacgtgctgacggagcgggccatagcggaccctgacccgaggaggactgcggagatgaagcggatgatcaacgccatgtgatccgctcgcgtcgcgccgcgcttcaatgtcttggagcagcagcagccgtagcagcattagcatctatctactagaaagaaagaatttgctcgcttcccttcttgtgttgtatgcctccccccatgagatgcataagaacagtaatccttgagacacctgtggaacgccatcgnccccgacagttccgcggatgaacgtcaatgcactt

SEQ ID NO: 60199 - DNA, 699 bp, Triticum aestivum
  Clone ID: PAT_TA_60199
gccggccgggtccgaagtcacttcattcccgccaattgttggatactcgaccgccagcaccatcgcgggcttcgtctacggatttccattgggttggcccattgtggcatcaggatgcacagctggcgctctttgtgcgttcctagccagcaggaccgtcttgagcaagtacgttgatcgcatggttggtcaggatcaccgttttgttgccctaggccaagtcctgcgccaggagggtatttggtatcttaccggcattcgattctgtcccctgccattcagtctgagcaatggctttctcgctaccattcctagtattacaccgctagcgtttacgatctctacagctctttcaagccccaagcttctcgtccacgtttttattggtagtcgactcgctctcctagctgaaaagggcgataagatgtccgccggtagcaaagcgattaactacctcagcatgcttcttggtggcgctgttggtcttattgtaggccttgtcatctacagacgcaccatggccagagctgaagagcttgcccagcaagaagggttggaccctgctggcgcatccgtcgaagcgggcgaagctggctacgtagactccgataactcacctctcatggatcccgaggaagcagctgcccttatgtcggatgacgatatcctcgctatgggaacgggatgacacccgaggca

SEQ ID NO: 60200 - DNA, 603 bp, Triticum aestivum
  Clone ID: PAT_TA_60200
gccggccgggctgcaaagcagtccccttccttccttctcctattgatccttaagaagcatcgtacgttggtccccaagaaagagatggaggtgaagaagagagcggcagccattgccgccctgtgcatcatgttcctcctcgtgctgccgtccgggcagcggcagcaggtggccgccatgtccgacttctgcaagtgcttcaacgactgctaccctgggtgcaggagccccggcgtgccgcgctggctctgcgtcccattctgcgccaacaagtgcagccccaacaccaaccaggccggcgacggcgtcggctctgccgccgccacgtgcaggatggcctgcaagatacacatctgtgacttttcagaggcgccagccgatgcagctgacgccgacgtctgcgtgcagaactgcaacaagatgaagatatggagccacaaggcccataattagcttccaagctgctctagaggagaaaaggattttaagagctagcttgtagatcatgggatcgtatatatacgatgttgaactgctgtgattgtggcagcaaccaataaaatgagtttctgtgtcgaaaaaaaaaaaaaaaaaaggccccta

SEQ ID NO: 60201 - DNA, 495 bp, Triticum aestivum
  Clone ID: PAT_TA_60201
gccggccgggctgacgaggacgtcatccccaagggctggaaggccgacacctcctacgaggccaagggcgggtactgaagatgatgatgatgatgccacaccttccggcggccagcttaattaattaactccttctggctcgaaaagaagaataaaccagccggacatatatcatacatacgatatgatgagagcgtgagtatacttattcattcatttactctagggaaagagcgtggacaacttctaatttgaggtccagaacatgtgtggtgcaacaagttctgggtgtaaccttacaaccaaccaataatccatacctactaataaaggacggtgtgtttgtatgaaattttcgtttacccatgcatattttcctccacacatacatacattttttaataataataataatagcgctgttgttattaaaaaaaaaaaaaaaaaaaaaaaaaaaaaaaaaaaaaataaaaaaaaaaaaaaaaaaggccccta

SEQ ID NO: 60202 - DNA, 428 bp, Triticum aestivum
  Clone ID: PAT_TA_60202
gccggccgggctgcgctaatactactagtatactactgtagtgctgtactccttcttcaagtatgtttgttttccttgttgctggcttgccacatacagtagctcctagtgctgttgggacttccatgtggtggtaagctgacggtgatctagctcttgcttgctagcagcagcatgcaacgcaaggctgttttagttcctgatgactagtttaggattggttagtagactactacttagtactttattagtgttgatgattgattggcatggcatggcatggcatgatgtgaagctgtggacgagtgaacaagcgcgtatccgtacttctgttgtttaaaaaaaaaaaaaaaaaaaaaaaaaaaaaaaaaaaaaaaaaaaaaaaaaagaaaaaaaaaaaagaaaaaaaaaaaaaaaaagggccccta

SEQ ID NO: 60203 - DNA, 600 bp, Triticum aestivum
  Clone ID: PAT_TA_60203
gccggccgggctcgggatcagccaccgcagctaccacaaagacaagtcaacctcaccgaggagaaggaaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatccttgaaaaaaaaaaaaaaaaaaaaaaaaaaaaaaaaaaaaaaaaaaagaaaaaaaaaaaaaaaaaaggccccta

SEQ ID NO: 60204 - DNA, 823 bp, Triticum aestivum
  unsure (1)..(823): unsure at all n locations
  Clone ID: PAT_TA_60204
gccggccgggtctgggttcttcagttcatcggtcgtatcatcggcaaggcattgtacgaaggtcgcgttcttgactgctactttagtcgtgctctgtacaagcgaattctaggcaaatctgtctcggttaaggatatggagtccttcgaccccgactattacaagtctctgtgttggatgctggacaacgacatcacagacatcatcaccgagaccttctcagttgaggatgatgagtttggcgttaccaacgtcgtagacctcattcctaacggccgagagatcgcagtcactgaagagaacaaacacgactatgttcggttggtggtcgagcacaagctattgtcttcagtcaaggagcaaatggcgcatttccttcaaggcttccacgacatcatcccagcagaactgatctccatcttcaacgagcaagagctagagctcttgatttccggtctgcctgatattgatattgacgactggaagagcaacactgagtaccataactacactccatcatcgcagcagattcagtggttttggcgagctctgagatccttcgataaggaagaacgtgcgaaaatgctgcaatttgttactggaaccagcaaggttcccctcaacggcttcaaggagcttgagggtatgaacggcgttaaccgattcaatatccatcgcgattatggcaacaaaaaccgactgccctcttcgcacacctgtttcaatcaacttgaccttcctgagtacgagagctacgatcatctgcgctctcaagntatgaaggctatcacggcaggaaagcgatatttcggcttcgcgtaat

SEQ ID NO: 60205 - DNA, 549 bp, Triticum aestivum
  Clone ID: PAT_TA_60205
gccggccgggtcgggcctcatgcatttgtaagtctacctttacaaagctaaaatcagtacgtagtacgccgtacgcctatttatatctagcttttcataacaaagtagtaaccatattcccggcgaatatccccacttcgtcgggattagacgaataaaaaaaaatagttggcggctcgagcgacgaacctggctatgcttcccagattgctgttttcagaagaatggcgagaaatcaaggtgaatcttccctgaacgaggatgattcgcaccaaccttatgaagttctctgggaatggcctaacgcatctataccgtctcactgagtttgggcggtggtaatattacctgactcaccgtccttactaacttgtcagttcgatactccacagagtgtgttgctggatatctaccgcgttgaactaaatagttgcagtagctgctccgaaccatcccttgcgatggctctaatccctgtagaaaactgaatattctgtactgggcaaaatgactattggacttgaaaaaaaaaaaaaaaaagggccctaa

SEQ ID NO: 60206 - DNA, 567 bp, Triticum aestivum
  Clone ID: PAT_TA_60206
gccggccgggttcgggaaccccacccaacaccgagataccccaaaggcccaaagacccgacagattcgcgagagctcgagagagtgcgaccataatggcgatgagatgcgcactgacctccctccccgcgcgcctccggtccccggcggtggtggccagcgggacccggcgtcttctgagtgacgggaaggggcgcgtgctcagcgaggaggagcgcgccaaggagaacgtctacatccagaagatggagagggagaggcgggagaagctcaagaaaaagctcgaacaggagaaggatgcggccgacaaggctaagtccggcgccgacggcaagaaggccgagggaactaactaggagcgatcttcgcctgcctgaaggtgaccccatcttggatgcatctgggggacatttgtgtttatagatgtccaaagatggaagaataaattctgtaaaacgttgatagcactagctttgctttgttttcggtttgccgcgcttgttgaggatataatccagggaccataaacattgataactgagaaaaaaaaaaaaaaaaaaggccccta

SEQ ID NO: 60207 - DNA, 520 bp, Triticum aestivum
  Clone ID: PAT_TA_60207
gccggccgggtcgggaaaactgcgcgcggaagttttgattatagttcattaatcgactactatatagatcgccgccaccacgcgcgaagcagtgattgaggaccatgactgtcgcctcgatgaagggtggcgagacaatgatatgcacgggggaccaccccttcgttggcctgctgcaacatgaccgagtggatgctcgacgacaagggtattctcggctacttgccttccaagaacgctagactcgccgctgccgcagaaatgtgatccacgctagagggcatgctgtctcacgctctctccgatgaggatgtgaagcgggaccactgaactgccggtgtcataaatgttctgatagaagcgcgagatctactccgagagcagagaagaccagctgggccacgaagcgttaccagatgagagcaaacgaaggctcttaccgaattcgatggtccgcagcgtgtccgagtcactaaggacccaggatgcgaagatgctggggtctggccaaggcctgggg

SEQ ID NO: 60208 - DNA, 831 bp, Triticum aestivum
  Clone ID: PAT_TA_60208
gccggccgggtctgaacctcaaggccgcggctgaatccctccctagcttacacctagccgccgccgccgacgaaatccacccaagccgccgagctcgtctcgccgtcgtcgcgctctaggcttttgggatggaggccgagacggcggcgaagagggcgcgggagaacgagggcgctgcggcggcggacggagccggggagcaggcggggatctccgccgtcatccccggatggttctccgagatcagccccatgtggcctaccaggagatgatcacccacctccctctctgctcaattaaagaccccaagaaggtcctggtcatcgggggcggagacggcggcgttctgcgggaggtctcacggcactcctcggtggagcagatcgacatctgcgagatcgacaagatggtggtcgatgtgtcgaagcagttcttccctcacctggccctcgggttcgaggaccctcgcgtgtccctgcacatcggcgacggcgtcgccttcctgaagaatgctccagagggcacctatgatgcagtgatcgtcgattcctccgacccagtaggccctgcccaggagctgttcgagaagccgttcttcgagtccgtctccagggctctgcgtccgggcggggtcgtctgcacccaggcggagagcatatggctgcacatgcacatcatagaggacattgtcaccaactgtcgccaggttttcaaggctcggtgaactacgcatggactacggtgcccacataccccagcggagtgataggtttcatgctctgctccacggagggacctagtggtgattccagcatcccgtcttcagcatcg

SEQ ID NO: 60209 - DNA, 694 bp, Triticum aestivum
  Clone ID: PAT_TA_60209
gccggccgggctgccgactcacctacacttgagttggttcctctgctctcacttgctggatcttccccggagctcaggccaggtctacaatggcaatgatcagccctgccgccgccactgtcgtcaccgccaggccggcgcaagctctagggctccctcagctgagggtgaccagggctgagaagctgaggtgcggctactccaaggacggcaaggaggcagctgcggcgagtccggcggtcgtgaagggcgcgccgctgctggccgcggcgagcgcagcggtgtctgcgacggcggcgtccccggcgctggcgctggtggacgagcggatgtcgacggagggcacggggctgagcctggggctgagcaacaacctgctggggtggatcctgctgggcgtgttcggcctcatctggtccctctacaccgtctactcctccaccctcgacgacgacgacgagtccggcggcccctccctctgaagtcgcaccaccaccaccatcttcttcctcctgcctgccccgcctcatccttgaaagctttgcgtaattaccgtcagcctaagcatggacgaatgctgagttactgattacggtaggtgaactgtaagatgcagtatatgtcagtgttaaaccgttgcagttgttaacttgttgtttggatcttcgaaaaaaaaaaaaaaaaaaggccccta

SEQ ID NO: 60210 - DNA, 590 bp, Triticum aestivum
  Clone ID: PAT_TA_60210
gtgcggcgctcgaggcggcgggttcaaaaagtactctgacctcaagctatcagcctagtgtgatgggcatgggcggtatggtcactcctagccccgatggcttctattatccccaacaagcgtctggcatggtctactatccacagtagaactgggacatgtctgattaccaaacattcacttaccccgatgatttctactcgtattcgatttaatagctacaatcacgacttcaacctacaaaaaacacaaaagcgcctgctacttttaacacaaaagccccacgtgggcaaacacgagggaagaggaggatggaaaatcaccgtttcatgtgaagccattctttggttaggctactcatgcctttcaggaacgggtttaatatgcacttgaattggtcaggtggacgcattcttatctttcataactacggactcgacatcattacttggaacggattgacaggtgggagttgagcggcaaggagtaccctgactggtgttttgatcattggtgggagacggtgttttccttggttacgactatcagagaggagttgacaacaaaaaaaaaaaaaaaaaaggccccta

SEQ ID NO: 60211 - DNA, 272 bp, Triticum aestivum
  Clone ID: PAT_TA_60211
gccggccgggttgggttgagaggtgtaggataagtgggagccctcacgggcgcaagtgaaataccactacttttaatatgaaaactatgccaaaaataatcatctggattgcgttggttcctatctgtagagtgcttgatttatgtggaatttgtgtgggctcagctcagtagagctgaccttgtcagatagtataatccgtgcagggaccttttgttttatttctgtgagcaatgttttccgccgaaaaaaaaaaaaaaaaaaggccccta

SEQ ID NO: 60212 - DNA, 796 bp, Triticum aestivum
  Clone ID: PAT_TA_60212
gccggccgggtcgggattctttgtccatttatcatcttcctttctcatacgacccagcaactgagcgtaaagctgccacttccaataccactatatattttcttttgcaagaggaagtagttatcttactttgatacctctcctctctcactttcaacctggatctttggaagaaaggggtgagagctggctgatcaagcggctgctgatttagaagtgttttatttcatcgaattcgaaaagaggatagaaaactgttcacacaatccttcgacacgccccaaaccaaccagaaaaatatctttcgggtgcggccaactctaaggaccatcttatctagacaacaacataccgactatcatcattcacaatgccgccgcgtaaatccagctcgcgcaaaagcgacacttctaccgcgcgattcgtcccaatggacaatgtgtcaccattgtaaccaagcccggcaccagcatccacacaggttgatgcccctgcaccaacgtcagcacccataagtgctgagaccatccccgctgagggtgatgctgggtcttcacctgtacagaccacagaaaagaaggataaagacaaggaaaaggagaaggataaagagcataaggaacacatcactatcgaggacctaactcttccaaagtctataataacccgattatccaagggcgtactgcctcccaacacacagatccaggccaatgctatcatggaccttagccaaagcaccacagtctttatcaactacctagcctcccacgccaacgaaaacactgtgaacgct

SEQ ID NO: 60213 - DNA, 507 bp, Triticum aestivum
  Clone ID: PAT_TA_60213
cggccgggtcgggaccacaccacagctgatctcagtccacagcacagcagagaagcattcttccattctactcaacgcaaagtccctccctccgatcagatcgagccctagcctcgccgcaacatccatcccatccatggccccctcccaagaagtcgcgccccccgccgccgccaccaccaaggagccatccaccaacggcaacggcacggccgcacccgccccgaagaccaaggccccggcactgaacgagcggatcctgtcctccatcaccgccggtcggtggcggcgcacccgtggcacgacctggagatcgggccggacgcgcccaccatcttcaactgcgtgatcgagatccccaggggagcaaggtcaagtacgagctgggcaagaagacggggctcatcaaggtggaaccgcgtgctctactcctccgtcgtctaaccgcacaactacggtttcatcccgcgcaccctctgcgacggctccgaccccatcgacggcctc

SEQ ID NO: 60214 - DNA, 305 bp, Triticum aestivum
  Clone ID: PAT_TA_60214
gtgcggcgctcgggccggccgggtcgcgcagttggagagctatagcttttgctgcttctaagcaaagtaaaccaaagctttatgttactatcacatggatttggaccctggaaaggttcacttgcgtctgatgatcctgtatgcaccttgatgatttctgatgaatctttcatagcccagactacttgcaagctgaatgctttggtggaaactatatctgttgatcaaacgggtcctgttgaaaatgatttgtgaactctatattgaatgtccgaagccaaaaaaaaaaaaaaaaaaggccccta

SEQ ID NO: 60215 - DNA, 627 bp, Triticum aestivum
  Clone ID: PAT_TA_60215
gccggccgggctgggctcagccgccgaccccgtccagcctctgtcccagttcttcttcttcgtctaggtgctactacttgtcgaggccccgatctcccattcaagttcctccatgtcacgaccacgttgtcacaggaacactagtagcatcggcgtgggaagagcagcggcggccgcccttccccttcacagactggtggtgctagcgctgaatgcccccgaagccccgatctccccctactccacaagcaacccgccacgacggagcaaggaagccgttgcgcaagtagcggcgagggaggacgattccattccatccttcaggtcaatcaaacccgaccaccttcggtgacgtgtctatgcgaaggaagggaaggtagggctgcttcccgcgttggttctgtcggcgatgagggcgggtggctaggatactttagcagcaaggtggaaaagaatccgttgaaagttctaatgtacctttttatccttttctttccaatcaagaactagtacctatgtttgcccttttccctgtaatatatacaaataattctcctcaacaaatgatgtttttggtttttggtacaaaaaaaaaaacaagaaaaaaaaaaaaaaaaaaggccccta

SEQ ID NO: 60216 - DNA, 630 bp, Triticum aestivum
  Clone ID: PAT_TA_60216
gtgcggcgctcgaggcggccgggtcgggatccgactcgcttctcgctcccatcctcttgcaccaccgccttcaaccatcaccgacgagccgacgaccatggacagaaagaagccgatcccgcctgccgcccagcgggccatcgactgtgcgctcgtcactgcctgcttcccgttcgactccttggcgttgcacatacgacgctcccacgttacgacgtcaactgcatgtagtgcgagacgtggttcactgacgcgcaaaaatcgtaggagcctgccctctgcctctcaatgctgtgctactccgggctccaatttgtcgccgagcggatgacgctgctgctcccgcgaagccgtcgttcctgatagataagcacctgccactcttgctatcttcaggtagttcagaaacttcacatactccaggaacagtgtctctgaataacactgatagccaacgtgcggctgtacacctactagttcatgtagcattctgataccgatgtacctatgcttcacctacacgcacacatggacatgacatgtcatggatcacacattcctctgcgcgagtaatgaacgctcatgcacgtcctagcgtagagccatggacacgacctgtaagatcatgga

SEQ ID NO: 60217 - DNA, 326 bp, Triticum aestivum
  Clone ID: PAT_TA_60217
gccggccgggttccggttgacctcggatcaggtaggaatatccgctgaacttaagcatatcaataagcggaggaaaagaaaccaacagggattgccctagtaacggcgagtgaagcggcaacagctcaaatttgaaatctggctttcgggcccgagttgtaatttgtagaggatgattttgatgcggtgccttccgagttccctggaacgggacgccatagagggtgagagccccgtctggttggatgccaaatctctgtaaatctccttcgacgagtaaaaaaaaaaaaaaaaaaaaataaaaaaaaaaaaaaaaaaggccccta

SEQ ID NO: 60218 - DNA, 632 bp, Triticum aestivum
  unsure (1)..(632): unsure at all n locations
  Clone ID: PAT_TA_60218
gccggccgggtctgggggtggtcgccgccaatgtggcgagctcgtcaccatggccgccggcgactcgatgcgcctcgtgtgcatcgatggcgcgggatgcaccccctctccatggccgctcacagccacgggcgcactcgtctccttgtccgcctccgccaggagctggatgtgcgccctctccatggccgccaaagccagggtgtgccagtcgccatggccaagctgcaaccggccacgggggcggcgagttcgtgctggaaccgaggggatttgctagaaccagctgttgtacatgctacaaggtcgatgcctcgccggagtaagctacatccagcggtgaagagtgttgcatccaacgccattcgatgtcgggagctgcaagcgtgcacgtcggggctgcgaccggctactagtggagctgcaagaggggaggccattttttgtggatgtgttctcgttttgccgaaccaattatgctgttgctggaaccgatgtatttttttactggaaccgagataattttttgcttcaacgattgcacagctcttannnnnnaannnaannnnnnannaaaaaaaaaaaaaaaaaaaaaaaaaaaaanggaaaaaaaanaaaaaaaaaggccccta

SEQ ID NO: 60219 - DNA, 788 bp, Triticum aestivum
  unsure (1)..(788): unsure at all n locations
  Clone ID: PAT_TA_60219
gccggccgggttccgcacagcaccaacgaccaccagcgcctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcacgcgcagagcatcctcgccatctgggcctgccaggtggtgctcatgggccgccgtggagggctaccgcgtcgccggcgacccgctcggcgagatcgtggacccgctctaccccggcggcagcttcgaccccctgggcctcgccgaggaccccgaggcgttcgcggagctcaaggtgaaggagnatcagaacggccgcctcgccatgttctccatgttcggcttcttcgtgcaggccatc

SEQ ID NO: 60220 - DNA, 361 bp, Triticum aestivum
  Clone ID: PAT_TA_60220
gccggccgggctccggaagtagctagttgtctccatctctcccgcgtctcgattccccaacccagcacccgagcaaaccctccccaccgcccgcgccatgggcggcgagatgcccggcaccgacgacgagggccactccgcccccgcccccgcctccgcctccggattcccgccgtcggcaccgccgtattatcaacagcagcagcagcagtacgggaccttcgggggcccgtccgcttccggggagatcccgcaggcgggggtcgggtttccccagaccggtccgccgcctgggtttcggaactatccgccgccgccgacgacgagctacgaggaataacctactctgaaggattattcg

SEQ ID NO: 60221 - DNA, 807 bp, Triticum aestivum
  unsure (1)..(807): unsure at all n locations
  Clone ID: PAT_TA_60221
gtgcggcgctcgaggcggccgggttccgttggtggctgggttagtagaaagctgaggactcttgcccagttctcgattcgcgatatggacgccgaatccacagctggtgatatgatggatccttctagagcatcaatggtcagcgtacgaagcggaggcggtgctgctcccggatcttctagtttgaggaatgtcgaacctgcgcctcaaatcttggaggaggaacatgaccagatgactcctcgtcacgaatacgaagcagcccctaccatgatttccgaacttcccgacggccaagagacaccgacagggtttcagcactcgcaatacgaacacccaccacaatcagccggttctcaagcaccagcccagctgaacctttctcaccagcccgatcaaggattcgatatggacttttcacgatatagttcagcagagcccgatcacggccctgtccacagacgtccagtcccaggccaagcccaacaacccgagcctatgcaagggtacggtcaagcgccgccccagatccggctaccaggtgttgatggacgagaggagggagggttctggtcacagcaggaaaagaacgagaagagtgaagaagactggacaactgatgccatgatgcatatgaatctggcaggtgatatgaaaccgccacgatgataatacacaacataagagcgaagtgacgaagcggagtcggagttgggaagcatttagaaacgaataacaaacaattgggacttgtcggtctgatgacctatttacttcattcaaaaaaaaaaaaaaaaaggcccctan

SEQ ID NO: 60222 - DNA, 708 bp, Triticum aestivum
  unsure (1)..(708): unsure at all n locations
  Clone ID: PAT_TA_60222
gccggccgggctgcggtcgtgctcccagcctccaaacgaccactctcccccgctcagctcccaccctcgcctcccatggcgtctctcctcttcctgccgcacacgacccccacggcctccccgcgcgccgcggccaggcccagggccggggccatcacctgcggcccgcgcgacaaccgcggcccgctccagcgcggccgctccctctccaccgaggccatccacgccgtgcagtccctcaagcgcctcaccgccgccgaccgctccccgtcggccgcccgcggcgcggcctccgcgtccctcggccgcctcctccgggccgatttcctcgccgccatggccgagctccagcgccagggccactggtccctcgccctcgccgcgctccacgtggcgcgcgccgagccctggtaccggcccgacccggagctctacgccacgttcgtctcctcctcgccgccctccgaggccgccgccggcgccgtggacgcgctcgtggaggcgttcctcgaggagaaggaggaggggcgcggcgggcggctctcggagttggaggggccgtgggtgggggtggacgtgtacaggctcacgaggctggtgcgcgcgctggtggccaagggcagggcgcgcgcggcgtggccggtgtacgaggcggcggtgaggaggngaggctgcgacgtgaacgagtacatgtaccgggtgatggcg

SEQ ID NO: 60223 - DNA, 642 bp, Triticum aestivum
  Clone ID: PAT_TA_60223
gccggccgggcctgggagttgacgtacgacccccatttgatgcaccctatctcccggcgccgctgtgcgtgggatatcctggacgattccggcggcggaatgagggcgcagggataaaatagtaccatgaggctgctctctaggacttcgcccaaagatgccgagagcgatccaggtcagagcgtctacgccgcagaccaaagcatctctcttacgtaccattggtgttctgaggatcatatcccaggcacgtgtactgtccctagtcgactcactgagcgatgattcgctgagtagtggcatcggggaatactgtcatacacgctcgctgcgcctgcgacatatttaaattggggtaatggctatttctgatgtggggtctcaagatctggcatgttatgcacatagtggcatcatatagggcagggtgacggatatttcatgcagactataatttactgacccccaaaaaaaaaaaaaaaaagggccccataggcgcgcggcgctctctaaatatagtgatatccccgcgctgtgcgagaattcatatatcaagttatatctataccggcacactctcagagggggggccgcggacacacaatctcgcccatatatgagagcgcatatatacgcgcgtct

SEQ ID NO: 60224 - DNA, 557 bp, Triticum aestivum
  Clone ID: PAT_TA_60224
gccggccgggtcgggctgctgaagatgctgccttcaagatgtgcacctagacacatggacctctgagacgagaggaaaagaccaaaggaagatctgttacaattatcgcatcacgccgcttcaccactgctgactgttggataaggaaaaaatggagcgacaagggtgccctgagctgcacataccagatgcaaaacgagtgcaccctccaactggtattacagactccgaaggaggacagtgaagtgcctagactggtgaatagaatatggcagcgactctgcaaactgaatatatttcggtggcctgaaatgggaaaggcactacgtacacgacaggaagtgaacattttgttctagcctgatgtctattatggcatcgtacttatggttgatgacttgcaacaatactgccagcgcaagcaacttatgtcgagtacttcaggctggtaaaacttaggcctttctaacaactcagaaattatcccagcatggagatcatcttataaagaaaaaaaacccctgggaggcgaatgttgctatcaatattctaaagaa

SEQ ID NO: 60225 - DNA, 745 bp, Triticum aestivum
  unsure (1)..(745): unsure at all n locations
  Clone ID: PAT_TA_60225
gccggccgggtcgggaagaccaccctgcgggcagttatcttgatctcgcatgaaaggatgtgtagcacttgcaactgcgggcacgcggcgaccgcttcctcgtaggcggccgccggcgtgggaaccggcaagtctcgcaagacgagcgtggtgagcgcgttgaatccccggagcggcgggggcaagcagttggcaagcttgaggcttcgcagtcgggactcgccgggcttcctgctgatgaggccaagagggaagctgtaggccgacggctccagacgcgtgagcggccctgtcggggtggcaacaacctccagatcccggacgccccgacggcgtccacgaccaggcggttgatgcaggccgaggtgctgtaggcgaagacctcgagcgacagcctctccacgcgccggcgagcttggctggccaggaggctcttgagggagcagaccatggatcgcatggcgcggcgctcgtaccgggcggtgatagcctctagaagcctcctgtcagacaaggtcgagctgattttcgaatccctggcgtcttcgcggaggcggaagcaccggtggtagcggngcggcagtatgtcgctgaccttgaggtccaggacggggacctcgcggggcaggctggcccagcgcctggagagcgccgcggcgccgagcgcggtgcgggtgtcaaggcggcgcaggatgtcaaggagcagatcgtcgggggaggtcaccgaagcggtccctcgtccgcg

SEQ ID NO: 60226 - DNA, 768 bp, Triticum aestivum
  unsure (1)..(768): unsure at all n locations
  Clone ID: PAT_TA_60226
gccggccgggttccgagagaacgatgtgactttaaccaaaatattgggacaccatgtactacaacaacctcctcaccatccccgtgctcgtcttcttctcgctcgtcactgaggactggtccagcgccaacttggccaagaacttccccgaggatagtcgcaaccgcatgatgatcggtatcatctactctggtcttgctgctatctttatctcttactgctctgcttggtgcatccgagtcacctcttccaccacctactccatggtcggtgccctcaacaagctgcctattgctgtctccggtcttatcttcttcgccgcccccgtcaccttcggatctgtttcagctatctttattggtttcgtctccggtatagtttatgcttgggccaaggtcaaggagaacgaggctaagaagaacgctcttcccactgccgagaaccgagattcgtcaaagtaaactcgatatcgaagcgaatcgcaccggtcggctgaagttacttcaagcgcacgccaaaagctacttagctattctgccacaattctggccaatctttcctcctagcctggttataccagcaaacgacaattatgtacctatccatggtaattgaatgacaaacgtaatgtagacattttttgtataacgtctggagcaatagctcaaatattgatggggttttgggtgtcatttaaaagcgtttatagacctgattcaatacaaagtctcttaatcnttaagaaaaaaaaaaaaaaaaaggccccta

SEQ ID NO: 60227 - DNA, 289 bp, Triticum aestivum
  Clone ID: PAT_TA_60227
gccggccgggtctggaaattctgcgggcagctgatagctgagcgcaccttgcccaacatcgcatgatttaagtccactagcttgtgcatatcagaaaattcatgaatgcccgcagatacctgtaggcatgtacaatcgttatcagtaaattctgccgtcctagactccatcacatgtcttgtttcctagcttcctggagtatgcaatgtgtgattgaaccaagctgcacgatgaaaatatactcactggtgctttgtgattgcaaaaaaaaaaaaaaaaaaggccccta

SEQ ID NO: 60228 - DNA, 506 bp, Triticum aestivum
  unsure (1)..(506): unsure at all n locations
  Clone ID: PAT_TA_60228
ggccggttcgtgccccttctccgccgcctctccccgatccagatccaacccaagcgcccgtcctccgccgccgcagccccgacgtcacggcctgctcctcgtggtggtcgcgccggtgctccgcgccgcgcagagccccatctcgcagccgtcgtcggccggcgcgcccaccgcgtccccgctcctccgccccgacgtggactctcgcaaccctctctccaaccctaaccctctccctccctcagatctcaatacgccgccgcccctatccctacccccgcgtagcccaatccaatccgccgccgtcctctacccagatccctccccgctccggtgagcccgccatgaaccgtctgggggagggagngtagngggagcagcacgggtttcacctccccgggccatgtctcccccttccaccatcgctcctcctccacctccttcacggcctccctcccgggcaccggccgagaagncttgaaagggaagacntggatncggacccg

SEQ ID NO: 60229 - DNA, 640 bp, Triticum aestivum
  Clone ID: PAT_TA_60229
gccggccgggttccggaacgcctttatcatcagctccgatttctgccactggggttctggcttcagctacctcccttactcacccaccaatagtccttctgatttgacgcaactaaagaagagagaccctaagcccgacggcccaccgatccatgagacgatcagagtcatcgatcaagctgccatggatgctgtcgagactggcagtcatgatgcattcatcagtactcttaagcagacacggaatacggtgtgtggacgacatcccattggtgtcacgatggcagcactggagctgctccaaaaggaagctggatttgaagaaaaaggtcgcttcagcatcattcaatacaatcggagcaacatggttgaagaacccaatggcatgagcgtaagctacgtgtccgcgtatgctgtactctgagggatgtttagcaggactgcaggagtgttattgctggttttaagagggcggaaggcttgttgggattgagcgatcacttggagtttggctgggtatagaagcggcatcgagttatgagatagcgtttgaggttgaagaggagtcatcaagggcagagtatttgcccagttcagttcaagtcgttagacaatacgagaaccccatattattaaccgc

SEQ ID NO: 60230 - DNA, 178 bp, Triticum aestivum
  Clone ID: PAT_TA_60230
tgcggcgctcgagccggccgggttgcgttcgaaacatgtttgaaccatcgcatgcgtgattactttgcagagtccgtgtatcccgagcatctttccaggagacgatccggagcaaagaaatcgtagttaaaatgaggtccatatgagagaggaaaaaaaaaaaaaaaaaaggccccta

SEQ ID NO: 60231 - DNA, 228 bp, Triticum aestivum
  Clone ID: PAT_TA_60231
ctgtgcggcgctcgaggcggccgggtcgggatagagcgccgcccccgccccgccagattccgttccgccgccgccgccggaagccgaggacgggagggagaccatgacgaccattcgccggttctgctgcgacgatctgctccgcttcgcctccgtcaacctcgaccacctcaccgagaccttcaacatgtccttctacatgacgtacctggctcgctgggccgacta

SEQ ID NO: 60232 - DNA, 696 bp, Triticum aestivum
  Clone ID: PAT_TA_60232
gccggccgggctctggacacctcagcatccgcagccccccagcccacaccttcgcacaaagctccacctcctccccacaccttcgcacaaagctccacctcctccccacaccgtcgaagcacccatggcgcctaaggcggagaagaagccggcgctggagaagaccccggcggggaagaagcccgcggcggagaagagacccgcggccgggaagacggcgtccaaggagggcggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcaagggagatccagacctccgtccgccttgtcctccccggcgagctcgccaagcacgccgtctccgagggcaccaaggccgtcaccaagttcacctcctcctaggcgtcttcctcgtttcatgagctgatggcggcgttctgtgtgtagttagcagtgcgatgttacaatctctgtaagaattgtgctgcttggtggtttgaagaattagtggtgttgctgtctgaaaaaaaaaaaaaaaaagcccctagggccgc

SEQ ID NO: 60233 - DNA, 779 bp, Triticum aestivum
  unsure (1)..(779): unsure at all n locations
  Clone ID: PAT_TA_60233
gccggccgggtcgggaacctatccactcctcccactctcagtcacatctcgaatcctcgagagtttcgaccggcgcccctcgccgccgggcatggaggccaccccccgcaagctcgttttcttatccggtgacgcacgggcggtggaggtgtcgccacgcgcgccgcggcctcgctcggaggtggaggagcgagtagagagggcgcgctcggtgggcggcatggcgaggcagaaggtggagagggagtgggcggccatgcctcggcggagcagagtgggatgaggcggagcaggaagcctcgatggtgtgcgacgtcgggagggaggcgagataggcggagagcacgggggagacgaggtcgtggcggttcacggcatcgtgggtcaccggcagcacacggtggcaggaggtgaagaagatgaggtcatggcagccagggcggcgagagttgcggagccgaggaagggaggttgcggaaggcccgcgaggaagacggaggcgacctcgcggaggggaaggggagcagcgggcggacgaacgcggaggcggagctcaacatgccgcctggcttccgcttccacctcacgaacgacgagctcgtcgtgcactacctctgcagggaggtggcggcccagccgcagccgtgcccctcatcgccgagctcgctctgtacaagttcaacccctgggtctgcctggtgcgtcttcttcctctttcctgctgctcgctaccatggtttccctcctnnctgctcgtcactcattggtttcgtctgatt

SEQ ID NO: 60234 - DNA, 795 bp, Triticum aestivum
  Clone ID: PAT_TA_60234
gccggccgggctgggccctcttctattcccctcccctctcctcttctcttcggcggcggattgagacagacagagtcgagaccgagcgagctagggtttgtcgcggcggcggaaggaaggaagtcgggaagtcgggagggaagatgagccgcagcctggggatcccggtgaagctgctgcacgaggcggcggggcacgtggtgacggtggagctcaagaccggcgaggtctaccggggctccatgatcgagtgcgaggacaactggaactgccagatcgagaacatcaccttcaccgcaaaggacggcaaggtgtcgcagctggagcacgtcttcatcaggggcagcagggtccgcttcatgatcatccccgacatgctcaagaacgcacccatgttcaagcgcctcgaggccaggataaggggcaaggggtcggccatcggcgtcgggcgcggccgtgccgtcgccatgcgtgcccgggctgctggtggtcgtggtggcggccccccagttggaggtggacgaggtggcgcgcctccggtgaggaggtagatgatgtgagctgagccgctgtctggtcgaggaaggaactcgatgctgtctttactggcgaaacaaaatgcttgcgagcttatgatgtgcctctagtttagttttgtcggtttgtgcgaaccgattttctctatgtatgatgatgatgatgtattgctgttgttagctgtaaacatgggtttgactttgatgcctcgttttgagctgccgttggaatggattatcgtctcttgtgaagcttact

SEQ ID NO: 60235 - DNA, 819 bp, Triticum aestivum
  Clone ID: PAT_TA_60235
gccggccgggccgggctctcctgcgccaacggtcccgactttttggcatctcgagttgggacaataaagtccgtatttacgaaattgccaccaacggtcaaagccaaggccgacacgcatatgagcacagtcaacccgtgttgagctgcgacttctccaaggatggaacaaagatcgtctctgcaggcgccgacaagaacatcaaggtctgcgatctcgcctcccagcaggacattgttgtgggcacacacgaccagcctgtgcgaacagcccgattcttcgacagcggcaacggccccatggtcgtctcaggatcatgggacaagacggtgaaatactgggatctccgacagcaagggcccgccgccacagtagcttgtcaagaacgagtctatactatggacgttcgcgacaatctgtgtgtagtcggtacagccgatcgctacatcaacgtcatcgacctcaagaaccctaccaaattctacaagactctgcagagccctctgaagtggcagactcgggttgtcagctgctttaccgactctgctggattcgccatcggcagtatcgagggacgttgcgctatccaatacgtcgaggccaaggactcaagcgccaactttctctttcaagtgccaccgtgaccctccagccaacggtgtcaccaatgtccacgccgtcaacgacatttcatttcaccccgtccacggcacattcagcactgccggctccgatggaacattccacttctgggacaaggatgccaagcatcgtctcaagggtaccccaacgtcggaggcagcatcaactctactactt

SEQ ID NO: 60236 - DNA, 464 bp, Triticum aestivum
  Clone ID: PAT_TA_60236
gccggcccgggtcggcaccaagaacgcccccgcggcgcttggcccctactctcaagccatcaagaccccccacatgatctactgctctggtcagatccctctcacccctgagggcgagcttgttcagggcatcactgagcagacccgtcaagcttgcaagaacgtccaggctgtcgtcgaggaggccggttcatccctctccaaggtcgtcaagaccactgtcttcatttctgacatgtcctactttgctgagatcaacacagagtacgagaagtggttctctcacaagccagcccgtagctgtgtcgctgtcaagactctccccaagaacgtcgatgtcgaggttgaggttattgctcttccttaaatgtctggaatgaacaaacgaaatgaatggtgatcatatagcactcaataaaagaagttatttcgatcagcaaaaaaaaaaaaaaaaaaggccccta

SEQ ID NO: 60237 - DNA, 424 bp, Triticum aestivum
  unsure (1)..(424): unsure at all n locations
  Clone ID: PAT_TA_60237
gccggccgggtcgggctagcctccggatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgacattgaaatctttaatggaaagaagnttgaggatatcgttcctttatcccaaactgtgaagttccccatggtgaacgncaagattataagatgattgaaataaatgatgatggatatgaaagacttata

SEQ ID NO: 60238 - DNA, 546 bp, Triticum aestivum
  Clone ID: PAT_TA_60238
gccggccgggtcgggaaagccctcgtcccccgaagccagatttcttctccagccttcatcgcacgagaggcggcatccatggcggcggcgggcccagccaagacggaggtgctgtccctcttccgcgccttcctccgcacggcgaggcagttctccgactacaacatccgcgagtacacgcggcgccgcgcggcggacgccttccgcgagaaccgcgccctcgccgacgcgccggccgcggcggcggccttcgcggacgggaagcagcagctggaggtggccaagaggcaggtgctggtctactctctgtacgcgcccaaggccaagagcgttgtggagatgaagattcagtgagcgacaccagagagaggtttcacgcactcctttttcccctttagggtctgtgctcttttatgtactgttagtagggttatggcgatctgacgctgatagaaattctgccgttactatgtttgctggataattgccatgatacggtggttgctattgttcaataagttcgcaaattaatgatcatgatacttt

SEQ ID NO: 60239 - DNA, 702 bp, Triticum aestivum
  Clone ID: PAT_TA_60239
gccggccgggctgggaatttcgctcgcctgtgcagcccccctccccccttcgctcgctgccgttcttctctcccctccacccgccgccgccgccgccgctgccgtattctctgccccatccgatggcttctgctaggtttggtgctgtccagcagatggaagaccgtggagcgttcgggaccaagaggtcgcgcaatgacgagaatgatgccagcgcctgctggtggtggatatgatcgatcacctctattttacggtagcactggtgcccccccgcctcacattcctcttggatcagctagctatggtgctccatatccgcatgttggaatgcggtatggttatggtccaccagttggacctcatggctcatatggtctcatttcttcttatggccaacctggtccaatgggggggatgggttatgcccacggacctgagttgggtcgatatggacctgagttgggtcgatacggctatggatttagaggatctccaatgccggtttctagcccatggcctgatggagcattagtggaaaataatgacagcactgcttcacgaaagcggcgtggaggcccagatggactgtctgagggtgactgggaatgccccaagtgtggtaattgtaattttggcttcagaatcaatcaaataaaacatttgtcctaaaaaaaaaaaaaaaaaggcccctagggccgc

SEQ ID NO: 60240 - DNA, 292 bp, Triticum aestivum
  Clone ID: PAT_TA_60240
gccggccgggttgggttaggtgacacagagcattctcacgccaactccgtccgtccgcgccatcaacccaccaaaagcagagcacccctcagccggcgaaaagggagcgatggccaaatgcggcaagatccagagcatcgtccgcctccagcagactctgcggcggtggcggtcccgggccgcggcggcgccgacggctccggtgccggcggggcacgtggcagtgtgcgtgggcggcgcatcgcagcggctcgtggtgcgcgcgtcgctcctcttcccccccgcgttccgg

SEQ ID NO: 60241 - DNA, 751 bp, Triticum aestivum
  Clone ID: PAT_TA_60241
gccggccgggtttgggtacgccatgatcttcttcgaaccactaccatcagctacgccctcgcctacaccctgcccatccttctcgtcggcaacatgggcttcagcgtcggagctgctcagtgtctcgttgctcctccttacgcctttgccggtatcgtcatgttcgcgacagcttgggtcggtgacaagtaccacgtccgaggcccctgcattctcttcaacatgctgctttgcctcatcggacttcccattatgggctgggccgagagccccaatgttcgatactttggtgtcttcctcgtcactgccggcgccaacagcaacatccctactgccatgtctttccaggccaacaacatccgtggtcagtggaagcgagctttctgcagcgccactcttgtcggattcggtggattcggcggtatcgctggtagctaggtgttccgtgagcaggacaagctgacgggatacaagcctggcatgtgggcctgcattgcctgctgtctcgtcactgtctgtcttgtcatctgctgtgacttggacttcaagagaaacaatgccaaggctgacaggggtgagaagattttggaggctcatgatgacgatgccactgctgatttccgatacacttactaagatggacgagttcatgtcgattgctagcgtacgatttctatgttgttcgaggtggccatgtccaagtagtccaataacatctattgttcaaaaaaaaaaaaaaaaaaggccccta

SEQ ID NO: 60242 - DNA, 322 bp, Triticum aestivum
  Clone ID: PAT_TA_60242
gtgcggcgctcgaggcggccgggttcataaagaccatattcaaccttgtgagtgttgtggtggatcacatccccgtaccttgagtgagttgaatttgaggattcagttttatttactggctcaagagtctgaatatttgagtattctcgggtcttctgaggttgtacctgaattgagttaatggtaagcaattagtgttgttgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 60243 - DNA, 342 bp, Triticum aestivum
  Clone ID: PAT_TA_60243
ctgtgcggcgctcgaggcggccgggttccgcggcgtgggagttcccgtcggagatctacttcatccggctggagccggagggggtgatgtgcctggccgtcctgggcacgccgcgctccggcatgtccatcatcggcaactaccagcagcagaatttccacgtcttgtacgacctggagcacaaccggctcggcttcgcgccgcgccggtgcgccgacgtctaattagtccggcctccgtgcgtccattttgacttgctgattgggttgattgtttgaccggtaggagtatgtaggcggctctgctgactggatggaaaaaaaaaaaaaaaaaaggccccta

SEQ ID NO: 60244 - DNA, 722 bp, Triticum aestivum
  Clone ID: PAT_TA_60244
gccggccgggtccggacacggttcactgccataatggcttccgaggactctgccgcgcccgtcgtcgtggacgactgccggggcgtgctgttggtgtacagcgacagggccgtggtgcgcagggatgggccgggcttcgccacgccggtgcgggacgacggcaccgtggagtggaaggacgccgagttcgacgcgccccgcgggctgggactccggctctacaggccgcgccagcggaaccagctcctaccggtcttcttctactaccacggcggcggcttctgcatcggctcgcgcacctggcccaactgccagaactactgcctccgcctcgccgccgagctcggcgccgtcgtggtcgccccggactaccgcctcgcccccgagaaccgcctccccgcggccatcgacgacggcgccgccgccctcctctggcttgcttcgcaggccggccccgccggcgacacatggctgaccgaggccgccgactttactcgggtgtttatctccggtgactccgcgggaggcaccatcgcccacaacctggccgtgcgtttcggctccgcggccgggcgctctgagctgggcaacgtccgcgtcaggggctacgtccaactcatgcccttcttcggcggcacagaacggacgaggtccgaggcggagtgccccgacgacgccgttcctcaaccgcccgctcaacgaccgctactggcgcctctcgc

SEQ ID NO: 60245 - DNA, 426 bp, Triticum aestivum
  Clone ID: PAT_TA_60245
gccggccgggccttcgattctcactgtgatcccctgagatgccttgtgtatttgctttatcctctacttctgataatgcaagacagatcaaaccaacgcagcaagacgaaactgaaatggggatctcggacaagtgcaaggagggaagctgtcgtaagatagataataaacttgcctccgctctgacaagagcatgttcgttcagaccttttcttactaaaagctatttatctatagcaagtatttccattagaactatcaaattcaaactcctagatgtctatgtcagcatgtagaactttgtccaggcaaagatatcccctctgatctttttgtgaatccttccacacttctttgtaaagtgttactgattttaataaaatctctctattaaaaagacaaaaaaaaaaaaaaaaaaggccccta

SEQ ID NO: 60246 - DNA, 631 bp, Triticum aestivum
  Clone ID: PAT_TA_60246
gccggccggtttccgacggtggcggcggcggcggcggctgctacagtgcggggagcaaggccacatcgccagggactgcccccagggcggcggtggcggcggcggctacggcggtggtggctacggaggtggtggcggcggcggccgtgagtgctacaagtgcggcgaggagggccacatctccagggactgcccccagggcggcggcggcggcggctacggaggcggtggcggccgtggcggtggcggcggcggtggcggctgcttctcctgcggcgagtccggccacttctcccgcgagtgccccaacaaggcccactaggcggcacagctcttcagatctgagtgccccgtttacccttgctcctttacctacctcctgattctgcagcaagtcataccctatacctatcagtactagtattagtcgccgtagcgtttccccctgctgctcgatgcgagcttggttccagaagaattgctggtggtgtgttcgttaagatccaagttattttgctgtctctctgtgatgaggatacagatctatctatgtgttggatggactaagttatcgaagtcaagtttggtgtcaaaaaaaaaaaaagaaaaaaaaaaaaaaaaaaggccccta

SEQ ID NO: 60247 - DNA, 555 bp, Triticum aestivum
  Clone ID: PAT_TA_60247
ctgtgcggcgctcgaggcggccggttgggattcttgatcccctcactctgccgtcacttcttcctcgtctttcccgctgctgttctcgcggccggaccatctatttcccgcacgtgaacgaaaagggttgatgcgcccgccgtctattctgcctccgtcggtcccgaagcggatcgctagaacaatacgatgagcttctacgctttctacgcggatatccagttcaccttcgtgatgatacaccccgacagctacttctcgctgatcgccgactagttccacttcaaggatatcgagccctgcgtcctttcccactcgctcaggtataatcaaactactgagacgagacggatatcgatcttctgctggagaacattactcatcagcgatgtcgtcgatcctttccagccatacggatcttcatcacggcgtctgaacactgcgctctaccttatatgtgggcagaacctgcatatatgccgctcgacagtggcgttgatgctacattccttcattctatgtgcagcgatgcacactgagacatcttcagagata

SEQ ID NO: 60248 - DNA, 619 bp, Triticum aestivum
  Clone ID: PAT_TA_60248
gccggccgggccggggggcaagactcgtctcgccaaatggtacgcccctttcagcgatgagcaaaagatcaagctcaagggcgaagtccaccgcctcgttgcgccccgcgatcaaaaataccagtccaactttgtcgagttccgtaacaacaagatcgtctatcgtcgctatgccggtctcttcttctgcgcctgcgtcgacacaaacgataacgaactcgcattcctcgaggccattcacttcttcgtcgaggtcctcgatgcctttttcggaaacgtctgcgagcttgaccttgtcttcaacttctacaaggtctatgctatcctcgacgaggtgttcctggcaggcgagatcgaagagacgagtaagcaggttgtgctcacgcggttggagcatctcgacaaattagaataagctgcgcacataatgatcgagggtatggagaaatacgggaatgcccaaggcttctccgcagtattcctttatgccaaagctatactttgtattttgcatatcatatggaggcaggttggagttcgggcgtttagtggaggcatccaccgtatcaagaataccattggctgttatttctaaaaaaaaaaaaaaaaaaggccccta

SEQ ID NO: 60249 - DNA, 477 bp, Triticum aestivum
  Clone ID: PAT_TA_60249
atgacataacacaacaagcatacacatcgtcagcattttaaccaccacaggaagatgaacatacattaggagagacggaagccttgaacgccgatgacaaggcgtttcagaccattctttcctacatccatcagataataagcaagaaggcgctccctgcccatgccctacggactccaggaaccactatcaatgctgccgattcatgctgcaacagcaagaaaggtcgctgatcaaactatcggtaaactgagaagtggcgatagaagatctctaactcatcccctggaaaattatagacctaaaatttacaggagtatacggcggattatcctttatcggaaatatggactcatctaaagtactccctccgtgtccaaatatctgtctttccaaacaaattaaatggattaaaacataccggtggataaggtcctaataaacaaaaaaaaaaaagtccctaaggacttgtgcgct

SEQ ID NO: 60250 - DNA, 752 bp, Triticum aestivum
  Clone ID: PAT_TA_60250
gccggccgggctgggaaaaaaaaaacgcatcccaagcctccccgctccatcgccacacgctcgaacccactcctctcacgctcgagtgcacaccgcaccacaccaaccagagcagccatggctctcgccggcggcgccgccaccgcagcgtgcatcctcgtcctcctcgcgctcgccgacgccgcgggggcggctaacccgtcgccggcgcccgcgccggcgccggactgcacggaggcgttgattggcctcgcggactgcctcgactatgtggtgcccggcagcaagtcggctcggcctcccaaggcctgctgcacggaggtgaagaccgccgtcggcacccccgccaccgtgaagtgcctctgcgctgccctggacgccaagacaactccgataccgatcaacatgacacgggtgctcgccctccccaccgcctgcggccagtccgcctccgtcttgagcaagtgccacgctgcggcgcctgctgaaggacaagaagctggatgaacaagtgctgcatctggaagcaactgttgtgtgccatcaagatagcaacgttgatatagttcttaatggcaatccttgttgagtgatgattagcatagtccttcagacttagcattgcccgtcatgtaccaaagctgatgcaactttcgctaggaattcttgttgatcctgtcatgttattgataacctgataggaatgtcttctcgtgttttgcctggggagtccagtttgacatgtactcaaa

SEQ ID NO: 60251 - DNA, 316 bp, Triticum aestivum
  Clone ID: PAT_TA_60251
gccggccgggctgcgagtgaaccttcctagcgggcgggcgggcgggcgggcatgtcatgtgcctggcctgcttccaacttcaaagagctctctctttagaccaggtaaggttggttcatggccttgtggtttgatcgtggcaacttgcatgcatggtaactcggtttgttcgtccgtctgtccgcgagaccatgccttttacttcatgattttttagattcttcttcttaatattcttgtaatcacgccgatgctactactctataattgagggggttacctttgattccaaaaaaaaaaaaaaaaaaggccccta

SEQ ID NO: 60252 - DNA, 378 bp, Triticum aestivum
  unsure (1)..(378): unsure at all n locations
  Clone ID: PAT_TA_60252
gccggccgggttcggaaaaaaaaaaaatatctcatctcacccaccgccgcagcaacacacacacagagaagccaatctcgccggagagggaagcgtcgacgatgtcgggccgtggtaagggagggaaggggttcggnaagggcggcgccaagggccgccggaaggggctccgggacaacatccagggcataaccaagccggagatccgccgtctggctctcagggggggggtgaagcgcatctcgggggtcatctacgaggagacccggggcggggtcaagatcttcctccgagagagtcatccgcgaccccgtgccctacaccgagcaccgccgccgcaaagaacggccccccatgggcgggggctacgccctccag

SEQ ID NO: 60253 - DNA, 841 bp, Triticum aestivum
  unsure (1)..(841): unsure at all n locations
  Clone ID: PAT_TA_60253
gccggccgggtcggggtacacctaccaataccaagaaacagagcgcaacacagacacagaagaatggctatggggcgggagaggcgcatcaagcttctcatggcagttgtcctgctcctcaccttggcgaaagggagcagctgcaacaagacatgcaccgtggcggacctggagatacggcatatccgggtcgacagctacaagcaggacggcggccgcacgcacgagcaagagcaggagcacatgaactccggcggcggcggcggcgggcgcaagctgaagcagctgccgatggtcatggcggcgtgggtgtacaaccactgcccgtgcatggtggacaacgtggtgacctacgcgcccgacggcttctccaccatctacgccaacgggaccgacgaggggatcttctccaaggtgacggagcacctctacctcatccaccacgccggcccgctcctgccggcggcgagctgcccccgttttcccccctcgccgcccgagaacacatctgcctctgccgccgtcccggtcgatgggaaggcgcaaactgaagatttcagctgcccgtcgaccgctttcttctacacctggtacgatgagatcgagctcaagcctgccttcctcgtgcctcactgctagagtgctagctactgtacaagaaattccatgtcgatccactgggatttccgtccgtatgatgataaaataagttgttggtgaactagtgtactccgtgtgcgtggtttagctgtagaatctactcttcgantctcacggatgtgtatcctctcagggatcggatctggtatggttgcagaaattaaatcatcagtatttgcag

SEQ ID NO: 60254 - DNA, 659 bp, Triticum aestivum
  unsure (1)..(659): unsure at all n locations
  Clone ID: PAT_TA_60254
gccggccgggtctggggttcgtgcgctagacacgaggcgaacactagctagctactccctccgttccaagatcacaactcacaagtagagatcgaccgggcttgaccttgagcgcgatggacgcggcggcgcaggcggggaggaggaggccgtcggaggtgagggcggaggggctgatgcggggcgcgtgcgccgccctggcgacggcgtcggcgctgctgatggggctggacacgcagacggagaccgtgctgctcatcaggaagaaggccaccgtcaaggacgtccacgctctctgggtgctgacggcggcggccggcgcggcggcggggtaccacctgctgcacctgctccggtgcctctacctcggccgcttcgcccacaacccctgccgcaacagcaaggccctggcgtgggctttcctcctcctcgacaaggggtgcgcgtacgtgacgttcgcggcgacggtggcggcggcgcaggcgtgcctgatcgcgctggacggcgcgcaggcgctgcagtggaacaaggtctgcaacatcttcacccgcttctgccagcaggtcgccgggagcctcgtctgcggcggnctcgccgccgccggtaccgccgtcctcttcgcgcttctcgccctcaacctcttccgcctttccccttgt

SEQ ID NO: 60255 - DNA, 656 bp, Triticum aestivum
  Clone ID: PAT_TA_60255
gccggccgggtcgggaaccaactatgcctatcacaagccacaaatgcgaggcactctgtgcagatcgactccacatcgagaatggctgccgcgaatgaccaagataagggcgccaaggagggtgcgcgcataccatgcatctcgccggagctggtgaggacgcacgtgtggaaagtggaacgcaccaagttcggccgcagctttggtgatgtcctgcccaatctgtgcaactacagcatcatcgtccaattcgacttgagattcctctgccgcacaaagctctgcagcagcaactgcaactgaaccacgatcttggaacacagcgacatcatggtacattctagtatgctctaccaggtccgcatggccacagcgatattggtcgtcctactgcgaataaccgaaagccgcacagagagcatggatgaagtgcatgctagcgccctgacttagccgctaatacggtacgcaattgggtactatcttccatctgacggcctagtagatactactacggctcgcacttctaagctgtatagcgtaccaacaggattcttacattcaacacactgcggttgtgatagtgcaaactcctactcaccgaactcatcgccatcagtgctgctgtcgctctataaataatgaatcctcgacag

SEQ ID NO: 60256 - DNA, 596 bp, Triticum aestivum
  Clone ID: PAT_TA_60256
gccggccgggttttccattcaattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaaatgatttaccgaaaaaaaaaaaaaaaaaaaaggcccta

SEQ ID NO: 60257 - DNA, 719 bp, Triticum aestivum
  unsure (1)..(719): unsure at all n locations
  Clone ID: PAT_TA_60257
gccggccgggctgcgattgtcaaacgtaccatgatcgacatggttcccaaggccgttatgctgaaccttgtgcaatttaccaaggatgagatgcagcgagagctactggagaacatgtaccgaactgacacattagacgatcttctcaaggagagtgatttcaccatccgaagaagaaaggagtgccagcagatggttgagtccctcggcaaagccagtgagattgtcagccaagtgcagtgatgtcgttcatgaacgaggcttcttatcatcacgtcccaattcagcgtcagagtcatgctgggcccatctgcaacctcttgtttctccgcgagacaaccgctcaatgggatcaccacatagcagctgtctcatgtcaccacatcccgcgcatcactatattttttttcgataccactacttttcagaaggagacccagagtagactgcttaatgacttgcattcgatatgcatgattcggtgcgtgcacatgacaaataacgtgtggaggcgcggcgtcttttgggatgttaagaaagcggggagtatttggagggttcgtgctggccggatagctgggcctttcctggcttcatcctcgatgttgtgttttcttacgagcgccctccgaggtgcttgaaagattgtgcaagcacgggcttgtaggtagaatatataatcagtcacccattaaaaaaaanaaaaaaaaaggccccta

SEQ ID NO: 60258 - DNA, 477 bp, Triticum aestivum
  Clone ID: PAT_TA_60258
gccggccgggtttccaaatgttgagacgaggccaccgtggttggtgtttgttcttcgatcagaacagcagtcgccggcttttgaggctgttgtttttgcctatcatcattcccttatggatgggatgagtggtcgattgttccatgagaaattccatgcaaagctgaactcactgcctcctgatccatcggcaccaggcgttctgtctttccccgagtgtccggagctgcctggaccacaagacgatgtcatcgactatacgaccacttttgctcagagattctcgagccttttgaattggatgcgaccttcgtttcttacacctactcacgaaatttggtctgccgagcccatcgagttcaatcgccctcacaagactcggatggatacaggggatattcctccccgctgcaaagctgagtgttctccaggcgactcgttcctatagaacatcttttacaggcctgctacaatgct

SEQ ID NO: 60259 - DNA, 613 bp, Triticum aestivum
  Clone ID: PAT_TA_60259
gccggccgggttctgacacacacacacacacacacacacacaagaagaaaaagaagaaggaggaccttctcatggagcactcgtacagcaacagcggcatcagcaactacggcggcgcaaaggagaagaggcctccactgaagagggggcagctgaagcggcagatcgtcaggaccatcagcaacctcgtgctgccgaggagcgacggcatggccgcggagaagcgagcatcgggtcgcaccagcctcggcacctacaactgaacctctccaaaccacatccgtcgtcagtcagtcaaggctctagaccgggtacaagaagaatgcttctagctactgtacatgttactgtgttaacttccccctttccttcaggccttccttggtttccaactagcttaaagaccgcttaatactaggatttttgagtgttgttttgggtcgtgcaagaaggaatagagaaggtatggaaatttttcctaaaaaccaaaaacacaaaaacccaacaaaaacaaaacacccacacaacaacacaacaaaccccacaacaaccacccaacaagcatcaaataaaggggaccgaaaaaaaaaaaaaaaaaaaggccccaaaggcc

SEQ ID NO: 60260 - DNA, 317 bp, Triticum aestivum
  Clone ID: PAT_TA_60260
gccggccgggccgggagaatttctctctttggatttgcagaatcctggttctagtatgtgaggtttgatgtgcttctctagattttgcgcgctggttctctatggatgcttagcctttgatgcaagagcttttggactccaattcggcttagatgttcttgagctgcttagctcagttaacgctgtcggctttatttgtcacacgagaacagtttgctgaaaaaaaaaaaaaaaaaaaaaaaaaaaaaaaaaaaaaaaaaaaaaaaaaaaaaaaaaaaaaaaaaaaaaagaaaaaaaaaaaaaaaaaaaggccccta

SEQ ID NO: 60261 - DNA, 627 bp, Triticum aestivum
  unsure (1)..(627): unsure at all n locations
  Clone ID: PAT_TA_60261
tgcggcgctcgagccggccgggctgggaccaaattcgaagcatttccatccaccgccgccgcccgccgcattccgagaggttcgagctcgccggagagggaggagagatggccaggaagggcggagagaggaagaaagcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggtgtgatccccaacatcaaccccgtgctgttccccaaaaaggncctcnagaaggtcgaaaaggagtcccagtctcccaagtcgcccaagaggaaggcccccgcccccgtaccctctctcaataataaccccaataagaaagaagccgacaaaaaaacccccccttgacaagaaaattgccgccgctgtaaaaaaatactcccactaaatacaa

SEQ ID NO: 60262 - DNA, 480 bp, Triticum aestivum
  Clone ID: PAT_TA_60262
gccggccgggtctggaactcgcataccagcctcctcattcctcctgcatcctctcagtccttaccttccttccctcgaaccctcccccacccaaggaatgtgtattgatgagaagactactcgtaacgcggcgccatctgccactgcgactactggtaagtgcgccagtaccatgtctccccgatctaccagggcaccggcgatccacacgccatgcatctgcccaccgcctcccacaaccgccgatctcgcgaaggctacctgcacgtacgccagaccgcttgatgcgattgcaccccctggagatgcggcacccaccgttgatgtcccccgctgaaatgtcaatgctcctcgctactatatcaccgtcgttgaagctcaccaccaccatgatgacgtcaagaacagtgatcattgtcacctccatacaccacactgcgtcattctactactagccgccgcaagtgctcacgtccacgc

SEQ ID NO: 60263 - DNA, 825 bp, Triticum aestivum
  Clone ID: PAT_TA_60263
gccggccgggttgggaattggttgatcaatcatgaagttcttcaatgccttgctctacggagctctcctcttctcagaggtgtcagctgccaagaagttgacagccagccaagtcgaaggtgacattaaaaagtccaaacttcgaaagactcttgtagaccttaacaacatcggcaagaagcacggcggcaaccgagcctttggtctccccggctacaaggcttccgtcgactacatctacaaggagctcaagaagcacaagaaatacctcgacactcacattcaacccttcaactacacttttgagcagacgagggatattcaggtgcgaggacctgacggcgaggatgtctatgtcatcactctcatctacaacgtcggcacgcctgcaggtggtgtgactgctcctctggcccttgtgccaattgacgacacccgcggatctggatgcttcgccgaccagtgggagggcgttgatgccaaggacaagctcgttctcgtcaagcgtggttcatgtgccatctcggacaaactcaagctcgcaaagaaggctggtgctcgtggcgttctccttgtccacaacgctcctggtgagggtatcaccagtgctacactcagcgctgagaacctggagctcattgtccctgttggcgttattcctcaggaggtcggaaatgcttggaggaagcgcattgagggtggcgagtcgctcgaggtcactttgctggtggactcgttctatgagactcgagagacctggaacattatcgccgagacaaagcagggtgaccctaagaatgttgtcatgatgggtgctcatcttga

SEQ ID NO: 60264 - DNA, 532 bp, Triticum aestivum
  Clone ID: PAT_TA_60264
gccggccgggctgcgaaaaaaaagaaaaaaaaaaaaaaaaaaaataaaaaaaaaaaaaaaaaaaaaaaaaaaaaaaaaaaaaaaaaacaaaaaaactaggcccctccgggacccccagagatataagaaaaacccggatcccccatgtaattaaaaatttcggacttcaagggggagccccaaccgcccccttacgggcggggaatcccgttacgtcaataggggcgtatatgtttagctcattttcaagggcttaaagtgtcgaaaattttagggggtaccaaaatggaaaaccctttccccctttcccccttttgcgccactggggcaaatcccccagttggcccgctggtttacaacttccaaagggcctggccgttccgagcgggggaagggaggggaatggcggaatggaaattggaaaatttcaccgtttaattattgtgaaaaaattcgtgtttttttaaccggaaaagtcccattaggcttaaaccccggaagaaccaaatgggcaatacccccttatggatta

SEQ ID NO: 60265 - DNA, 533 bp, Triticum aestivum
  Clone ID: PAT_TA_60265
gccggccgggctgcgatctacggcgactctagacgaactctcagccccctgatccaacaagtcgactttgacaatgtcgttgtgtaccacacctccgacgaacattcttatcctgaccagggtattacacggcgaagacccatgtacgccgatgcagcactggacgcttgctgtgatgaatgcagcgcccaaggacgcgcctgatgtagatcgggctgcgagcgtgatgggatttttgtacgtatcggatgtggatgaggagcgtcacaagatcaagttgcttgcgccggtgagcggacgcttgggtgatcagccgcttgtgtggcggaagcgcccaaagccatacatcaacctcctcggataagaagtattttctttctttccattgcttggcgaggggttatggttttatcagctgcctgtgttactctagtcagttgcggccgcatgtgtgctccatagccaacaatttacgtatcagggaaacaacctgatttagttgcattaaaaaaaaagaaaaaagaggtccctac

SEQ ID NO: 60266 - DNA, 444 bp, Triticum aestivum
  unsure (1)..(444): unsure at all n locations
  Clone ID: PAT_TA_60266
gccggccggtgctgcacaaaaaaaaaccactcccaccacttttagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagactgctgcagcaccagctgcgaagcccgcacctgctgagaaaccagcaccggcagctgctgatgtagccaagcagattccagctggcattccaggtagccgggcgaacaactattaccgtgcagatgggcaaaacacgggcaacttccttacggaccgtccttcaaacaaggttcatgctgctcctggggatgggttcgtccctgggctacttgtttggnggaaagagatgttaatgattggtgcctgcttaatgaacgagcga

SEQ ID NO: 60267 - DNA, 802 bp, Triticum aestivum
  unsure (1)..(802): unsure at all n locations
  Clone ID: PAT_TA_60267
gccggccgggctgggactcaatctctcggagcctcacaaccaccgtatctcgctgcttctccgccgagccgatcacgagcagcaactagttgagatcaagccgtcgccgtcgccgtattcttcttcctctccgacaggaggttaagccgccgtcgccgtcttcttcttcgtctccgacaggagtttaagccgccgtcctcgtcttgttcttcctcgtcttcatcaggaggagcggccggaaacctcgggaagagctggccaacctggatcagctggagggcggcgccgcctccctgcgcgggcacgagaccgaggagcagcgcaacaaattcctcgtgctccgcctctacgaggcgctcaacggccgcgaccacgccgccgtgcactccctcctcgcccccgacctcgagtggtggttccatggcccgcccacgcaccagcacatgatgcgcctcctcaccggctccagctccccgtcctcctcctcctccttccgcttccagccgcgctccgtcgacgccttcggctccaccgtcatcgccgagggcgtcgacgacaaggccaaggcgtactgggtgcacgcctggaccgtgggtgccgatggggtgatcacccagctgcgcgaatacttcaacaccgacctcaccgtcacgcgcctcgccgccgccgccgcngtcaagtgcgtctgggagagccgccgncccgaacgcgnccgcaactccctcccgggnctcgtccctcgcctctaactgcggaaagcatgtactcctactgtgtagntttttattgggggatacttacc

SEQ ID NO: 60268 - DNA, 390 bp, Triticum aestivum
  Clone ID: PAT_TA_60268
gccggccgggttcgggagatccagctgctatctctaaagaacttcttcagggaatcacagaaactgtgaaggaggcagagggaacttctaaatgctgatgctgactcggttatgcctttgttgacctgccgttttgaatcaaatatttgttgacatctgctagtttctatagtttcctagccttgactatcacctttgtatacagttgttgatctggggctagccattcctaaatcatcttgtatggcatctgggcatgtgtcttgtcatctcaaaacttaaacagtgatgctgataatgtgagttagagacatagtcattttgtatgtcacaaaaacttggaagtgctgatacttctacaatgaaaaaaaaaaaaaaaaaaggccccta

SEQ ID NO: 60269 - DNA, 247 bp, Triticum aestivum
  Clone ID: PAT_TA_60269
gccggccgggtccgctgtttctggtactgtttaaaccttggacctagtggtgttccaccttctaagcagatgttgctgctttctttgttagcttcgcttgtttgagcgcataaatgcgagacgacctttatgtcggtgttaaaaaaaaaaaaaaaaaaaaaaaaaaaaaaaaaaaaaaaaaaaaaattaaaaaaatcaatgactcggcaaaaaaattcccaaaaaaaaaaaaaaaaaaaggccccta

SEQ ID NO: 60270 - DNA, 519 bp, Triticum aestivum
  unsure (1)..(519): unsure at all n locations
  Clone ID: PAT_TA_60270
gccggccgggctgggatgccggcaacctcggggactccgtcaccgtcgcccgcgacaagagcaaggtcaccgtcacctccgacggggccttctccaagaggtacttgaagtacttgacgaagaagtacctgaagaagcacaacgtgcgtgactggcttcgggtgatttcatccaacaaggaccgcagcgtctacgagctccggtacttcaacattgctgagaacgagggcgaggaggaggactagatgtgcactgccttgtttctgtgccgtgtgaaactttgaacttgttggagcacttctgcagtagagttttgatgtttatgttttcacccctgttttgaattgtggccaggacgccatgtgatggatgcttagataaccaagctgaagaattgtccgttcttgttcttgtggtttatagaaatgttggtgagagtatgtggggcgtagaaatgttgcaacaggcacggtttccttctcaagtcaaatgcctttattaagtatcnnnnnnnannna

SEQ ID NO: 60271 - DNA, 732 bp, Triticum aestivum
  Clone ID: PAT_TA_60271
gccggccgggttgcgggaagactcccccttcctatcttctctttctcctctccacttcgactatactccattatttctctgttctccctgtcctctggctcagctacgtacgaaaagcaaagcaagcagcatgtacccagccgaggttgccggtgttcttctccccgcggcgtacttgccgccacctgcaaacgcagcctctttcggaccccattatccctaccagatagcggaagacgatcatctcctgttccagtgcggcggcggcagtctaatgcagttgccctacgccgacgagttgtttctcaaccaccttccggcggggctgcccaacaggtcgagctccgacgagccagcgccccacgccatagaccggcagcgcgcggaggagaggaggaggaggcggatggtgtccaaccgggagtcggcgcggcggtcgcgcgtgcggaagcagaagcagctgggccagctgtgggcgcaggtcgtccacctccgggacgccaaccgtgacctgctcgaccagctcaaccgcgccatcgttgactgcgaccgcgtcgtgcgcgacaactcccggctgagggacgagcgggaggagctgcagcggaggctccgggagctccccgtggtcgatgccggcgacgcggagggcgtcgccgttggtgaagatgacgagtctacagtctaggatggttgtagttgcaaccagctagaggaaaaataacatttctttct

SEQ ID NO: 60272 - DNA, 547 bp, Triticum aestivum
  unsure (1)..(547): unsure at all n locations
  Clone ID: PAT_TA_60272
gccggccgggttcggaagacagacaacgctacacgagggcattatggtttccgccatgaagctgtccgtcaccctcgtcctcctcctctcagggctcgtggtgttcggggagatcgcggacgccaaggccaaggcgccgtgcgccgtggtgtgcttccagggaggccacatcacctgcgacaactaccccggccaggagctcgacgggtgcgactgcgagtgcgcgccggcagacggcaagggctgcgtgctacacctcgacgacggcgtgacccacaccaactgccgcacgcccaatatgtagctgaattgttggtttgagtttgagttcaataaggctctgcaagtttgttgtcgactgtaacgaaaatgttcgcgtgtctctggtttggcagtgtaatttaactttacacgcttcgaataaaatttccgaccataatgtgttgaggctcnnnaaaaaaaaaaaaaaaaaaaaaaaaaaaaaaaaaaaaaaaaaaaaaaaaaaaaaaaaaaaaaaaaggaaaaaaaaaaaaaaaaagggccccta

SEQ ID NO: 60273 - DNA, 529 bp, Triticum aestivum
  Clone ID: PAT_TA_60273
gccggccgggctgcgacccccaccagcagctttcctctctagctcgatcgatcgatcgaatccttccgtcgcgttcgcgtttccgtttcgtgtgtttagaccaaggacgactccatcttctacaatgaggcgaagctgagggaggtgctgcacttctcgaacgcttgcggcgccatctgcaccaccaagaagggagccatcccggcgctgcccaccaccgccaccgccctggagctcatcagcaagggcagcaactagagacgccttgtgtcgcgccgtcgggtctgaatcttaggggagtttagctgcacttttattattagggatgaattgagtttagttcgtgtgtgtcagtgtgtgacctcgtgggcgcttaataaaaagcaagcatgtgtggtgattttggttgccgtctttgtgtaaggaggctactgattgttgtagccttcacccaaactttatcagagtcttgaatgaatttatcaaaatcttgttctgctaaagaaaaaaaaaaaaaaaaaaggcccta

SEQ ID NO: 60274 - DNA, 499 bp, Triticum aestivum
  Clone ID: PAT_TA_60274
gccggccagggttcgccacatcaactgaaagagatcgagcatatatgagagagaacaaacatggccgtcactgtcgtgcacgcttaggatcagctgaaaaatctccctctccgatgcaaagactagcgcagctccaggccgagcgatcatacgaggaggacatcgctgctcatattaatgacgaacaatgcgaaaaaagatcagaatgaccaaccctacccttcgtgggccgcaataatagtaaaggaatgacctaatacgtccaaaagcttctgcaaggggaacgtgacaaagcagatagaccactgtacccaccccccacgtgatgtgacactccaatatatacacacacaagaatgctcccacattattgacgcaatacggcgtagaaaatacagggctgaaactctgatgaactgctctttctgcaaaacagtacgatggtgatcgacctgatgaccaaagtaatggcttggctccatggattgtgtgcgtgata

SEQ ID NO: 60275 - DNA, 756 bp, Triticum aestivum
  unsure (1)..(756): unsure at all n locations
  Clone ID: PAT_TA_60275
gccggccgggttccgaatcctccctcgccatcgagaacaattccacatctcccgttccgactttgacgatgaaactactactagcttcgtcatgactgtacctgacgtccgctaaagatcgctcctcatcgacgtcatcctccagtttctataacatcggcttctacctcaaaggtctgatgatccctaattcgtctaatccgttcgcctattagtactactcctatttgtcctcttcttccttctaccctgcactcgagtggttgatccgctcccggccgctcgtccgtatggtctgtgagggatagaacgtcctctgcaatgaacgccagatcattggcgccaccaaacccctggactctgaagcagcatgcatccgtgtagattgactccgacatctgcaggctcgtcatccatgctaccaactccaactgacagtgccacgacagacatctccctgaggccccctgtaaggatgtgcacacatcaccagctcccccctcaactggatctatgaggcctacgattgatcatgcgcgacttgactgaagatcttctttaagaatccacagcactagcctgtgactgctaacatgttgaacaatctgatcttgtaaaccatgagtgtatcaactgaagttatctcatcgtgcttgagacccttattgttatatgatgctatagtattgatatatggggttgngttgctactcctacattgttatggcttcagctttgagatgtttggtttcctgc

SEQ ID NO: 60276 - DNA, 513 bp, Triticum aestivum
  unsure (1)..(513): unsure at all n locations
  Clone ID: PAT_TA_60276
ctgtgcggcgctcgaggcggcctggcccggtggctgtcgtcggcgtccgccgaatcgcgccatcttgaacagcaggacggccaagagacggaggtgtcgtcgcacgagcagcttcgccaccctgagcaggccgtgatggggcgcgagcgcgaccacctgcgagccgctctcgtcccgagctacgagcacccggggggcgacgccgagtgcgcggtgtgcctcggcgacgtggagaagggggagccagtgcggcggatgccggtgtgcctgcacgtgttccacaccgagtgcatcgaccggtggctgcgctcgcacgcgacgtgcccgatttgccggtgcagcgtgttcaccccgccggaacgcccaccggaagtagtgttgaacgtggagttgtgatgcgaattggcgctcgtctagctacagctagcttcaaagggaattccccttgccnnaaaaaaaaaaaaaaaaaaaaaaaaaaaaaaaaaagaaaaaaaaaaaaaaaaaaggccccta

SEQ ID NO: 60277 - DNA, 621 bp, Triticum aestivum
  Clone ID: PAT_TA_60277
gccggccgggtcgggaaaaacacccatccatccaccgcatcacatccatcatctatccacgcacaaaggaaggcaacgcacgaagcacccacggggagccaccaagagatccatccatcatccatccatagcacgcctcaagcatcacgcatcagccaggagatcgacgcgagctcggctgtcttctggagtagacggccgggacggaggtagcatagccggcgccgtacgcgaggagcgcgtgcacgagcgacgacgcgaacatgccgatcgtcttctcccaagggctggatgcttggagacatgggagaggacgcgggttccgcggagaagagatagcgtgactgatggtcatgaatattatggtagggtaagagagaagcaagaacaaccgtgccaattggttgagcatagaagttacatgactgtcctaatatggttgtccttctgcgtgacaaagttagttggattcaacaataatatgaccgccccacacatatggctctaatagatatcctggatgtataaatactacatgctctcctccccatttaactcgtccacaacttgccacaatgccattgttgttgagatataaaaaaaaaaaaaaaaaggccccta

SEQ ID NO: 60278 - DNA, 510 bp, Triticum aestivum
  Clone ID: PAT_TA_60278
gccggccgggtcgggccgactgacgacgagtggatctgttccggcgcttcctgccgccgtcgaccatggcgtcttccaactccggcggcatccccatcaaggcggaacaggattcggatggctcggcccagagcacagctgatatgactgcttttgtgcaaaatcttctagttcagatgcaaaccaggttccaaactatgtcagagaacatcattacaaagatagatgaaatgggtgcaagaatcgatgaattggagctgagcatcaatgacctcaaggctgaaatgggcagcgatggtatgacccctactaaagtgaaggacgaagaatcaaagccagcagacagctctgcctgatttaagcagaagtagcagaagcaagtcgtattagtcttggttccatgtcaatatcatcagccattcatcactaacttaatgcatgttatgagatgttattcgcactgttatatgcatttgagatctacaaaaaaaaaaaaaaaaaaggccccta

SEQ ID NO: 60279 - DNA, 652 bp, Triticum aestivum
  unsure (1)..(652): unsure at all n locations
  Clone ID: PAT_TA_60279
gtgcggcgctcgaggcggccggtttgggacaatcccccagcaacaactactgatagagactcccctcccccatcctaccccgcagcaatggcgcgcaccaagcagacggtgaggaagtcgaccggtgtcaaggcgcctaggaagcagttggctaccaatgacgaccgcaagtcggacccgttcaccggtggagtgaataagccccactgcttccgccccgttaccgtggagttgcgtgagatccgcaagtaccataagagaacggagttgctgatccgcaaggtgtccttccagcggatggtgcgtgagatcgcgcaggacttctagaccgacctccgtttccagatctccgtcgtgtccgcgctccaggaggccgccgaggcgtacctcgtcttgctcttcgaggacaccaacctctgcgccatccacgccgagcgcgtcaccatcatgcccaaggacatccagctcgcccgccgaatccgacgagagagggattgaatactggtagccgcgtgcgtgcgttgttagacagtgctactgtgatgttacgaaatcacatgttgttggtgtagttaccatgttcctgatcgctcttgtcgntggcatgacatatgtagcttcttggtgcgatgaattatcaatgaaaagtgca

SEQ ID NO: 60280 - DNA, 635 bp, Triticum aestivum
  Clone ID: PAT_TA_60280
gccggccgggttccgatttctctatgtcggcatataacatccattccgggcagcctttggagcactaacctcacatcacttgagaatttatcgattgagaactgtgcagatatcgtttcaattggtggagaaaatgcaatttcagaaatacaaaatgtatggattacaggctgtcctgggatggaggaactaaagcggcccatggtaagaggcaaacggataccatgagagtggagccagtcttccccaatgtggtttgttcagtcaacaatctactgggatcaaagatctgagcttttagctgaatccacgttacgccatagcagcttatccttgttactcaaggtttactccatccatcattctgtcggcaaatcccatataaataatgcagttatggagtttaccagtctccccatttcatcatgcgccattttgcactttctagtacttgtggaataaatgagggcaaaatatacatgttattgtaccttgtatggtgtatatgtgccattactttgatttttctcagtcaactattaagaacaattttaatcaggatattctcctcgtgtgagaggtctatactagtagatgttatcctgttaatgttgtagcagttcaatatctgagga

SEQ ID NO: 60281 - DNA, 153 bp, Triticum aestivum
  Clone ID: PAT_TA_60281
gccggccgggtctcgaggaaatccattgggttcatgagccatgtggatcagctgaaattgcacatggactcatgttgtataaaatcagtgcctatacataatagtaatgcttatgatttcatctccgaaaaaaaaaaaaaaaaaaggccccta

SEQ ID NO: 60282 - DNA, 706 bp, Triticum aestivum
  Clone ID: PAT_TA_60282
gcgggccccatctagaaagaaatcatgagaaaaatctcttgtcgaccgttgttggtctttcccaattttattctgtggctattgcccagtcttccaccacaatcgctgttcccactggcacacccattgctggcaactacaatggcacctatcgtccccaagtccacttctcaccacctgaacatttcatgaatgatcccaatggcatgttccgtgatgctgatggcctgtggcatttgtactaccagtacaaccctacagctgtcgtcgctggtaaccaacactggggccatgccacatcaaaggacttgtatcattgggtgaaccaacccattgccttgttcccgccagaggaggatacatacgtcttctctggaagtgttgttgtcgacgagaacaacacttctggcttcttccctgaccaagacaacggagtcgttgcaatctatactttatcatcgccagaagttcaggatcaagctatcgcctactcccgagatggaggctacactttcgagccttacaagggaaacccagtcatcaacagcacctctacacagttccgtgaccccaaggtccattcgctacaatgactcttggatcatggttgttgcatacccccaaaaatttgccatcgacatccttgaagtcctccgaatctgaaagaatgcaccgcccccaacaaccttttcccaccatggccctg

SEQ ID NO: 60283 - DNA, 614 bp, Triticum aestivum
  Clone ID: PAT_TA_60283
gccggccgggtcgggatcaacacaacaagcatcgatcagattgctgctccgttccttcaccaccacaaaatccacactccactgctatcaagcttcaagcatcagagagttcaggcagaccattgagcggcatcatctcctccaacgcggcgagaagaacagagttgcagagagatcatggcgggtgcggcgaaggcgtcatggatggttgcgatgagcgtgggcgccgtggaggcgctcaaggatcaggccgggctctgccgctggaactacgcgctccggtccatccaccggactgccaaggccagggccaacgtccgtggcggcgtctcgcagggcgcaaggcagcttccggcttccgcagcggtggcggagaagcgacgagcggagaaggccgaggaggggctgaggacggtcatgtacctcagctgctggggtcccaattagtactagctaccaagcggtgttttctcctagctccagcctatgttagaaacttctagcaacgaccacgccgtgtgacttggctggttaattccctgccgattataaatacgtatcacgatgatgatgatgaaacctttccccaaaaaaaaaaaaaaaaaaggccccta

SEQ ID NO: 60284 - DNA, 404 bp, Triticum aestivum
  Clone ID: PAT_TA_60284
gccggccgggttccgaaaaaatactactgcttcgtgaattcaagtattgattgatcttcgggatgcagtgaggaggtaggaatctgtaggttctgatgatcgtcaaccatgtgtggaacaggggcagtgcaatggagcagaggaggcattaagacaagaactgcaggctaagaatgcagaaattcaagcattgagggcaatatgcaatagtttggagaggaatgcagtatgtaatagtgtgttctatgtcatgaccatgttagtggcgggtttatttgcaggatttatgctacattagtagctagactagaggatcaatgtaatggaaaatggtgtaatggttggataagtgagttttatggtacttatttaactaccaaaaaaaaaaaaaaaaaaggccccta

SEQ ID NO: 60285 - DNA, 714 bp, Triticum aestivum
  Clone ID: PAT_TA_60285
gccggccgggtccggcaaacaaacctccccaattccatccccattccccaaaattttccccaccggcgacgacgccctccccaaatccgatccgccgccgccgccgttgacgccagccatggccgccgccgcccgccgcgccctgctgctcctcctcgccgccgccgcggtggtcctcctcgcggcgcccccggcgtccgccgcccgcccctgcggccgcgcgcagacgctgctcatctccttctcctccttctcccgccccaacccggacccggctgacccctcgccgctcaccaccaccgtcgtcaccgtcctccgcgtccgccgcctcggcccgcaccgcttccacgcccacgaccagaaccacctccagatccgccgccccgccgagtccctccccgccgtcggcacccccgagaccgacgccgacgccgcctcctccttccaggagcgcgccaaggacatcctcgtcgtcgtctcgggcctgctcttcggcttcggctgcggcgccctcaccgccgcctccatgtacctcgtctggtccctcgtcgcctccaccggcgccgccagccccctacgaagaactctacagcgacgacgacaacgaggacgtctccgacgaccgcgccgagagccccaagaaggcccggctacgtcatcatccacggcgccgaggacgtcgtccccggtaagaactaactaagatccgggctt

SEQ ID NO: 60286 - DNA, 592 bp, Triticum aestivum
  Clone ID: PAT_TA_60286
gccggccgggctgggattcattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgccctccgcctatgctctgcccttggtgtccttgtgtgtatgtgtgtgcacgtgtccctgtaattgcttcatctatctccactatggatggagtgatgaatatgtaagaatgaatgatttacctaaaaaaaaaaaaaaaaaaggccccta

SEQ ID NO: 60287 - DNA, 686 bp, Triticum aestivum
  Clone ID: PAT_TA_60287
gccggccgggctgcgatctcatctgcaatcccctctcctccttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctcgtcctccccggcgagctcgccaagcacgccgtctccgagggcaccaaggctgtcaccaagttcacctcctcctgagtctcgtagttagctgtttgggtgtgtttgtggccgtgttatcgtgtaagaatcgcatcgctatgtttctggatctcgagaaatagtaacggtgcctgcctcaatgttcagaaaaaaaaaaaaaaaaaggccccta

SEQ ID NO: 60288 - DNA, 766 bp, Triticum aestivum
  Clone ID: PAT_TA_60288
gccggccgggctgcgaccctaccccagacgaaaccctagcctgcctccccatagcgccgagtccctccgcccccaacagatctactcgctcgaggctcttgctcgatcttccgagctctagacatgtcggacgacaatgccccatatgaggatgccgctccggttgcggcccctaccccagttctatgaacagcccatgatacttgatgactgctctgcagcttgtgatgaagaagcaagcgctcatgacggccttgtcaaggcacttccagaacctgctaaagcgattgacaagcatgctgctcatatctgtgtgcttgctgaggactgcgaccaccctgattacgtgaacctggtgaatcgcactgcgagctgaacacaacgttcacttggtcactgtgcctaccgccaatactcttggagagtgcagctgagctttgcaagattgactctgacggcaacgcaagaaaggaggtgtcctgctcatgtgacatcatgaaggactacggagaagattctcagggacttcacatcccgcaagaatacgtcaagtctcactaaggacagccttccagtttccggaatctgcatgatggtaccagattcgttatgaatgtgtaccatgtctgaaacttgttaccctaacaaaactatcttgcgcgctaatgtcgaatcggagtttctgtttcaggtgctgctacatcatagcttgattgtcgcacataccgatcttccaatttccatgatgtagccgctatctctatat

SEQ ID NO: 60289 - DNA, 559 bp, Triticum aestivum
  Clone ID: PAT_TA_60289
gccggccgggtttcgaagcagcaagaagcacacaagaagcttatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactaaaaaaaaaaaaaaagaaaaaaaaaaaaaaaaaaggccccta

SEQ ID NO: 60290 - DNA, 621 bp, Triticum aestivum
  Clone ID: PAT_TA_60290
gccggccgggctgcgaattcattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagcaaaaaaaaaaaaaaaaaaggccccta

SEQ ID NO: 60291 - DNA, 284 bp, Triticum aestivum
  Clone ID: PAT_TA_60291
gccggccgggttcgaaaaaaaaaaacaaaaatgcattagagattgcgataagctctcactagtctggctcttctgtttaacttgtgtcaacacatatgacctcttcagtttgggactatagtttcttttgaaaagtcacgactacgatgacaaataatgcggccatagtatctgttctatgcgtggtttgtaattttcttagatgccccttggcctttaacataactttggtacttgtggcatattgtttgttataactatgtctgcgctgcttgtttcttccc

SEQ ID NO: 60292 - DNA, 563 bp, Triticum aestivum
  Clone ID: PAT_TA_60292
tttcaattcaattgtgctcatcttatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagatcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcaaaaaagggtgcatgtgcgtgtgcgtgtgaattgcttgctcgctcctcccatgctctgccccatggcgtccctttgtgcgcatgcgtgcgcgcatggtgcccccgcaaattgcttcatcccatccccaccctatggctggagcgatgaatatggaacaatgcaaaatttaccct

SEQ ID NO: 60293 - DNA, 234 bp, Triticum aestivum
  Clone ID: PAT_TA_60293
gccggccgggctggacgttcgatatggtaggaaaacagtccctcaaccctgtactctacggcgtttgatcttcaacacttcatgcatgatggtgagcgcggctttggttatttaagatatctctcatatgattcttcataccccccgtttcaaccaaggggaagtagactatagtcatttcaactagacagatcttgttcagaatccgaaaaaaaaaaaaaaaaaaggccccta

SEQ ID NO: 60294 - DNA, 609 bp, Triticum aestivum
  unsure (1)..(609): unsure at all n locations
  Clone ID: PAT_TA_60294
gccggccgggttgcgaaatatttgtgattatcatcatcctcgacacctagctcatcttcttctccttgaaatctttttgcgttcatcacatttggaggatgtattgcaactgtgaatccggttgcagctgctggtcatactgcaagctgcggcaagatgtaccctgatctgaaggatcaagttagtgccgcgtgccatgtggtctgcgtgcccgatctcgttgtgctacctgagaactaggcgggagagttccaggtggacgccggacaatccgaagaggtctggatatgcgacgacaactgcaagtgcaaaccctgctactgataatctgcatgcactcgctctgatgtctgagacagtatacgatgaataaccagcagtccctactgatcatgatgtcatgccatgcaagcgatgcgatgtgccgtgtgacatgcagctgttagcttgagtcgtgtcgtccgaactatcgctctcgccgcttaggtgctgctatgtgtcgtatgatgtagtgcactgtgtcacctggtaattgctgtcatctatcgtccactagtggatgtgagtggtgaatantgtaaagaatgaatgagttacgtatgtaactac

SEQ ID NO: 60295 - DNA, 707 bp, Triticum aestivum
  Clone ID: PAT_TA_60295
gccggccgggttgggtttcgagctgacgtcaattgatgacgccgacccttttaatccttcctggctttttgacaccgagaagcattgccgggaagcggatgcatcggttcatggcggcatagggccatttggacttgttattctggcctccgacaacatggaggagcaaactgttgtgcacttcagagtctacagatcacagaaaaattatatgatcctcatgtgctctgatctaagaaggtcttccctgacaccaggactggacacaccggcctatggaggcttctttgaatttgaccttgaaaaggaaaggaagatctctctcagaactctgattgatcggtctgcggtggagagcttcggtggcggtggcagggtctgcatcatggcgagagtttacccagtgtcacttgtcgacgacgaccaccagccccacatgtatgcctttaacaatggcagtgcaactgtcagagttcctcacctcatggcgtggagcatgaggagagcacaagtgagcgtttaacacggaggagcaattctaatttgacatgtgattagaggaccgtcttaaatctagtcatttgttgttttcaatatttagcatgggtatttgaactagagtcatgaagtagacgcccacgagctatgatgtaagtttgccgatatttggaataagaacagaaaaaaaaaaaaaaaaaggcccccta

SEQ ID NO: 60296 - DNA, 578 bp, Triticum aestivum
  unsure (1)..(578): unsure at all n locations
  Clone ID: PAT_TA_60296
gccggccgggcttgcgaagccagcaagaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattanaaaaaaaaaaaaaaaaaaaaaaaaaaaaaaaaaagaaaaaaaaaaaaaaaaaaggccccta

SEQ ID NO: 60297 - DNA, 776 bp, Triticum aestivum
  Clone ID: PAT_TA_60297
gccggccgggtcgggattcagatctgtatttcacctcagccgagaaaagtgacaaacgtccatcatggctgactcttccatttctttcctgcccctcggcgccatcattcagtccattgtcgtcaacggcgtcaacatcgttcaaggcttccccacccaagaagactatgagaagtacaactatccctactttggcgtgaccgttggccgcattgccaaccgtatcaaggacgcccgcatcgacagccttaatggcaaggaagtcattctcgccgccaacgatggaaagaaccatctccacggtggcaaggttggctggagcacccgcgtctgggacggtcccaagcccgttggcatccgtgaggttcctggtgtcgagggtcttgagggcggggagagcgttgcttttacacttaccagcgaggatggcgatgagggataccccggtaccgtagaggtcaccgttacttacacgacgggcacacaaaaggtcgacggcaaggatgtcactattcttgctatggagtacgaggccaagctcgttggcggcgctgatgagacggtcatcaacatgaccaaccactcttacttcaaccccagcggaaaggagaccattgccgacacagagatgactctccccacagccagctaccttgctgttggcgacgacctcatccccactggcaagattgagtctttccccggcgtcactgccaacaagaccttcactctaggtcctcaagagcccacatcgaccactgcttcgttctgaacga

SEQ ID NO: 60298 - DNA, 419 bp, Triticum aestivum
  unsure (1)..(419): unsure at all n locations
  Clone ID: PAT_TA_60298
gccggccggtttgcanaaactcagatcgtcgccgctcccgatctctcaagaacaaaccaccaccacagccgccgacccccaatccccgatggcccgcaccaagcaaactgcccggaaggccaccggcgtcaaggcggccatcaaggagttcggcaccaatgctgctcgtaagtggtagccggtgaccggcgacgagaagaagccccaccgcttcacgccgagaaccgtcgacctccgtgggatccgcaagtaccagaagaggacggagctgcgcatccgcaagctccccttccagggtctggtgcgacagatcgcgcaggacttctagatcgacctccgcttccagccctccgccgcctctgctttgcaatagggcgccgaggcgtacctgatggtgatggtcaaggacgccaacctgt

SEQ ID NO: 60299 - DNA, 378 bp, Triticum aestivum
  Clone ID: PAT_TA_60299
gccggccggtccggggcggcgcgacacgacgaggcggagcgtgcccacgggcacgagcggcacggccacggccacggcggggcgagctaggtacgggcgcgcgtggttatttttgggcgcctgttggagttgctactgttgctagccgggcagtatatttttgggcatctgttggagatactcggtcgtccggcgcgctaaaacgctattttggcgttgtaaatttttttttagcgcgcggctagattatgcgtctgttggagatgctcttaagcaaatatgccccacaacctaaacctatcggccaatttgaggccttgtaattcgaatcatgcaaatttaagtttttatcaaaaaaaaaaaaaaaaaaggccccta

SEQ ID NO: 60300 - DNA, 660 bp, Triticum aestivum
  Clone ID: PAT_TA_60300
gccggccggtctccgaaccggcatttctcctacaggagcagccggccacagcgggacgcggcgggaggcggcggccaggacgcggcaaaaaccggtgttgcgcgggcgcccgggggccggggctggggccggggccggcgaggaacgcggtaggggccgggtgcgcaggagccggagccggcgagtggagcagccgaaccgggtgctcgggagccggagccagcgaggggcgctgcggtgaccgggtgcttgggagccggagccggcgaggggcgcggtagcggccgattgcgcgggagggcggagccagcacgcgggcggacccggcggaagcagagctcccgccacgggcgaaggcggctagacggggcggagctggcgggcgcgcggaggcggacgccggctgggaggcgacccgacgagcaagcggaggcgcggggtcggcaactcggcgcgcgcggggaagccgactgccggacggggcccagccggcgggcgcgaggacgcgcgcgaggcgaggcggggccagcagcagccagtcggcgcgggggcgaatggtgcgatgcgggccaggcggctgaagccggcaagcatggagcaggtatccagaggaggagcagtcgcaggagggtgctcggacatgcgccaggggcacggcgc

SEQ ID NO: 60301 - DNA, 611 bp, Triticum aestivum
  Clone ID: PAT_TA_60301
gccggccgggctgggctgaaacccaagcccccctcccctcccttcccccgggcttaaccacctcgagaaagagtaaagctagagagaaagctacatcccaccgaatccaacaaccgacaaggaggaggagggagcgagcgagcgagagagctgacgatgcagcaggcgatgtccttgcccccgggagcggtcggcgcggtgtcctcgccggccggcatcaccaccgagcagatccaaaaggttcgatccgtgcctccttcctgctagggttacgcagatgcttccttcaacctattgattcgaccataggcctcacctttttcgttcctggttagagaaatatcgcccctgtgtttcgaacgagccttgtggatgagtgtatacctattgataactgtatacctatttcctctatgcaacatcatctctgtgtttccaaatcatggactcgtgatagttacatataaataagtttaactccaagagagtcaacttcagaaatcatccattcagtaatcagtatccatctgaagacatttctatccgaaagactggttcaagaaatatcaactatgctggcacgataaaaaaaaaaaaaaaaaaggccccta

SEQ ID NO: 60302 - DNA, 519 bp, Triticum aestivum
  Clone ID: PAT_TA_60302
gccggccgggctgcgtcgggcaggtgttcctctatcccgaccctcccctctctggcaatggcggaggcgacgacagcgggggcaccggagggaccaaccggaggcgaggcctactcccatctctcgcgcatgaagtagtccactttgcgcctctgatcggtagcgaaccgaggcgacataggcagtgcaacgatccgacgcgagctgggcggcgacaatggccttctccggcgtcgcgctccatcgtcggctttcttctcgccggttgatgatggagactggagctcggaggtgggatcaattcaaggaggaggtggatgtcatgctgtaggaggagaagaaggctgcggagaaggaacaacagtacagtatcttcttagatccagccaaaggcgatggccctgtttctactctgttatagataaactgtccatttttttcttcattggagctccaccgttttgaaataactagactgtcacatagtattgacaaaaaaaaaaaaaaaaaaggccccta

SEQ ID NO: 60303 - DNA, 414 bp, Triticum aestivum
  Clone ID: PAT_TA_60303
aaatcagcaggcgctatctttcgcgcgaaggcgacgaggctaaggcaacagaacagagtcatgacgatgaaaaactacgagccgagcacggatcgagttcccacgtgacaaagtgtgcatcacacatgacacgacgcatctctgtgatgtacaagacgactttctcttcctgctaatgagaacctttgctacgggcgccagtgaataatcctgacgcgaaagttctttctgatcccccgtgcaaatgctcaactacgatgttagctatgtcccctttggtaggcatgcagaaagaaactctgtcctctcggtacgacaaacgtttggcactgatatacccttgctgccgagaccatgtacttatatgccgctggagagaatcactgatatgtccctaggtccgtcaaacgatct

SEQ ID NO: 60304 - DNA, 643 bp, Triticum aestivum
  Clone ID: PAT_TA_60304
gccggccgggctgcacgcgcaccaaagcccagagcaccgctccgcgcactcgcaccgagccgaccgccgcgcgccgcaaggcggggagagggaggggatcgatggggagcagcgggggcagcagcgactacttcctgcgccagctgagctccagcgacggcggcagcgcgccggcgccggcgccgcgccagccggaggaatgggagtgcggcggcggcaccggcaggcgcgggtcgaggaggtggtcgaggaagaaggcgagggcgagaggccaccggcggggcgggggcggcgggttctgcggcgccccggaggaggccgcggcggcggggaggaagcgggtgatggtggtggtggaccagagctccggggccaagcacgccatgatgtgggcgctcacccacgtcgccaaccggggggacttcctcacgctgctccacatcctgcctcgcggcggcggcgcccgcggcgaggacgccgccgcgcttgccaactccctcggctccctctgcaaggcctgcaagcccgaggtgcgtgcccgtgctctctcctgccaccagacccgttcctcttctaacaagaagaagatgaactggtcacttgggtagcagtacttcccagcacattaactaggatgttttgc

SEQ ID NO: 60305 - DNA, 247 bp, Triticum aestivum
  Clone ID: PAT_TA_60305
gccggccgggctgcggctcaatatgaagtttcttaaaacaagatcagatctctactttgccccgtgattgtagcgtcaatatacaacgcggatcggacggacgtgttgtcccgaccgaaggataccaccggtggagttcaatgaattggtgtcatatgaggtgttgaatagaccttgaggactcttcttgacggttgaatgtctacgaggtacatgaatccaaaaaaaaaaaaaaaaaaggccccta

SEQ ID NO: 60306 - DNA, 726 bp, Triticum aestivum
  unsure (1)..(726): unsure at all n locations
  Clone ID: PAT_TA_60306
gccggccgggctgcgnaaaaaaaaatcgctctcggggttgtcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagcctgtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgaacggggggggccctccagttatcgatctatctaccatctccgtcgtcttccgtca

SEQ ID NO: 60307 - DNA, 825 bp, Triticum aestivum
  unsure (1)..(825): unsure at all n locations
  Clone ID: PAT_TA_60307
cctgtgcggcgctcaggcggcggcctgccaaacttattacgggtccacgaagtatttccgctcgtgatatcatcgttctgccgaagactacgtccaccaacgtacgtgggtagagttgaaagatcactccgtggatatattcgggagaaaccgtcggacgacgtgcatgtcgctatcttgtgcattggtggactccgacaagtagagagactttgggaaattaaaggatacaacagtcgccgtggggccgttgacacatggttcaatgctctcaccaaggatgcacctcctaccgagtcgggcatgtcgacatcaaaacctaaacgaagcctttttggacgcaagaagtctaccagtgaagcccggccatctggtgccacattaaacaaggctcgaagctcgggttccatagacgggaacatggactgggatgctggccttgtcttcaacacgagcctatctgccggcgctcccatgtcttctctgagctcacaacaggctcaggctctcctcagcgatcttcctgtactgcaacaaatatggctcacttcagccgaggctcttgttcttcaacggcgaattgtcgagcgcccgcaggacatcaagcgcaatcaacaggtcatgctggatttgatccgagaggatgngcttgacgaagaggacgaatggtggtacggccgcagcatccccgattccgtgcggcctcccgtcagtgtgactgatgacgatgcggactgatcacacccaatgggcatttttcattatatatatttgctgttggcgagcgtcctttcaggaaagtataccacgactacatactacttt

SEQ ID NO: 60308 - DNA, 807 bp, Triticum aestivum
  unsure (1)..(807): unsure at all n locations
  Clone ID: PAT_TA_60308
gccggccgggtcgggacatccaagtgccgaattacacggcgccagttgatgtctatggtacagctcggtcgatggggccaactgcaccgatcaacctgaactacaaccttacatggattttaccggttgatgcggggttcagttacctcctgaggttccatttctgtgagattcagtatcctattacaaagcagaatcagaggtccttcttcatctacatcaacaaccagacagcgcaggagcaaatggatgtcatcgtctggagcggcggaatcggtagaacaacatacacagactatgttatcctgactgctggctccggccaggtggacatgtggattgcacttcaccctgatctttcaagtagaccagagtattttgatgcaatactgaatggtcttgagatcttcaagctacagaattacggagcatcgaacaatcttgccgggctcaatcctccacttccacaaaagccagctgatgccagtcccggcgcggcatctggcaaagtgaaatctgtcgcggctatcataggtggagctgttggtggtttcgtagtgctgctggtcacatgttttggcatttgcatcatctgcaaacgaaagaacaagagcaagaagaagaagaagatatccaaggatcctggtggtanatctgaagatggtcactggactcctctcaccgagtacagcggatcacgatcagctatgtcgggaaaacggccaccaccgggtcgacactgccatccaacctctggcgncacttcactttcgccgagcttcagaccgncaccaagaactttcgaca

SEQ ID NO: 60309 - DNA, 213 bp, Triticum aestivum
  unsure (1)..(213): unsure at all n locations
  Clone ID: PAT_TA_60309
tgtgcggcgctcgagnncgccggnctgaccttctcgccccgatccatctcctatcngcctcaacttggctatggcgacggggagacgaggatcaacaactctctcctttgccttctaaatcgccgccccccacacgcctccccgcgtccctccttcattcccgtccccgattaggccgccgccgccaccgcaccatcaggggacgccggggga

SEQ ID NO: 60310 - DNA, 639 bp, Triticum aestivum
  Clone ID: PAT_TA_60310
gccggccgggtcgggaccaccaaatcagacgcagtgccgcgcattccatccaccgccggattccgaggggtccgagctcgccggagagggaagagagatggtcaggaagggcggagagaggaagaaggcggtgacccggtccgtcaagggcggactccagttccccgtcggccgcatcgggcgcttcctactagagaagggccgctacgcgcaacgagtcggatccggcgcccccgtctacctcgccgccgtcctcgagtacctcgccgccgaggtgctggagctcgccggcaacgccgccaaggacaacagagaagagtcgcatcgtgccgcgccacctgctcctcgccatccgcaacgaccaggagctcggcaagctgctcgccggcgtcaccatcgcgcacggcggcgtgctgcccaacatcaaccccgtgctgctccccaagagggccctcgagaaggccgagaaggaggaccagtctcccaagtcgcccagtaagaagatcgagcaagaaggacccgcgcctcgccgtcaacaagacctccaagaacaagaccgccggcgagcagaagaccaccggcgccgacaagaaggccgccgccgacgtcgagaatgagccgccgccgccgccgccgaag

SEQ ID NO: 60311 - DNA, 269 bp, Triticum aestivum
  unsure (1)..(269): unsure at all n locations
  Clone ID: PAT_TA_60311
gccggccgggccgagagatttcttctccagccttcatcgcgcgagaggcgtccatggcggcggcgggcccagccaaaacggaggtgctgtccctcttccgcgccttcctccgcacggcgaggcagttctccgactacaacatccgcgagtacacgcggcgccgcgcggcggacgccttccgcgagaaccgcgccctcgccgacgcgccggccgcggcggcggccttcgcggacgggaagcagcagctggaggtggccaagnnaggcaag

SEQ ID NO: 60312 - DNA, 655 bp, Triticum aestivum
  Clone ID: PAT_TA_60312
gccggccgggtcggaagacatcaaagaagcaaagaaacttgagaattttacatgcgaaggttgtgttgctgaaaatggaaatggaaatggaaatggagtcaagaatgaaaattcgcatgaatctacaggcgaatcagatgagaaggtacatataactgctttaaagaaggatggacctggcgtagtggtgaagtactccccacttgtgccaagagcccaagaggtcctgggttcggcctctctgcattgcactgtgcaggggtaaggcttgcctggtataatccttgcccagaccccacatggcgtgggaccttctagcaccggcaggtgcagtcgaagcggcgacggcggtgaaggcgaaggcgatctgggcggaagtcctccatctcttcacgcatgtgacgcggtggatgtacattgctgtttccagtttgatgtagaacgaacctgtattgagagtctcttctagagtctggcattcggccagtttgcgactttgcatatccatgtggacctacctgttagagggagtaatttttctctcttcttttttccttcccccttcgtgttgacatggacatttgtgagtgagcttaaatgccctttcttcaaaaaaaaaaaaaaaaaaggaaaaaaaaaaaaaaaaaggccccta

SEQ ID NO: 60313 - DNA, 510 bp, Triticum aestivum
  Clone ID: PAT_TA_60313
gccggccgggctgcggaaagtaagccaggcgacattcccctcgaatccagccgagatgccgcaccgcggcgccgtcctcgtgttcctcctcgccctcgcggcggcgccgctcgccgccgtggcgtggcgcccgtggccgccgcgcgttgccagcggcgcgctcgccggcctcggcgcgtccaagaagttcgagggctcgtccaacttcgtcaagctcgagtaccacatgggccccgtcctcgccgccgacatcaccgtgcacccgatctggtacggcgcctggcccgccgaccagaagcgcaccatccgcgccttcctgcgctccctctcgccgcaggcctcgggggagaaggagggcgccgtcccgtcgccgtcggtggcggactggtggcgcaccgtccggctctacacggaccagaccacggccaacgtgtcggccgtggtggcgctcgggcaggagaagtgcgacgcgcggatgtcgcggggggcctcgctcgtccggatggacat

SEQ ID NO: 60314 - DNA, 586 bp, Triticum aestivum
  Clone ID: PAT_TA_60314
gccggccggttcgggacccaaccccagcgcctcaaacaaagccctgctgcacctgctccgatcgccgcgaggaaccagcgagagaccccggagccagaggaggaggaggagatgagctactacaaccagcagccacccgtcggcgccccgccgccgcaaggctacggggacaagggcggatacccacccccggcgcagggctacccgccggccggctacccccagcagggctacccgccgcagtacgcgcagcagccgccgccccaccagcagcagcagcagagcagcgggccttccttcatggagggatgcctggccgccctttgctgctgctgtctcctggacgcctgcttctgaggagggaggaagaagacgacgatcaacttcgtggaactgggactgagctatcctctctgacggagaaatgctgctagtagcttaaatattatttctcgtcgggcattatcgcctactttgcttgatccatgtttatgaacctctctgcattgcaactattcgcttggttgtcgactgatgattatattatgcctggtgccttccgtgtgtatattgtgtcggtttaaaa

SEQ ID NO: 60315 - DNA, 338 bp, Triticum aestivum
  Clone ID: PAT_TA_60315
gccggccggttcgggggacggcaacctgatcactagccaaggtccaggcacttccatggaattctcgcttgccatcgtggagaagctttttggtagggaaagggccttcgagctggccaaagcaatggtttttgtgtgagttctgttgctacgatgaagttcctggtcagactagagtggcgctgtgaatatacgaggggatgctgtgttagctggtggcctttgtttcttactagtacaataacgcaacagctcgtaatggatggaaatgcaataaaaagttaagatgaatacgatgcagttaaaaaaaataaaaaaaaaaaaaaaaaaggccccta

SEQ ID NO: 60316 - DNA, 821 bp, Triticum aestivum
  Clone ID: PAT_TA_60316
gccggccgggtcgcgaatctctctggtcactccaaattgctgctgccgaatagctcccatcaactctgttgttcatgctcacctgcagccacccccgcaaatggtgcttccatagtgtatccgtcgacggcggctgcctcgcttggatccagcttgagtattaggatgccggcgacattgtcttccccaagtgcgcaaggcagacacattgtttgtattcccgctcgaggtagtcgggcacgtcgtcgtcatcccccacggcgtcaacaatctccaaagttgaaagtctgccctgcagagaaggtgtgaccgggggctatgagctgtaccattgtagacatggacgatgatgctgagaggatccataccgatgcacatcaagtgcgtctggttctccaatatccaaacaccctggttagtggttctccaatatccagttgcgctgactagtggttctcctagtggaactggacgccaagaccaatatggcgattgtgcactggtatgtagtatgaacatgagcagggagcggcgtagcataagctcggctgggcgtccatgagatcgttggtggcgaagccgaccttgtcaaggttgtagctcttgttgtcgagccggacacaggcgacacacacttcgtggttgagcccgacataaggcatgcgataggctgttgagctctctgtagatctgtgtcttttctagtaaacaatttaacaataggtggtatgcatgaacagatatagcatcattttttttctgaatcagtaaatagaaagggctaaattagtacgaaaaaaaaaaaaaaaaaggcccctagg

SEQ ID NO: 60317 - DNA, 394 bp, Triticum aestivum
  Clone ID: PAT_TA_60317
gccggccggttcgggagccacccacccgcgctgaagcgttttgctcctctcttttttctgttctcgcctcacggcagcggcggcgattccggatcggagcggcggcgcttgaggcgatcccggatcggaatgggggcgctcgaggacccggagaacggaggcgccagcggcaagttacatctcgatccctctttgtactagatctgattcatctttccctttctctcaagctagcacggaggagcaccgagccgacgaatagaatcagcaagccagccccgatttgatacatactactgatctgtgttaatccatgtcaaaaaaaaaaaaaaaaaaaaaaaaaaaaaaaaaaaaaaaaaaaaaaaaagaaaaaaaaaaaaaaaaaaggccccta

SEQ ID NO: 60318 - DNA, 651 bp, Triticum aestivum
  unsure (1)..(651): unsure at all n locations
  Clone ID: PAT_TA_60318
gccggccggttcgggccgtccgttcactcgagtcgcgcgctcggcgttgcatcttcacctctgctcagctaaataagtggctgcttttgccaaacatctcttggacggaaacagagttgaagaagaaagacaaggcgatgaagcctctcccggtgaccctggctctcctgaccctcttcctcgtcgcctcgtaccaggacctcaccgtggccgcagatgcagatgcagatgcagctggagctggagatgttggcgccgttccggttccggacagcgtgtgcgagggcaagtgcaagaaccggtgctcgcagaaggtggccgggcggtgcatggggctgtgcatgatgtgctgcggcaagtgcgccggctgcgtgccgtcggggccgttggcccccaaggacgagtgcccctgctaccgcgacatgaaatcccccaagagcggccgccccaaatgcccctaggactagggcgcttctttttctttcttgggtggaatgggatcttgacgagccgggtgcgtgggatttaggggttccccttgtttgtaagcttgatttgttcgggataaacaacgcagatccggtttgagtaannnnnnnnnnnnnnnnnnnnnnnnnnnnnnnngaananaaanaaaaaaaaaggccccta

SEQ ID NO: 60319 - DNA, 735 bp, Triticum aestivum
  Clone ID: PAT_TA_60319
gccggccggtttcgggatatttcccctactatggctggaagcaggccaggtggactagtcgcaggagcttgggctgcgatgatgtctcttggattgaatggttatttggaaagtactggtaaaatcatggaagtctcaaggaagatacaaaaaggaattgatgatatctcaggtttatttgtgattgggaagccagacatgaccgtcgtggcctttgggtcggacgcagtcgacatatttgaggtgaatgacataatgtcatcaaaaggatggcacctcaatgctcttcagagacccaacagtctgcacatctgcgtgacgcttcaacacacggctatctatgaggaattcctcaaggacctcgaggattctgtgaacacagtgaaagcgaatccagggcctatcagcggggggatggctccgatctacggcgcggctgggaagatgccggacagaggcacggtcaaggagttgcttgtggagttcatggacagctcttgctaaccattgactataccccattggttggtcatctctctgtaacatgcatatgtacaagccgcagtgacagtgttgtgtgatcttctatatttggtttggctcaaaactgaaggcacacaacacaatgcctccaatatagacatgtatctatgtatcagttacattggtcgcaataaagttacattttcagcctattgctcctatatacaaaaaaaaaaaaaaaaaaggccccta

SEQ ID NO: 60320 - DNA, 358 bp, Triticum aestivum
  unsure (1)..(358): unsure at all n locations
  Clone ID: PAT_TA_60320
gccggccggtccgggtgcttaaagagtcccntgtaacactgtggaaagctagctcagacgtgcgccgatggtgtgatgccgtgccgttcaacacttgaacatgcgcgcgtgctggaagccagagcacgccaccccacagcactgtaatgttcatgttcgttctttcgctttgttgatgttgaaaatcaagtttcattttctttttaaatgaaaacgaaggaaggtttggttttagaccaacatctcctcgcgttttgtcgctgcaatgatctgataatatcctggcatagacctctttcaaaggaaaataaagaaaggttattcacagttgcaaaaaaaaaaaaaaaaaaggccccta

SEQ ID NO: 60321 - DNA, 834 bp, Triticum aestivum
  Clone ID: PAT_TA_60321
gccggccgggtctcggaaaaaaaaaacccccggcgagtctgtctacggcgagaagcgcatcagcgtcgacgaggtcgtcaagaacgacgacggaaccaccaccactaccaagatcgagtaccgcatgtggaaccctttccgaagcaagctttgcgctgccattgctggtggtgctgatgagatctacatcaagcctggctctcgcgtcctctacctcggtggtgcctctggtacttccgtctctcacgtcgctgacattgtcggacctaccggctacgtctacgccgtcgagttctcttcccgatccggccgtgatctcatcaccatggcttccaagcgacccaacgttgtccccattgttgaggacgcccgtcagcctgcccgttaccgcatgatcgtgcccatggtcgacgttatctttgccgatgttgcccagcccgatcaggcccgtattgtcgccatgaacgccaactggttcctcaaggtcaacggtggtgtccttatctccatcaaggccaactgtatcgacagtaccgctcctgccgccgaggtcttcgccgctgaggtccagaagatgcgagctgagtccattaagcccaagttccagcttaccctggaacctttcgagcgtgaccattgtctggttgccggcgagtacttgcgctacaagtcctaaatggcttaaagagtcatgctgctgtgtatttcgcttggaatggacattgaaagagatggtctgctttgtcatgcggtttcccaggtatctcacggttcccggtagacttatttgtcttcagcttgctgcatcagggaaaaaatgggttgacgcttttc

SEQ ID NO: 60322 - DNA, 617 bp, Triticum aestivum
  Clone ID: PAT_TA_60322
gccggccgctcccgcactacattcaattgagatcatcatcatcctcgaatccaatctcatcttcttctccttgaaatctttttgggtcatcagatatggatgagtcttagaactgtggattcagttgcagttgctggtcatactgtaagtgcggcaagattgccctgatctgacggaacacgacttagtcgccttccaggacatcgccgtgtccgccctcggcgtgatacctgagaacaacgcgccgaacttccatgtgaacaccggccaatcctgaaagggctgtggatgctgcaacaactgctattgtaacccctgtaactgttaatctgcatgcactcatgtgatgttgtgagacaatacgtgaataacgagcgtacctctgatctgatggaataaaacaacgatgtatgtgcgagtgcttgtgcattacttgatcactctccgccaatgctctgcccttgctgcacttgtgcatatgtgagagcacgcgatccctgtaaatgctctcatctatctccactatggatgaatcgatgaatatgtaagaatgaatgatttacctacttaactactcctatatcgcgagacaccaaatttaaaaattgacctagaaa

SEQ ID NO: 60323 - DNA, 573 bp, Triticum aestivum
  Clone ID: PAT_TA_60323
gccggccggttcgggaaaccaaacgagcatcagctcactgagacagttcaagaaaatcaaactagctctgttcaacttcgcaagtccactaggatcacaagtcagttttcactcccagcagcgcggcaagaacaagaagtataggagaagccatggctggtccggcgaaggcatcgtggatggtggccatgagcgtgggcgcggtggaagcgctcaaggaccaggccgggctttgccgctggaactatgccctcaggtccatccaccgggcagccaaggccaacgtccgcggcggcgtctcgcagggcagcaagcagcttccggcctccgcgtcggcggtggcggagaggcggcgagcggagaaggccgaggaggggctgaggaccgtgatgtacctcagctgctggggcccaaattaggagtactagttggttaggggtgttgtgttcgttgcagcttgtgcttatagttatgcgacaaccccatgaccgtttgtaaatacagcacgatgatgatggtgatgaaaatttcggctatgagtttatataaaaaaaaaaaaaaaaaaggccccta

SEQ ID NO: 60324 - DNA, 526 bp, Triticum aestivum
  Clone ID: PAT_TA_60324
ctgtgcggcgctcgaggcggccggtcgggacagtttgtccacagcgcgccgagtttggtgaccacaacatctatgttaccacgcatcgggatcgcgagttatacgccggaggatggtacacgaaccagtcgcgcggaggtactggtgtcaggacctgggcggagagaaacgagacgcttacacccgagtctgatattgtattgtgggtgcagtttggcatcaaccatattcctcgcattgaggactttcctgtcatgccagtggagattctcaaggtgcatctcaagcccgttaacttcttcaccaagaaccctgccttggacgtgcctcctagtgagcaaagagttaacaagagtactctgatcgagacaacaaaggtagaggcgacggccggagactgtggttgcgagtcatcctcagtccctgcaaagctataacttagtcatctcaatatacaattattagtcgcagaattgtaagcgattttgtattagtttatcaaaaaaaaaaaaaaaaaaggccccta

SEQ ID NO: 60325 - DNA, 760 bp, Triticum aestivum
  unsure (1)..(760): unsure at all n locations
  Clone ID: PAT_TA_60325
gccggccggtccgggatctatcctactncacaagcatcactcgcttccatatacaaacaaacaatattgtctgtccgtcactatctatcaatatcaactaccaacaatggatgccccttcaacctccaactcttcggctcaacagtctccttctgtccagatggttcctcagccagctcccaccaaggcaacaacccatcaaccgctcctttccttcaagactttacactcattgccgaggctgcaaagcgagctcagatggccatcatgatccgcgactttgaagattgtggcctgtagagtcaccatcaaaaagccatgcaatccaacaaggagaaaaggaaaaagatgatcgaaaccatgcctatctcgatcaaaagtcaactctacgaatcacttgagagaccttgattggggggaagatatgcagcagtggcatgtttggcttatcccgccttaccaatcacgacgtccacgggccatattcacattctttgtctctctcgtctcactcacctccaaccactttctcatgcatcaccatcacgactagaaagtggtccccgtcaagaaaaaaaaaagatgacatggatatggttatcttttctcggctctattccgactacgactactgcacaacaacgcacgcatctcatgtgggccatgtctttatccccattcgggctttgatccgaccgaagagaagccaacgcttgctcggctcggttcgttcctttctcgagcttctctagttcttgtc

SEQ ID NO: 60326 - DNA, 635 bp, Triticum aestivum
  unsure (1)..(635): unsure at all n locations
  Clone ID: PAT_TA_60326
gccggccgggccgagaccacttaagcagctagctatagctcatctccatccatcgcatctcttcttcctcaatcctccactacaaacacccacccaattcatcaatggcttcatctctgaaggtggctgctgccctcgccatggccgtttgcgtcgtgcttgtgctgaacatgggccagcctatggcagccacagaatgcaaagattgtctcgctgactgtgttgacgtttgcgtcaactactctgacactgcgtgcagcggcatctgcaccgccaaacctcctgcatgccagtcatgcaagtacgcgtccttccttacgtgtggtggcacatgctacagcgcctgtgcccatttctgctaaagcctatagtggctgtaagctgcctgcgtgtgttggtacctcgttgttgctaagccatgtaattaagtgaacaaatgctattgctctgtgcatatggcaaatgttccttcgctctattgttcctctttgttttatcgttccgctttgtttcaaccatcagtaaatatgcatgtatgtgtgcaagtcatctatannanannnannanaaaaaaaaaaaaaaaaaaaaaaaaaaaaaaaaaaaanaggcccaaaaaaaaaaaaaaaaggccccta

SEQ ID NO: 60327 - DNA, 365 bp, Triticum aestivum
  Clone ID: PAT_TA_60327
gccggccgggtcgggcctatgaaccaaagggctctaaaggaaaaaatcctataaaattcctatcctctaaaattcctatgaaattcctccaaatcaaaggaggcctatatctttcgtgagatgataacacctaaacttccatctagaacttcgccgaaaccttacaccatcatgagatttctcagtatcttccaagataatgaatgtactgaaaaatccttaccggtagagatgttccaaaccaacctgtcgtcatcataagatatctcactatcatcacgttgctgactaatcttcaatcaagcatcacaccagattatacatcttcaggtgcatagcaaaaaaaaaaaaaaaaaaggccccta

SEQ ID NO: 60328 - DNA, 745 bp, Triticum aestivum
  unsure (1)..(745): unsure at all n locations
  Clone ID: PAT_TA_60328
gccggccgggtcgggaatcctcccctgaaaaggcggatgctgcattggcgcatgctattantgtgggagggaacaattcatcttacttggtcttcactcacaaatgttgttgctatcttcaaaagcggtgaaaagccatctaccaatgagtggccccgctctctcgagatcaagaaaagagtgagcctcggtgtttttgaaaaattgcttggactgcttcgtgaatccaggaaacgtactataatggtaactgagttgcgttggaaggagggctctattgagagtggtcggcatcatctcttaaagaccatagagtcgtatactgccaatgagagagtagggttagtgaagccaaccgaagaggtggagttgttcctctgtccttatcaagggaaggcagctcagatacttgctgacaacctgctaaaggagttgtggtgtggccaagaccccatatctcatctatggtagtttaaatttgtgcaatctgcaagcgtctgtccgctttgatgcatggttgccttgtccctcgtccactcatcagttaatatatgcaagtatcataagatctgcatattgagatggttttatgttatgttgtgtcagaacctcgtgcacctagccatcttggtttgtttcccttcccagggagtcaagtacttggtatatgtaactgcaacaagttgaatgctaaaattgctatgtttgggtgctttcttgctgaagccttgctatttatgctagc

SEQ ID NO: 60329 - DNA, 437 bp, Triticum aestivum
  Clone ID: PAT_TA_60329
gccggccgtgccggggcctatgtgtcacgactcaaatggtattgtcatctactcatctctattatggcaatggcactttttgctaaaaaaaaaaaaaaaaaaaaaaaaaaaaaaaaaaaaaaaaaaaaaaaaaaaaaaaaaaaaaaaaacaaaaggcgccccgaacggccgcagccgtagcgagaccccgcgcccccccgggtgcggcagccccagcattatcatactcatcaacctccgaggatcctcgcgggggcccccgtcgccctatcccgccaatggggcgcccgattccgcggcccccctggccgacgtcctagaccgggaaggctgaggagctgccggctcaaccccgtgtggcgcgtccccctctcccctcttgtcgcagttgttaaaggggccgaggcggtccgcccttccccccccttcccaatggt

SEQ ID NO: 60330 - DNA, 839 bp, Triticum aestivum
  unsure (1)..(839): unsure at all n locations
  Clone ID: PAT_TA_60330
gccggccgggtttcggaaagaaaaaaagaaaaaggaaaagaatggaaaaagaaagaaataaaaaataaataaaaaaagagagagtaaagctctccatctggtcactattcgcacatgttcgtgacttcttgataggtgtttgtccagttgttttatgttctttcagtaaaaagttagaaatattaattgtgtaggttgattgcctgatatttgtgttacatatttggaaatcaatatggcagaagtagctcccagcaaaaggataaaggaaacaaaaaattgtaagggaaagaatacaaatccattatatgggttttgtgtggtatctttatgaaagatggttgtatgattcttttatgctttttaggaattgggagaaatattaactgactagaattagttgcctaatagttgtatcactaatttagagagggaggagtacaggagcaggtctgaatagtgaaggtatagctcccctttgtgctggattaaaaaaatatagagtgggcgaaatacaggagcatgtccgaagactgaaggtatagctccggtttgtgatgcattattgaagtatgcaccctgcactatggtatagtgaggttaatacaggtatccagttctgtgtagtagcgtgttcagttaagtgttgcctaagtgttgcgttttactactactaggatgttagtactactattagtttctgaatctgtgtgcttgtaccgatgctaaactaggtgtggacaatggttacatccctctgtaatcgttgctatgntctataaaacgntgcacctatggattacttactttgcattaaaaaaaaaaaaaaaaaggcccct

SEQ ID NO: 60331 - DNA, 833 bp, Triticum aestivum
  Clone ID: PAT_TA_60331
gccggccggtccgggccttggcacatcaaaagagggcggtctgcttcagaccgccaatagtttctacaagagttttgctgtggagtgttcgaagagtcaggtgtctatcgacatgttcctcttctcgtcgcagtaccaggatgttgcttcgctgagcaaccttccccgatacactggtggacagacctggttctaccctggatggcacgcttcgcgacctgaagatgccctgaagttcgcatccgagttcagcgactatctttcgtctgaaattggacttgaggccgttcttcgagtccgtgccaccagcggtctgagaatgaacacgttctatggaaacttctttaaccgaagctctgacctctgcgctttccctgctttcccccgcgatcagtgctacgttgtcgaggtggctatcgatgagaaccttacaaagaacgttgtttgcctccaggcggctgtgctacacacaacttgcaatggcgagcgtcgcattcgtgtcatgaccctggctctccccacaacgaccaacctgtccgacatgtatgcctcggccgatcagtgcgccatcaccacttacttcagccacaaggcttgtggagcgatctttgtcaagcggcctggatgcggcccgggatgctcttcagagcaaggttaccgagctcttgcagactttcaagaaggaactcgctggaggcagcatgggcggcggtcttcagttccccgccaaccttcgcggtctacccctcctgttcctgggtctgatcaagaatgttggtcttcgcaagtcatctcagatcccatccgacataagatcagcagctctctgtctc

SEQ ID NO: 60332 - DNA, 752 bp, Triticum aestivum
  Clone ID: PAT_TA_60332
gccggccggttcggggtccatctcgaaagcgatgcgcaactccacaacaacaaacgtgcgatgataacttgagacgcttccatcatgtctagtaaaagacattcgattcttcctgctatcgatcgcagcggtcccagaccacccgtccatttctcctcgaccctcacaatctccgacaatgcgatcctccaaggaacacactcgatcaccatgcagacggagacagtaatccaccctcggtcgagattcgagtcgaactacgggtctatcctaatcggccgtcgatgtctggttcatgaacggacgcatatgggagctcgtcctgcagaccccactgcgaagcccggtggtatcgtgttagcagactatgtcacaatagaggctggctcgaccattgaagctggcgggaccgagataggtgagggcactatcattcaagccggaacaatcgtaggaagcggcgccaaaattggcaagaactgcaccatcacacacatgtccaaaattgctcctggcactatattgccagacaatacggtagtgttttcgaacgggactagacgaatcgaccgacgtgagctttctgatcaaaggaagattgctctgattaagcaactcgcaatattgcgaaagatgatacccagcaacccggacaaatttaaatagagatacccagcaaatagtcatggccaatttgatatttataaaacattaattcatttgtcacaaaaaaaaaaaaaaaaaggccccta

SEQ ID NO: 60333 - DNA, 798 bp, Triticum aestivum
  unsure (1)..(798): unsure at all n locations
  Clone ID: PAT_TA_60333
gccggccgggccgggaacccggtccactatccagatccatattctctatcctgactctgctcctgcgatccccaaccccaacccaaggtatatgcgtgcaccaagaaccgtctctgtcccgtgctaccgtgtgtagatctgccgagaacggcgctctagtttctttttgatctgcaacctttttcatctctgtttcgcgacaccaactcacgactggatccggtcgctggtctgtccctgatctctgtgtggttttgattttgatccaaccaggccaacagcaacagggaaatcatgagcgccatggtcgcgtcgtcgctcaaccctgaggccccgctcttcatcccggcagcgttccagcaggtggaggacttctcgccgcagtggtgggacctcgtcaagtccaccgcctggtttcgcgaccactggtaccaccagcaccagcagctcgacgatatggccgattccctcatcgccttcgaggccgaggacgccatcgacgacgacctcttgcacggcttcgccgtcgaggcttcgcagccgcagccgccagcggcactcaagactgacggggtgctcaaggcgctgagcctggcatccccaagcccaaaggtcggcaacgccctgcgtgtcttctcggagaagcctaggtacaccgagaagcccaccaagtacgctggcagccccgaggagcggtggcgcaccgcgtttcatccaccggcctcgctagggtgnngatgtcagcttcaagaatccacaaatcctgcgncttgtgtcatgcagtgatgcattgctctg

SEQ ID NO: 60334 - DNA, 305 bp, Triticum aestivum
  Clone ID: PAT_TA_60334
gccggccgggttccatattctggtgtcctaggcgtagaggaaccacaccaatccatcccgaatttggtggttaaactctactgcggtgacgatactgtaggggtgttaatattggtgcgagatatagtcccttatagttgactgtataatcctttggttccgtcactacttatcagtttggcattgattggtcagtcagggaatgtagaatttcttccaccgttcgatatttggagtactactgcccctatgtgtgcgcgtatgcatttttttatttgcaaaaaaaaaaaaaaaaaaggccccta

SEQ ID NO: 60335 - DNA, 736 bp, Triticum aestivum
  unsure (1)..(736): unsure at all n locations
  Clone ID: PAT_TA_60335
gccggccgggtcgggaatccagctcagctcaccacgacactcactcactcacggagtccgacctcattcaaacaactactttcatacacaaagatggctgacgccggcgaagaacctcatcatgtgtcggagcctctcgaccttgtccgacttcttctcaacgaagttgtctttgtcaagcttcgaggagaccgagaactcaaggggaagctgcatgcttacgacagccattgcaatctggtcctaggagaggttgaggagactatctacaccgtggatgaggatgatgatgacgatgagctcaagactatcagccggaaatccgagatgctatttgtgagaggtgacagtgttgtcttgatctcacctggagttcccttttagaacaaacgactagactattatacactatgccatccaacatatgcacagcctggctcaacatgtgcgataacggaacatgtcgcatcacatgttagccaaaggcaatgaatgagctgcacacgtcatgccgagagcagctcaaccaaaccaagatcacgttctggccgggatttagggctgagtttttttattgttccacactcttcggctccgttattcagtagtanatgtcaagtcaaaaagctgaaatcccacctcgacagacccagctcaagggttagataggccatcaatagcacgaaagattattgatgaaaaaaaaaagtaaaaaaaaaaaaaaaaagggccctan

SEQ ID NO: 60336 - DNA, 498 bp, Triticum aestivum
  Clone ID: PAT_TA_60336
gccggccggttcgggattgaaaggttcaagaggaaacttctaagagtagatcagataggaagccaccaggtgttggtcgtggaagaggaagaggagatataggcactaaacctggaggcagaggcattggtcgtggccaagatgatggcaaaggcggtggccgtggaaggggcggaattggaagtaaaggtggcaacaaaggcggacgtggtcgtgggtaagacggatcttgagatgcgagaatgccgctttttaaggcctgtagttgtggtgttgcatagattgcttaggacatgaaaaactttggagctggaattgctgggttttgcggtatggtatggcaaacggtttgtgtggtatgaagttaccgaggagttggatgtcctaatattttgggtatgggcattatgcgtactagtcaacatgtatttgcaaagttccagcccagattttacctatttgttggttgtcgaaaaaaaaaaaaaaaaaaggccccta

SEQ ID NO: 60337 - DNA, 302 bp, Triticum aestivum
  Clone ID: PAT_TA_60337
gcggcccgctccgaggccggcccgggtcccgggaaaaaaaaaaaaaaaaaaaaaaaaaaaattttctgatatcagggttattcgaggctcttaatttcaaacacattccagtaattaactattgactataaaagcttttattattgtctaggatgcctggttgggtataaccgaataaagaatgagcttgggtataagccgctgggggcataaaggcttgaaaaatacgattgcatttagtttactgaaattttgttgggttgccttcaagaagccaaaaaaaaaaaaaaaaaaggccccta

SEQ ID NO: 60338 - DNA, 825 bp, Triticum aestivum
  Clone ID: PAT_TA_60338
gccggccgggccgggggattccagaatatccagaacacaccaccccgcacaatgtgttcttgtttctgcttctctcccgaaagaaacaggagcttcgagtaccctcccaaattctcgcggccgacctctcccctctcttccccggtgaacgcgggatttgagttggatctagccgtgcaggccgccggagacagagatgatagtgacggttgttgccatatccgagtctgttcgatatagcccttttttctgtgctgcccatggaggattagaggctaccagcggcaggactggcatgagtaggcctaggtgttgcgggcgcggaggatttctgacggtggatagagggcagcctcacaggttggcgctgttgccagggacagcaagggccacgttttcgtctctgtatgcagaatgctgacccccagtcgaagtgttgaggaggccgaggcaaaatctgccctcgccggactgcaggctcttgcaaaatactacatcgggcctttgatcctggagatggattgccatgcaatcataaaagagctagctgcgggagaccaatccagatcacagtgctatgcctgatcaaggatattaaacaagcactctcagtttttcagcttacagtgtcagccatgtggtaagaacttgcaatgctcatgctcctgagcttgcagcggcaaccagaaatgtgagcgaccaggagatcatcgtaaacgtcccggataaactccgtccactgatgatgtctgaatttgtatctcatgtagagtagtttcctactctagatctaaaaaaggggcagccatgcagagatgtcactga

SEQ ID NO: 60339 - DNA, 539 bp, Triticum aestivum
  Clone ID: PAT_TA_60339
gccggccggtccgggagatcaatcaaccaagcccaaaaatggcgcagctgcaggagacgtacgcgtgctcgccggcgacggagcgcgggcgcgggatcctgctggcgggggacgccaagacggagaccatcgcttactgctccggccgcagcgtcatcttccgccgcctcgacgcgccgctcgacgcctgggcctacacggagcacgcctacccgaccaccgtcgcccgcttctcccccaacggcgagtgggtcgcctccgccgacgcctccggctgcgtccgcgtctggggccgcaacggcgaccgcgccctcaaggccgagttccgccccatcaccggccgcgtcgacgacctgcgatggtcccccgacggcatgcgcatcgtcgtctccggggacggcaagggcaagtccctcgtccgcgccttcatgtaagcggatcgcgcgcgcgcacctgcccgctctcttcccttccgcatcgatctcgggctggaaggatttggagataaagcttgcgccatcttttttatcatcgaatct

SEQ ID NO: 60340 - DNA, 289 bp, Triticum aestivum
  Clone ID: PAT_TA_60340
gccggcagggtcgggcaccatccatctcacaagctcaactcaagctcaagctcgcattctacgccagcaaattcgtccatttctcacaacttcttcacccaaaaacacttctaatcaataaccatggctgagatccgccgaaagctcgtcattgtcggcgatggtgcttgtggtaaaacctgtttgttgattgttttctccaagggcactttccccgaggtttacgtccccaccgtcttcgagaactatgttgccgatgtcgaggttgacggcaagcacgtcgagctcg

SEQ ID NO: 60341 - DNA, 519 bp, Triticum aestivum
  Clone ID: PAT_TA_60341
gccggccggtttcggcttctactgtggaagtccaaagcttcacaacaatatgggagttattcttccaagggaacgcaaaaagcaagaatatctacatgctgtcaaggcgcggtataatcaccttcccgaaatcaggcggattgacaaacataggcacttgcctaagccaatctacaaggcaggcaagataaggcgcgccatgattgatgcacaaagccggaaagaagaaagaaggcgagcgcacagtgctccagggagcaggactatgcagcccttcaggaagagaaggctcatcacagaagttgagtacggtggatctgaccatggcgaggccagacaaagtggcattctggcgtattatttttggtcgagtgtgagtgatggcaagttgggatcatattattattatgtggaggaggagtattttgttacttgcaaaccttagacgacacaccagattatatttgagaaggaaaaaataaactttatcagcaaaaaaaaaaaaagaaaaggccccta

SEQ ID NO: 60342 - DNA, 606 bp, Triticum aestivum
  unsure (1)..(606): unsure at all n locations
  Clone ID: PAT_TA_60342
gccggccgggtcgggaattcaattgtgctcatcatcatccccgataccaaagctcatcttcttctccttgaaatctttttgggttcgcagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactccttanaaaaaaaaaaaaaaaaggccccta

SEQ ID NO: 60343 - DNA, 603 bp, Triticum aestivum
  Clone ID: PAT_TA_60343
gccggccggtccgggaacccatcatcccccccattgatatctatcaagagatccccccccaacactcgatccacctataactcccgccagcctccatctctgctactatgcatatttttgcgaagactctctacgatgatatcatcccacctgctcccaacactcgctgacacgattgacgatgccaaggctaacaccccaaagacagcagatatcccgcccaaccaccatggactctcctttgctcgcccactctgtcccagatggctactcactaattgaatacgacatccatgaatacccccccctccacttggtgctccatatccgtcggcgaggtgtcacatctttctcaagaccttgactcgcacaacaccgtcaccgccggacggagacaatctgtcagacaccaacacaccacgactcatgtcgaacatccataatcactgcgtgtgtcccaccggaccatgacgaggctggatccttgatcgaagaatactcttgctgcctggactaacactgcaactgtacatcgttataactgagtctactctccacctgatgcttcgactaccagtgggcctccgaggacttattattact

SEQ ID NO: 60344 - DNA, 757 bp, Triticum aestivum
  Clone ID: PAT_TA_60344
gccggccgggtcggggtggttcctccccatcagcaccacaagccccggcgtgcacctgccccttcccacctctccgtcgatctggcccactttccggtttgaatccgagccgtggctcgtgacgtcacgtgcgtcctgatccgcgggccagaaaacacgctttccggttaggtcgacggtggccgagtaaatgcgatgggcaagcgggtctccctggttcagttggtcggctgcggaggctgagctcggtgccattcgatgcgtccgaaggagaggaaaacgatccttgaatatggagtttctcttgcagttgattaagagaagaaccatcatggttcctggaggaggtcaatgccaatgagattccgattgagcttctgcagtatccagtactagcacctgcaccagaattgcctacgcagttgtcaatggaggagctgctgccttggcggcgaacatcggcgggggtcaaatctgtgtggcggtgggggtggcggacggtgaaattgcactctaacagacgcatgcttcggaatagtctgagtagatcggcccaaaagcgcctagatggacacaaaggtttggagtcatcgtgttagttcagaatttttttcagaaagtttttggtgtcgtacaagagtgcaaggatgatgggatgactgcagtgcgtggcacatgaaaaagtagataaaacagtgttggtcagatggatattccatctcctgcacccctgaaataccgagaacatattccctaa

SEQ ID NO: 60345 - DNA, 546 bp, Triticum aestivum
  Clone ID: PAT_TA_60345
cctgtgcgccgctcgagccgaagccttgggaaggtctcggcagggatttgcttaagaagctcacccttatatccggatccgagaatgttgatcttggaaacggtgacggggtccagccagcccttaacgatgctccagacagtggagaaaccccaaggggcgttgatcatatacaacttgccaaggcgctcggggtgagtgccagtgtgagggtggctgtgagaacagcgacgctggtccttggcacgaggctgagtttgcccgtcctgcttggtgggagaagaagcaggacgccaatgttatcgagaacaagggctctgagattgaggagcccgcaaaggcccctgaggctgctcctgttgccgagggtgctgacgccacccagacagctcctgcccctgcccctgctgctgcttaaaggataggaggagatgcgtgatgggattgatgtcgatgaaagatagacagagcggtttctctgtgtcttaatatagaccgcatactttctctcgtttattatagaaaaaaaaaaaaaaaaggccccta

SEQ ID NO: 60346 - DNA, 660 bp, Triticum aestivum
  unsure (1)..(660): unsure at all n locations
  Clone ID: PAT_TA_60346
gccggccgggccgggtatagaagacatacttcagagcaaaagcgctcggcacatcaagtgggcgaccatggcggccccggtggctctcaccatattcctgctgatcctcctcccagcgcaccatgctctcgccacggcggccggcgacgtgcacccaggctacgcggacgcggagaccgacacctgcgggccggcgctggacctgggcggctcctcctcctcctcctcctctgccgcaggcgcggccggtcggcgttacggcccggggctggaggagtacggcggcgggcgcatcgtggacatcacgcacgcgttccggcctggcatgccggcgtacgcgccgggcgcgacggtggggcccatcgtgcggctcaaggagtcgatggagaacgggtcagactacaacttgtcggagctcagcatggagtgccacataggaacccacgtggacgcgccggggcactttaaccaggcccacttcgccgccggcctcgacgtcgacacgctcgacctcgaagtcctcaacggtcctgcattactcgtcgatgttccgagacacacaaatataacagctgaagcaatggaatccctanatatacccaaaggtgttcgtcgagttctcttcaggacattgaacacagacatgggactcatgtggaa

SEQ ID NO: 60347 - DNA, 749 bp, Triticum aestivum
  unsure (1)..(749): unsure at all n locations
  Clone ID: PAT_TA_60347
gccggccgggtcgggcccctcatatgcactatgcagatatccagatgaagatgctgggcaactgccaatggcttttatagtgaggcaaccaggttcaaaccttactaggcaacaagtcatagattacgtggctaaacatgtaagtttctccttctccttatcttaatgccgctttctaccacatagttcaatgctgagttaagactgtcggtcatagtcagctttattttactttttggcaagcaagctgagcaccatgattgcaagttgagataggtcctagtaatgttttggtattgttagtgacactgtctctctgcctattaaggcattttaacatttttttccgaactgcaacactgaaatagtatgtagcatgttgttgcaaaagctatagaggactggtggtgggatcatcaaattgtatcactgcgtgccaaacgaagccacatgtcaacacacgagcgaattctacatgtgtggtatgcacacaacacatttagcaacacgaaattgtagttgatttgaagatacccacatcaatagtaacaaaaaagaatgcatcaatgcacctttatgtatgcagcatatgctttctgacaatgcattgccacttactagacactaaaagcacatctaaatgtttatcgtttgacaggttgcgccctacaagaaagtccgccgagtggctttcgtcaatgcaataccgaaatcgcctgcgggaaagatcttgncgcgcgagcttgtgc

SEQ ID NO: 60348 - DNA, 737 bp, Triticum aestivum
  Clone ID: PAT_TA_60348
gccggccgggtcggatagcgccgccgccgcggcatctcatatctcacccgtagcccccttggccgattctaatagcacctccacggccccccaactccaatgcccacgctcgctttccacgggatgaacgccgcctgtctccaacgcttgcctctccattggatcgccgccactgccccacggacgcggtcgtcgtcgccgtccgccgctcctccactcgattgccgctcaaggatgcggtcactgccggcatctcctggagcgtgggtcgtcgccgcccaccgctcggctgctgccccatggacgtgcttgcccacacccctacatccgctggcctctcctggagcgcgggtcgtcgttgccgcccgccgtcgctgtcgccacacgcagtgcattgaggccctagccatcaagagacatctttccccgtgaggctggagtaagacaagttgcagagggagttcatcatgtgcctggattgcttgaagcacgatgcactaatatggatgaggcctggggcatcctgcaaactggaagcaaagccaaagttgttggttctacaaacgctaacgagcacaacagccggtcacactggttgttcaccagatttttattcactcgcactaagttgcagaccataaaatcccgtcctcattaattttccatacattatattgtgtgaatgtgatagtcaaaggagaaaacttgatgaatggagagccatatccgctcttgcg

SEQ ID NO: 60349 - DNA, 390 bp, Triticum aestivum
  Clone ID: PAT_TA_60349
gccggccgggccggctcttgtgtgctgccgctgcagttgcgtgacacgctcgcctaacctccgcaccacatgccgccgccctacatgttcaacgccgactacatgatgaaccagtaccggccggcgccgccggcctacccgccgccgtacgtgccgccgcagcactactacgtgcggaacatgagcatggaggagaacccaaactcgtgcgtcatctgctaagtcaaagtcgatccctcgatcgctcgcgtacgtacgttccgtggggcgaccatgcatgcatctgtgtatagtagtattttctcgatcgtttttacgagaccagcaaagtttgcaaaaaaaaaaaaaaaaaaaaaaaaaaaagaaaaaaaaaaaaaaaaaaggccccta

SEQ ID NO: 60350 - DNA, 508 bp, Triticum aestivum
  Clone ID: PAT_TA_60350
gcggccgttcgagaaaaaaagtggaacctcctttgcagcatttggaccactagaggccctcccttgcccaggttcaacaagactgttaaatgcaatctatagtgcaggtcactattctgaacaagttcctgttctgcacgcatacaacatactagcgtcttgctgccgcgccatatagattgataaattgatttttctctaaagtagattttgcagttagtccgtgttactggagattaaagtttttcagcaggattacttgggtccaattagctgcgtggaagtggctgtgtagtgttagagattaaaatcacccagtagtgctttttcaacggagtcatgttactcgattttttttaaatgcttatagcgccttctagatatgcttgtgatgttttgatattaattttgtttttcaaaatcagaccagatagtaggaaatttgtattgtcttgtgaacaaatgctattttttgaatgagtaaaaaaaaaaaaaaaaaaggccccta

SEQ ID NO: 60351 - DNA, 766 bp, Triticum aestivum
  unsure (1)..(766): unsure at all n locations
  Clone ID: PAT_TA_60351
gccggccgggctccggcaactcaaaagatggagttaatgtcgtgagtggagactcattaatcgaatgtgctaaaattgctaatgaatgtgcaaaggttggtgcagttggtataaactgcacacctccaagatttattcatagcttgatactctccattcggaaggtcacagacaagccaattctgatatatcccaacagtggagaaagatacgatgccgagagaaaggagtgggtggaatccactggtgtgtcagatggcgatttcgtttcttatgtaagcgagtggtgcaaagatggggctgcccttattgggggttgctgcaggacaactccaaacaccatcagggcaattagtagatctcttaaccagtactaccctgcgccttaggtatttgcggcacagagttgtaccctccttcagatgggttactcctggtgttactttatcaacatgtccctgagatttagcaatagctgtgtgatgttctcctgcaaaatgagatagctgtgcacttacatgtgcgaaatggcggtgtgtttctagcaaacagtaagctgtactaaggagtgatcgcaagcagtaacagcgaagttgtactaaggagtgagcgaaactatctgcggcgaggttcatgaccccttattacctattaagagagtttgaggcaatgtatgttatacagattctgagttgttatggaggtattaacctgcaataagctgctatgntgttgggtgctgaaaaaaaaaaaaaaaaagccccta

SEQ ID NO: 60352 - DNA, 630 bp, Triticum aestivum
  Clone ID: PAT_TA_60352
gtgcggcgctcgaggcggccggttcggaagatcgactacttctacgcaccatattccatacatgtacgccaccatgcataatgtagctcaccttcgtcctcctcctctacatgctggtgaagtttagcgacgcgcttgacatctgcgacatcatccggtggatacaggaaggcaacaccatctgcatcaactacaccgaccatgagatctactcggtgcatgtgcgagagcccacctgatcaccgaaaggagtgcgtggtccacctggacaacaactccatgaacaaatgcacccttgactagaatggattatgactcccccgaatattagcgtctgcttctccggttgaggtcaagctaaataaacgctgtactgcgagtaacgaccacaaatgaaagtcttgtgtggtagcaatcgaatgcaatgcaatctgctccaaaataaagacaaagatatgcccctatggcgcacggtggctctatagctagaagacatcccccatggatgccggaaatacatactttctttatcgatcatcgtcgacctccaaggagtgcccgggacaccattcaaactatcactgaatctcattatccgcgatgcctggtccaagttttacaactccgaga

SEQ ID NO: 60353 - DNA, 739 bp, Triticum aestivum
  unsure (1)..(739): unsure at all n locations
  Clone ID: PAT_TA_60353
gccggcctggtcgggaaaacaacatcgctcaattctgtacaaacatccaattgaatcgcaaatatggcctcttctcaacctacccgatgggctgctctcgctcgtgacaccaacgagaccaagatccaactcgctctcaaccttgacggcggcgatttccctccggacaccgattctcgtcttctcgacaacgatgatagccatgcttcccaggccagcaagtcccaaaagattgctgtcaacactggaattggtttcctcgaccacatgcttcatgctctggctaagcatgctggctggagtctggctctgaactgcaagggtgatcttcacattgacgaccaccacactgctgaggatgtctgcatcgcccttggttacgccttcgcccaggccctcggtacacccgccggtcttgctcgtttcggctacgcctacgcccctctcgacgaggccctttctcgcgccgttatcgatctctccaaccgtccctatgccgtggttgaccttggtctgaagcgggagtggctcggccagctcagcactgagatggttcctcactgtctgcagagctttgctcagggtgctcgtgtcacactgcacgttcactgcctccacggtgacaacgaccaccaccgtgctgagagtgcttttaaggctcttgctatcgctgtcaaggctgccnaccacagaatacctggtaaggagggcgaggtgcccagcaccaagggtactctga

SEQ ID NO: 60354 - DNA, 630 bp, Triticum aestivum
  Clone ID: PAT_TA_60354
gccggccgggttcgggacccgcaaccgccgtctcctctccactttcgtctctcgcactcactctccccctccgtcgccggggcgaggtcctccccgcgagtccgatggccagcaagcggggcaggcccgacgggtaaccgctgttcgcggcgacgggcctcgccatcggcatctgcgccttgcgcctcctccgcaacatcaccgcaaagccagaagtcagggtcaacaagatggggagtgcagctgccactgcttgacaaccatgaggagggcagacgctacgccgagcatggactccgagtctatgtgcaggacaagacccccgagatcatgccaggaatcaactagttcttcaccagcccgaaatgaagcactttagcctgtcagtggctcgctattagcaactgatgtggtcaagtgcaaacctattgcaagcattcaggaatgttggcccgtccataattcagaggatatcatcaagtgccttttattgaacgaaccatgtgatgttagatggattgctatatatgtgatgggcgatgacttctaaatatctgcttcattgaaattgtggatattccatgcttccatttaaaaaaaggccgaaagataaacgccgtgggtccctaa

SEQ ID NO: 60355 - DNA, 344 bp, Triticum aestivum
  Clone ID: PAT_TA_60355
gccggttcgcccacgtacgtgcacgcggccacaaataccacccgaccaccaccacctccccctccctccggtcgcctccggcctcgcctcttttcgccccctccccccccgtcgcgtggcccggtagcccgtccctggcgcctatggcggacgcggaggtatactcaacgaccgcggcggtggtggtgcagcaccagcagtgcgtgaaggcggtgacgtacgtgtgtcaggtgttctgtcggctgcatcggcttactcctccaggtcctggtccagattctccgtggtacgccctcctgcggctagctcctctccttctgtggtttccgctagccgctcctctc

SEQ ID NO: 60356 - DNA, 516 bp, Triticum aestivum
  Clone ID: PAT_TA_60356
gccggctcggtctcgaccccttcatctacatccccaacgggtgcgggagcttcctgggcctgatgcagctcatcctctacgccatctaccggaagaacaagggccccgctgccggcgccgtgccggccggcaagggggaggacgccggcgacgaggccgacgaggtggaggacgccaagaaggcggccgcggcggtggagatgggcgaggcaaagatcaaggtcaatgacgacaccgccgtcgtcgacaaggtcgccgcccaggtgtagccgccgctgcacagagagagtgtgcatgaggtgacagcagcataaggccgctgcttaattagttggtagagctgttatgctaagcagatcgtcggtgtctgccttgttgatttgtttcttgacatggtacgtacgtacatttgccagaaagctggtgctctctccccaaaggccagcctacgggagagctatgagacagtactccgaaaatctcaaattggaaaaaaaaaaaaaaaaaaggccccta

SEQ ID NO: 60357 - DNA, 460 bp, Triticum aestivum
  Clone ID: PAT_TA_60357
ggcccgctcgaaaggccggccggttctcgggtacgagtcaaacaaacaaacctccccaattccatccccattcccttccccaaaaatttccccaccggcgacgacgccctccccaaatccgatccgccgccgcccgccgttgacgccagccatggccgccgccgcccgccgcgccctgctcctcctcctcgccgccgccgccgtggccctcctcgcggcgcccccggcggccgccgcccgcccctgcggccgcgcgcagacgctgctcatctccttctcctccttctcccgccccaacccggaccccgccgacccgtcgccgctcaccaccaccgtcgtcaccgtcctccgcgtccgccgcctcggcccgcaccgcttccacgcccacgaccagaaccgcctccagatccgccgccccccgagcccctccctgccgcaggcaccccccagtgtgatgccg

SEQ ID NO: 60358 - DNA, 660 bp, Triticum aestivum
  Clone ID: PAT_TA_60358
ggggaagggtcaccggactcaaggaagggctccacggcttccatgtgcacgctcttggcgacaccaccaatggctgcatgtcaactggaccacacttcaaccctgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgacgctgatgatcttggcaagggtggacatgagctgagcaagagcactggaaacgctggtgcacgtgttgcttgcggaatcatcgggctccagggctaagatgtcatcttcgccgaccaacgtcgtacagatatgggaaccttttcagaatgcagatttgcaatctctattctaaataagcacatgatctttgatcacttgttagtgtgcaccagtcgtgtcaattcctatgtgttactctgaactttatcgctgtcatttggctatcgagatgtgtgactggaacagttctgtcaattgcttgtggatctgttgttcgctactagctctggacgtgtttacagaaaacgagagaggtaaaaaagaaaaaaaaaaaaaaaaaaggccccta

SEQ ID NO: 60359 - DNA, 459 bp, Triticum aestivum
  Clone ID: PAT_TA_60359
gccggccggttcgggtttctctctgccggccgctaactccggcgacatgtcgccggcgatccggaggtactgcaaggcggagcaggtctcggggcagacgtctgcgctcagcccgtcacgcgagaccgggctgagcaccgaccccaacgccgccggttgcgcggagatctcgtcggcggcgacaccgtcgtctcagaatcaagacttccttgaccaattcgacgagtaccccgccctgaacctcgccgacatttggaagtactgaagccggccggagctgcacctaccacatccacatgattctcgctcgatcggttctggctcgttgattaattactgaattggacgcagtaaaacaatccgatttgaaaacttaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 60360 - DNA, 630 bp, Triticum aestivum
  Clone ID: PAT_TA_60360
gccggctcgggctgcgaccaaaccaaaccaatccaatcccctctccgcgatctcaccgggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcaggcttcgtggaggcatgcagattttcgtcaagaccctcaccggcaagaccatcaccttggaggtggagtcctcggacaccatcgacaacgtgaaggcaaagatccaggacaaggagggcatccctccggaccagcagcgcctcatcttcgctggcaagcagcttgaggatggccgcaccctggctgactacaacatccagaaggagtccaccctccacctggtgctcaggcttcgtggaggcatgcagatttttgtcaagacgctcaccggcagaccatcaccctggaaggtggagtcctcggacacc

SEQ ID NO: 60361 - DNA, 747 bp, Triticum aestivum
  Clone ID: PAT_TA_60361
gccggccggtccgggcaacgctgttgccctgatggttcacactaatcagctggagattgaagagcgatccggtacctcgtactgggactgtttccgaggcagtaaccttcgacgtaccgagatcgcctgtatgggattcctgtctcaaatcacaaacggtggtgccctctgctacagcggatctttcttcttccagcagactggcatcagccccgagacgtcgtacggtattgccctcggcggaactggcatcgcctttatgggcaccatcatctcgtggttctacatctacaagttcggtcgacgaaccatctggctcactggtttctcatgtctcgtggctatcctctggacaattggtttcctcgctttgcctaagcagaccaagcctttggcctgggcgcagtccatcctgtgtgtggtgtggctgggagcatactccatgacggtcggacctattatctacactatcgtcgctgagattggttcgactcgtctgcgaactcagacaattgtgctggctcgatcgacgtactatgtcggaaatattgtttgtggtggattaatccagcctgagatgttgtcgcctggttcttggaacctcaagggtaaaactgctttcttctgggctggtttgggcactctaaccctgctctggggttatttccgcatgtttgagacaaaggaccgcacctttggtgagatggactacatgttccaaaagggcgtctctgcacgcaagtcttc

SEQ ID NO: 60362 - DNA, 323 bp, Triticum aestivum
  Clone ID: PAT_TA_60362
gctcaggcggcggttcggtcttttgactctcttattggaaagatagaaaaggtcaatatgaaggaggagaaagaaacatagtaacgtggtcccgggcatctagcattctacccacaatggttggccatacaatcgcgattcataatggaaaggaacatatacctatttacataacaaatcctatggtaggtcgcaaattgggggaattcgtgcctactcggcatttcacgagttatgaaaatgcaagaaaggatactaaatctcgtcgttaactgaattctgaatagaaagattaagaaaaaaaaaaaaaaaaaaggccccta

SEQ ID NO: 60363 - DNA, 566 bp, Triticum aestivum
  Clone ID: PAT_TA_60363
gccggccggttccgggatgacagagactggaccgcgactggatctttctatggaaatcttgagtctcggggataatgagacgctcctgctcaaactgtattctatactcctgctgagaaccgcgcgatattctgtgatgctacagactatggaatgatcaggttctgcgattgctaatccagaacaagactggaggccagggacccagcaggacgagcccgttgagaaatgcctgacctccgcccacaggcagaaccagacctggctcctctttctgacccaccgaggtgttgagaactcatcctgtacttactatgaaaccgagggttctttcgaagcaccgatgatgctagaaacgctgcatgagtgtctgcaagacaaacacggacgatctcgcctgctactccctgggccgtaactatggagggacctggccaggctatcatagacagagcatcatagatgcagcacatcattgcagtggtcctgtcaaggctacgacatcatgttggttgttggcggcgctgccgctaaaattgcaaaatcaatctccgccagatcaagga

SEQ ID NO: 60364 - DNA, 473 bp, Triticum aestivum
  Clone ID: PAT_TA_60364
gccggccgggttggagagagagagcagtgtagggaatcctgagtgacaccggagagagagaagaagaagaggctgccaaggtcgacggcggagaagaagaggcgatggcgtccgggtggggcatcaacgggaacaaggggcggtgctacgacttctggctggacttcagctcgtgcatgagccgctgccgccagccctccgactgcggcctcctccgcgaggactacctcgagtgcctccaccactccaaggagttccaacgcaggaacaggatctacaaggaggagcaacgtcagataagagctgctgctcgcaaggccaaggaggaagccgaaggagctcctgctgttgcagctcaccactagcatcccttttcaatttttttcttatgcttttgtttgttgcaagcgcttccatgttcggctatgagcaaggcaataattacccaaaaaaaaaaaaaaaaaaggccccta

SEQ ID NO: 60365 - DNA, 523 bp, Triticum aestivum
  Clone ID: PAT_TA_60365
gccggccgggtcgggacatctggttgatgaaagtgctcgttgatgtagagatgactaacagaggatgtcttctctcctgagataggactatgtttcctggaccaagtcattacccccatcgtcactaaattccatactgctctatgagtcacatactactcgtgcaaggactgcgtacccgattggtgcactacccactgaccgagagctctcaagcctaccgaaatgcctgggtcgggagccggatatacagacacgctcatattctgctgcgagatactccacagccgcatcaccaacctcaacaactccgtcaaggatgaccgctatctcatacggcgatatgttgcacaactttgcacgaggactcccagacggtctgaactaacctgatgagactccatcttcgtaataggacaaccttgcactgatccctccataacatcaggacaatgacaaccacgagctgaggctcaagcgcaacatccgtacatgaggacttcctcgaggccgactatcaaat

SEQ ID NO: 60366 - DNA, 409 bp, Triticum aestivum
  unsure (1)..(409): unsure at all n locations
  Clone ID: PAT_TA_60366
cggccgcttcgagggcccggccgggtccgcgnaaaaaaaaaaaaaaaaaaaaaaaaaataaaaaaaaaaaaaaaaaaaaaaaaaaaaaggnccgtggcggccggggcccgctctagacctaaccgccccccctggacccgccggaattccaaattcctgcttaacaattaagtgcaacctcgaggcgtgggggcgtcccctaactcgatttacgctaaattgaaccccatgcggtggctggacttcaatttgccactactgggggggcaaaaacgtagccctcactgaactcaattgtacttgcaccacatccgccctttccccggttgaaacaatatgaaaaaggcccgaatcgattcccctttccaacacttgcgcagatttgcaagggagggggaaagtgaaagcc

SEQ ID NO: 60367 - DNA, 414 bp, Triticum aestivum
  Clone ID: PAT_TA_60367
gccggtccgggagctctatcgatcgtccctgggagaggagagaacgatccatttcattccatcccacccttccgaattcggatcaatggccgccatgaagaagatcgtggtgaagctggacctgccctgcgacaggcagaagcagaaggcgatcaagaccgtctccactctctgtggtatcgacgagatcgtcgtggacacgaaggacgccaagatgacggtcgtgggcacggtcgaccccgtcgatgtcgtccgcaagctgcgcaagcgcttctgctcggtgcggatggtctccgtcggcccggccaaggaggaggtctccgtccgggcgcccaaggaggcgccgaccaccaaattggagtgcccccccgtcccaccggcgccacccgttctaatcgtgccccccggcaccct

SEQ ID NO: 60368 - DNA, 542 bp, Triticum aestivum
  Clone ID: PAT_TA_60368
gccggccggtccgggcatcgagtagaccctgttattgtgagaattcttaattcaagagctatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctaccaattccccctacttattcaaaaaatttccaaggcccgcctcccgaaatccaa

SEQ ID NO: 60369 - DNA, 567 bp, Triticum aestivum
  Clone ID: PAT_TA_60369
gccggccgggtctcggaaaagagactgcataattttttccgcaaaaaaagtactgcataatttctggaaatttgaaaatatactttttcttaaaaaaaaggcttcaactgactcagactcattaccactattcttctagtagtagcaagttatataaatgtgatggttttctgatgccattactagtggcgtgtgtttgtgggtgggtgcagggatggatcgtgtgcaaccactgctgggacacgacccgggtgtatccgggcatgacgggacagagaaagtgttgccattgccagtcctacaacacctgcagggttgctccatcggtgctgccggcctagcagccacgatacccgcttcggtgaacgctacgattatttagtactagttgcgattgatgtattatttccagttcaacatgaactgtgcagactgcagaaacattattatacacggtaccgatttatatgtatgtacggtgccaatttgtgagaaagaaagatgaatggaaaaacacccgtctcgttgcagtttctaggggaaaaaaaaaaaaaaaaaaggccccta

SEQ ID NO: 60370 - DNA, 698 bp, Triticum aestivum
  unsure (1)..(698): unsure at all n locations
  Clone ID: PAT_TA_60370
gtgcggcgctcaggcggcgggctcgacactatatatcatgcgtgacgtgggttggagcaagacagccacaacctggtatcgttgaacacactacatctgaagacatgcagatggggttgtacccgaataaagccggcgattcagtcctcgacaaaagtcacctctcacagttcgaatcactgctctcaatcggcaaaaccattttccaaatcgttccggacatccaagtccaacgctgggaaaaggtcgtgtggaacgcagcctggaactccctaacagcgctcaccctcacggacacgcattcgtggttgagctcttctgatttgtcaacgccaatgacgcgaagactgatgaaagaggtcatcgatgttgccaatgctcttgatgtatctcttaagtatgacctgattgatcaacttctggacaagattctaggcatgccgccaattggtagtagcatgaggactgactacgagaatggaaagcctatggaagtggaggtcatcttgggatatcctgttagaaagggcagggagttagggatcgaggtgacgaccattgagacactttatactgttttgttggccatcaacaagcgtctgatgagttctgcagcgaagtagtatagccatgtcctggttattagttgcatataagacagattacatgtccaaaaaaaaaaaanaaaaaggncccta

SEQ ID NO: 60371 - DNA, 312 bp, Triticum aestivum
  Clone ID: PAT_TA_60371
gccggccgggcttggtgcttgttccttttttattatgtcggaatcggtttacacggcatgtatgatgagccgtgcgagtgctagtatacacttatcctagatagggttgtggtgatactaataatagtactgaacattttggccttgaacacgctgcctgctactttacttattcgactaccttatcggaaagagcattgcgtaattgatcataattaatgccagccgtgctggttcagcttaggctgccttccataaaaaaaaaaaaaaaaaaaaaaaaaaaaaaaaaaaaaaaaaaggacccgggcccca

SEQ ID NO: 60372 - DNA, 664 bp, Triticum aestivum
  unsure (1)..(664): unsure at all n locations
  Clone ID: PAT_TA_60372
gccggccgggccgggatcggtgtccattctcctccgttagctttgctagctagctaacacagcccccgtagcagcagccagtagctcactggtgtccacctctaggcctctcgggtgaaccagagcagatccatggcgccctctcgtcgcatggccgcatccgccctcctgctgctggtcctcctcgtcgccacagagatcggggcgacgaggaccaaggtggcggaggcgcgggactgcctgtcgcagagccacaagttcaagggcgcgtgtctcagcagcagcaactgcgccggcgtgtgccgcaccgagaacttccccgacggcgagtgccacacgcacaacttcgcgcgcaagtgcttctgcaagagggcctgctagcccgcctgctcgacccggccggccaccgccgcctcgtcccatggtagctacccagccactagatcgtccgtgccgtctgctagatctgttcgtcagtgcgttccggttcgtcagtagtagctgttcgtgtgtctgtgtgccgtaataaagtaggaaatcaaccggggtctcggtagtttggttcgccgcacgtcgcgtttgtgtctgctttgtgtggtaatgtaatcgttgtttcagcacggacggacgtgtgncaatacaaaaaaaaaaaaaaaaagggccc

SEQ ID NO: 60373 - DNA, 379 bp, Triticum aestivum
  Clone ID: PAT_TA_60373
gccggccgggccggatcacataagcttcatcaatcatctagggtattggtgtaaccataaagcggagctgttgcggaacttcggttggtgcggcttttccatctggttaattagcatcctgaatcaggtaggcaaagccatgttctttcgtatgcacattttagtgtcgggttgtcagcagccccgtcggttgaatctgctgggacatcatatgattcttgtatggattgtcatttgtaaactggttgtgttctggagctcgtttctcccctctttttttccatcgtgactcctgtatttttctaacaaaaaaaaaaaaaaaaaaaaaaaaaaaaaaaaaaaaaaaaaaaaagaaaaaaaaaaaaaaaaaaggccccta

SEQ ID NO: 60374 - DNA, 429 bp, Triticum aestivum
  Clone ID: PAT_TA_60374
ggccgctcgaggcccggcccgggtctcggaagtgcacgtcaaggtccatgagcgaggcggcggcgccggcgaccagccgcggccgctccggcaagaccgacaccggcggcacggtggcggcggcctgacctgacagcgcacgagaggcaggcaggctatcatcttccgaagctacctgccggccagtagctctggaagctctcgcttctcaccgcccgctacgcatgtattactctcgtacgtacgtacgaacgcctccaatatgaatcgctggtaatcgatctgtggaggccgtcagccaccgctggtcgatcgatcgaccatcgcctcagtacaactgcatagcttttttattaattattgtatgtacacttggagctcgaatccgtttctgagatcgtacaaaaaaaaaaaaaaaaaaggccccta

SEQ ID NO: 60375 - DNA, 810 bp, Triticum aestivum
  unsure (1)..(810): unsure at all n locations
  Clone ID: PAT_TA_60375
gccggccgggctgcgtaatatccttacgtcacgacaactaaacaccaatgtctctttcaaaacgcgccaacgatgcagagaaggccatcgagggtatggatctctgggaggtcatacccaacctcttcgaccaagagaccaatcctgatggcatcgtgagtttgggcgttgccgagaataccctcatgcacgatgttctccggaagcacatccacgacaacttggcgttgacgaacccagctttcacctatggagatggtacaacgggcacgaagcaggtcaagaaatctgtatcgcggttcttgaccaaacatctcaagccattcaaggctattgagccggcgcatatcaccatgaccaatggatgcagtgctgctattgagcacttgtcgtgggctgttgcgaaccctggagacgggatccttcttggacaaccatactacggaacctttgttcctgatctcactgcccgtttcggagcaaagcttctcccagttgcttttggcgaggttgaccccctcggcgaggccgcagtagccgagtacgagaaagtcattcttgaagctcaggctcaggggaccagagtttcaggtcttgtcatcagccacccgcataaccccttgngacggtgctactctcgcagtgttcttattgcatttatgaagttgtgccagaagtacgagatgcacttcatcagtgatgagatctatgccttgtctgtctggaccaacacggttgaccaacatcctctctctgttccttttgagtctgctctttcgattgatactacagacatcatcgatactgatc

SEQ ID NO: 60376 - DNA, 315 bp, Triticum aestivum
  Clone ID: PAT_TA_60376
gccggccgggccgggcgtaagagtcaaaaacaacaaaaaaacaaaaaaatggcactgggcgctaggttaatagacaagaacgcggatcatgaacgcgaatcatgcgcccggtcggtagatttctttgatccgtcttgtttgttcaccttgctgtatagaaagatgagagatcagtgatcggaaccgatgcattctgagttagagagtatctgttcatctgcacggggtgcaaatatcagtttctgtaccaccatggagattactatctgaaatggagtctgcttttctcaaaaaaaaaaaaaaaaaaggccccta

SEQ ID NO: 60377 - DNA, 617 bp, Triticum aestivum
  unsure (1)..(617): unsure at all n locations
  Clone ID: PAT_TA_60377
gccggccgggccggggccgtcgccaatccaccaaatccgccggagccagagatcggagagggagaagatggtgcgggtggcgaccttcttcgggatgaccttcggcgcgttcctcttctgggagtccatggacaaggtccacgtctggatcgccctccaccaggacgagaagcaagaaaggatggaaagggagatggagataaagaagatgcaagcagacctaattgctcaagcaaaagagagtgaatcatgattgtcttttcgccaatggtttcaactagttgctttgtcatatttttactttccaagtgataagccttggctgatgtatgcttgacacctccaataaaccaagttgttataactttattgaatgcaagaggctatgctcatgttaaatcatgtttagtttataaaacagcataacccagcttcactgccttggttatgaggtgttgttttgaattgcttatgcatattttgttgttttttcccgttgttataactttattgaatgcaagaggctatgcccatattcccgttgtttaaaannnnnnnnnnnnnnnnnnnnnnnnnnnnnnnnnnnnnnnnnnnnnnnnnnnnnnnnnaggccccta

SEQ ID NO: 60378 - DNA, 482 bp, Triticum aestivum
  Clone ID: PAT_TA_60378
gccggccgggccgggcaaactcgaggttccgaccaagctgttgacctgagggaactcagatttgatgaaatcgatgatgagtacattgttacaggggcagtacctagtatggcaacaccaggaagaatggccagtttccattacagggatacaagatatggtcggtgatcgggcgtactacttaatagaaccagctgataaagaaaaggatttgcagccgcgatgtgatgccgcagccttcaggaaactccacccccgcccatttttcgtttcttttcctgcccccgtcgttgctaggtgccgctccagcccggacttcctgtgcataaaaagtagcaacagaaaccctctgccgccgccgttcgtttgcaatagattttcatttaccctagcttccattctgtatatatttagcacccttcttatacagtgatgccggtgaaaagcctttttttcaaaaaaaaaaaaaaaaaaggccccta

SEQ ID NO: 60379 - DNA, 551 bp, Triticum aestivum
  Clone ID: PAT_TA_60379
gccggccgggcctgggatcctttcccaatcaccgatccacattatcgatgagagatcaaaaagatcccccacccagaaacgagcgcgcaccgttgaagatcgagatgagaggatgtccacatactactcgacgttgtgcaagcgtcagcttcagtctatctacccctacaccatatccgccatcacgatcgccggctcctttccagcgactgtgctccttacaacatgcctgatctacatcacacagagcagcctgatcggatccgccttcacggtgcccaggatgacctccgagaagctcgtaaccgctgtcgtctcgaaggacaactgttgatcatggtgacatccagacgatattgctctctgcgaatgataaaagtgaggcgacatcccgaacgcatgaaccagagtatatgcgatgctgggtatgcaatcattgcctcacgccatattgatcgggatcgctaatcataatggcagccaatgtgagctgataaacgcgagtatactggcactggctgatgcccagaatgcagaacacgaagccaaga

SEQ ID NO: 60380 - DNA, 148 bp, Triticum aestivum
  Clone ID: PAT_TA_60380
gccggccgggctgggatataaaaatcttcctgtagcggtttttctcggaggctaacgggaaagccggtgttcgaccggtttcaaaaaatcgttctggattatcaactaagtatgtgccgtgaaaaaaaaaaaaaaaaaaaggccccta

SEQ ID NO: 60381 - DNA, 564 bp, Triticum aestivum
  Clone ID: PAT_TA_60381
gccggccgggcaggagacttcttccctttggcggaggcaccacgggcacggaggcggcgggggaggctatggcggaggcggaggaggttacggcggaggaggaggcggcggctacccaggcggcggcggaggctacggcggcggtggcggctaccctggccacggtggggaaggcggtggaggttacggcggcggcggcggttacccaggcggcggaggaggctacggcggcggtggcggctaccctggacacggtggaaaaggcggcggaggctacggcggcggcggatgtcactggggctgctgcggccacgggctgttccatcaccatggctgccgctgctgtgcgcgcgcggaccaagttccggagcccatggaccgggcgccggcggagggccaccactgggcacaccatccagaccaaatggagccctggacacctgcgtaccggaaggagtactggtggccagtggctaccctggggcgaactctacctggatggcggtggtctgcacccctacctgcatatataacaattaaattggtccgaaataaacatggtcc

SEQ ID NO: 60382 - DNA, 662 bp, Triticum aestivum
  Clone ID: PAT_TA_60382
gccggccgggctggggaaggaaccctagccgccgtcgtcttcctcttcgtcgtcctcgaagccatcttctggtctgttggtagctatggcgctgcgcaccgttgccgcgaagctgaaggcccccgtcgcctctctcaagcaggcctgggcggtctgccgtcctcaggccaagggtcccaagctctctaaaggtcttgacatggatctttcagatccacacattcgccgggtttttgacgagaacgcaaagctattgaacaggaagcggacgaaggagactgctgccttaattgttttcatgactggcacgacaggcagtgctctccttgccatgcgttactgatctaacgagaatccctacctatcgtttagctgcctatcaagctaaaagctagctatctccctacctatcgtttagctacctatgaaggtaatagctatctgtctgctgtcattttgtatttaagggcactctatatctgagtattgtctatctgtggtgtctgggcagatgtgaaatctctatctaattatgtataagacttaatgaggtctgttatttgtaatggtctttgtgatatttgtaatgtgcaatctctatcttgcatgatatttgtaaaaaaaaaaaaaaaaaagaaaaaaaaaaaaaaaaaaggccccta

SEQ ID NO: 60383 - DNA, 643 bp, Triticum aestivum
  Clone ID: PAT_TA_60383
gccggccgggctggggagctctttccctcctccacacagaacaacccaacaacgaccaccatggccctcagggttgctccgtcgccgctcctcgcctccggcggcggtgccaccgccttcgccaccccgcttacgccgaggaagagaggcgccggcctgctcctcgtaagcaagcgctccagaatctcggcagctcggtggtggtggtggtggtggtggagatggagagaccaagcctgacggcaagaagttcatcaccagagaacaggaaccggagcagtactggcagactgctggggagaggaagggggagaaccccatgatgacgccgctgccctatatcgtcatcttcggcttctccacccccttcatcatcctcgccatcgccttcgccaacggatggatcaaggcgcccctcatccgctgagctccggtcgagctatcctcctccccccttccagcgagagagatgacttgcttccattctatagagattgctgtaaagccgtatgtaaatcatttcttcagagatctttatatagtggagtcaccggctgctctgcactcatgactgcatttggttctgcatagaagcgaaagccctgtgtttgttaaagaaaaaaaaaaaaaaaaaaggccccta

SEQ ID NO: 60384 - DNA, 796 bp, Triticum aestivum
  unsure (1)..(796): unsure at all n locations
  Clone ID: PAT_TA_60384
gccggccgggttggggtccactctacccctgcgacagatcgagatgcaggtctagcttcacgccggcggccatggcggaggcagcaaggggagggccgacgcctcctcatggtggcatcccggatgagatcctcatctgggacatcctcgtccgcctgccccccaaatcgctcctccgctgccgtgccgtctgccgcgcctggcgcacagccacctccgcccgcgacttcctcatcgccaaccacgcccgccagcccacccgccccctcctctacgtctgcaaccttccccactacggccactacaaggtcggtggcgacatagacatcatccccttcgaccaccgggccgccgccgacaagctccagcccgtcgcgctacttggccgagcctccgaattcaaagatctggtggcctcctttgacggcctcgttgtcttcgactggtggcgccgcaagtccttgggtatctgcaactcagcgacccgtcagtatgcccgcctcatggtgcctatggacttcacgttcttggggatgtaccgtcaccccccaaccggcgaatacagggtactgatgtacccgtgtctggcagctgggagggaagctggctgctatgttttatcgttgggctccatccaaccgccgagaagcattgtcagngccgggggaagtgcataaagaagtgatattcggcaccaagtctgtgcaattccgtggcgggctgcactggtacagggtgcagcagcacgagggcgaaagcacatgataatcgtatttgacacacagccgagacgttc

SEQ ID NO: 60385 - DNA, 485 bp, Triticum aestivum
  unsure (1)..(485): unsure at all n locations
  Clone ID: PAT_TA_60385
ggcccgctcccgaggccggcccgggcttgggnaaaaaaaaaaaaaaaaaaaaaaaaaaataaaaaaaaaaaaaaaaaaaaaccgcatcgcatctcaacctgacttgactcatctatcatgatgttacgacctcgcacgcctcaacgataccttggccgaagcagggcacttgccgttctggcgcctctgggatctcccgcaacgcattgagctgggatttgactttgggaattacgtcaggggggttgaaccccgcacttgagcggctgatgtggcacacaatgaatattatgggggatgggattatgacaatcaaatggtcaggtacaaggcggggttggatcgaccactatcaaatgctcaccaacacaaagcatcacaacaactttcaaagataaagaaatacagagattcctctgccaaaaaaaaaaaaaaaaaaaaaaaaaaaaaaaaaaaaggaaaaaaaaaaaaaaaaaaggccccta

SEQ ID NO: 60386 - DNA, 662 bp, Triticum aestivum
  Clone ID: PAT_TA_60386
gccggccgggccggcgacacccacttcaccgtcacatccaaggcgaacgacgaggacggcgacttcgccgagctatacgtgttcaagtggaccagtctcctgatccctccgaccaccgtcctcgtgatcaacctggtgggcatggtggccggcatatcgtacgccatcaacagcggctaccagtcctggggcccgctcttcggaaagctcttcttctcgatctgggtgatcctccatctctaccccttcctcaagggtctcatggggaagcagaaccgcacgccgacgatcgtcatcgtctggtccatcctcctcgcctccatcttctccctcctgtgggtgaagatcgacccgttcatttccgacacccagaaggccgtcgccatggggcagtgcggcgtcaactgctgatcggatcgccggcgctcaagatacccttgtcgcccatgctgctgggaaccacaaacagtcaagcctccactgcctacgaaacctgcagcgtacattgtgattttttctcctttttttccccatttgtgatacttggtctttggtgcttagagaatattatgtcagaattgtatttatacacactgtgacaccgactatttatataaggcagctggtgcatcaaagaaaaaaaaaaaaaaaaagggccctaa

SEQ ID NO: 60387 - DNA, 423 bp, Triticum aestivum
  Clone ID: PAT_TA_60387
gccggccgggccgggtataaagattaattgaacaacatacgttggtatatgacggccaacagtgatacctggagctacggcatgctgctctatgagctcatcacggggcaccggcgtgtcgatgggaaaccgaccagaggacgagcagaaggtgctggactgggcgaagccatatcgtctaggtgttgatctgaatccttttttcttgacatctatacctgaatagttgaacctacactagtatatgtgctggtgtattgagtgatctattccacccaaaagaatgacagtctgcagcttcagatgtaaatgtagattatttatatgttgcaatccaaacaactcgatgcattggcatccatctacattttttgaatggcacgaaacatattttttgaaaaaaaaaaaaaaaaaaggccccta

SEQ ID NO: 60388 - DNA, 425 bp, Triticum aestivum
  Clone ID: PAT_TA_60388
gccggccgggtcggggacgtttgtcgaagccggggaaagtattgagatgccacagcggacagaagatggtatcaaggtatccaggacgtttcagactacacagattgaggttgtcaagccaaaccgtgatcgtacggattatgatgaccttcagagcgaatcaagctctacgcgaaacttgaaggaggaacaatttaatgtttgaactcggactaattggtgaaaacacatcctaagctgtcgactgggatgagaagccagtcctccagatctcttccggatgaagaagcgaagagagatgtatatgcccttcatgcagaaatttcatttctttaaaacatatctagcccgtacacaatattgatactaagcctttttgagatgcaaaaaaaaaaaaggaaaaaaaaaaaaaaaaagggccctaa

SEQ ID NO: 60389 - DNA, 869 bp, Triticum aestivum
  unsure (1)..(869): unsure at all n locations
  Clone ID: PAT_TA_60389
gccggcccggccggggaaaggaagcgaccatcaccatcgacactctgggcttgtcccaatcctaccttatatccgtttcggtcggatatgcatctggtctcataacacaacaccgccatcatgcctcaggatcctgccgctgctctcagcgccttgttgcagcagtcctctatcgaagaccacgaagaagtcctcaaggccgccaacgccgcactcaaggcaaacaagaccgataccgacagccaacatacccggattatcgccctgttgaagcttgatcgcttcgaagatgctctgcgcgccattgccgacggcacccccactcttcactcacgaattgccctcgaacatacatatgcgctctacaagacaggaaagctcgatgaggccaccttagtcctcaaggccgcaggtctagagaacaaaagaaatctgcagcacgtcgccgcacaagttgcctatcgctctgagcgatttgacgaggcatgcaacatctacagtcgcctccttgataccgaccctgccgacgaggagaacgatatcagcattaaccttcgagccacacttgcccagtctagctggctcgggtattctgtcactgacaaggttgcggttcaagactctgatgggttcgaactgtgctacaacgcggcctgcgcgcacattgccaatgggtccctcgaaactgctgccgatctgctgcagcgggctagtagactgtgcgatgcctctgacgacctcacggaagaagacaagcagccgagatgcggccattctcgccaacagggctatgtctttgcaaactgngcaagntgaaaggaggcctcgatctctancatcattatcagcatcaaggaagagatcctgac

SEQ ID NO: 60390 - DNA, 832 bp, Triticum aestivum
  unsure (1)..(832): unsure at all n locations
  Clone ID: PAT_TA_60390
gccggccgggtctggcatggcggtctcaccgctgtcatgaagctcaccaagctcttcattgaaaagggtgcggccggaattcacattgaagaccaagcccccggcacaaagaagtgcggccatatggccggtaaagtccttgtccccattcaagaacatatcaaccgcctcgttgcaatccgagcgcaggctgacatcatgggctctgaccttctcgctattgcccgtactgacgccgaggctgccacactcctttccaccaacattgacccccgcgaccatgcttttatcctcggctccacgaactctacactcaagcccctcaacgatctgatgatcgccgctgaagctactggcaagtctggtgctgagctgcagcgtattgaggacgagtggcttgccaaggccaatctcagcagtttcgacgatgctgtcgctgctgccattgacgcgggttccttctctgataaggctggcatcaagcaagaatacacttccagggcaaagggaaagagtaactttgaggccagggctgttgctcgccagcttctcggcaggaatatcttctttgattgggatgctccccgaacgcgtgagggttacttccgcctcaagggtggatgtgactgcgcagtgaaccgcgctatcgcctatgcaccttactgcgnacgccatttggatggagtccaagctgcccgatttcgctcaagccgaacagtntcgctcaaggtgtccacgctgtctggccagagaagaaactcgcttacnacctgtcttctcgntcaactgggagacggccatgcctcgtgatgaacaggagactacatccgac

SEQ ID NO: 60391 - DNA, 807 bp, Triticum aestivum
  unsure (1)..(807): unsure at all n locations
  Clone ID: PAT_TA_60391
gccggccgggtcgggaaaaagactactaccaacagacttcactctactctagtccatcacttacacatcttccatcatggctccctccgccgtcgaaacccaggacgtcaacctgacagccgcagccatccacaagaaagaagtcgcccagcccaccaccaccacacaagctcccctcgacgcttcaaagctcacatacacctacacccaaaaccctcgctccgtccccgatgaagcaaacgcccactccggcgacgagaccatcgccaccgaccacatggtcctcgccgcctggaagcaatccaccggctgggccgctcctgaactcaagccctacggccccctgagcctcatgcccaccgcttccgttcttcactacgctaccgagtgcttcgagggcctcaaggtgtaccgcggctacgatggaaagctgcgaattttccgtcctgaccgcaacgccgctcgtcttcgcatgtcgtccacccgtatttctcttcccagctttgagccctcagagatcgagaagctcatgatttctctcctctccgttgacggaaccaagtggctccccgccgaccgcgcaggaagcttcctatacatccgccccaccgtcattggaactgctccccagcttggtgtttctgctcccaaggaagctctcctgtacatcattgtgactttcatgccacgcatggacgctccccccggcggaatgcgcctgcacacatccccagacgacatggtgcgcgcctggggtcgcggtttcggttacgccaggggggcgccaactacggnccctctctgctc

SEQ ID NO: 60392 - DNA, 765 bp, Triticum aestivum
  Clone ID: PAT_TA_60392
ggcccgctcgaggcccggcccgggctcgggataaaagcacaggatgttacaacctaaagtgctcagggttcgtccagacgaataatcagatcgcaattggtggcaccttatccccagtatccacctatgatggtgcacaatatgactttgatattttagtttggaaggacccaaaggagggcaactggtggctgcaaatggggagtgattatgtaggatattggccatcatccattttcacgtacttggcagatagtgcctctactatacagtggggaggtgagatagcgtcatctgatctcggccaaacttccacagatatgggtagtggacacttcccagaggaagggttcggcaaggccagtcatgtcaagaatatacaagtggtagattcatccaacattctcaaaccgccaagtgatgtgaccactatagctgggcagcgcagctgctataacgtgcacaatggtatctctgacaacttgggcacttacatattctatgggggccctgggaagaactctaactgcccatgatcaatacgcctttagtattataattatttgtggattactagtggcccaatacgtattgttagggtctatactaatgcaatagtatgtgaggccacgtatggcattcgaatgctctactagtgtgtgtatggctacactcgtaagaggtgggaacaagcaatttaagcttgcataatatgtattgattttcccacacatgtttgagaatatgggaatagaagctttcatc

SEQ ID NO: 60393 - DNA, 317 bp, Triticum aestivum
  Clone ID: PAT_TA_60393
gccggccgggcttcggttgcctccatggagatgagaaccaatggccgagcgttggatacatggaggctggcagcggcagagcctggtaactgaagacgaccaccatggggatgggggcaggcacgcaccatgagagacatcaaccttgtaggtaggtaggtactagtagaactcttgttctgtatatgtttcttgtaaagacaaataaaattgcgcgatttcgttcgtggttggaccgaattaaaaaaaaaaaaaaaaggggcctcgcggcgaataaactcatccctaccgaaaaaaaaaaaaaaaaaaggccccta

SEQ ID NO: 60394 - DNA, 368 bp, Triticum aestivum
  Clone ID: PAT_TA_60394
gccggccgggttgcgattcttctttcacgtacgtagcatgtatacgtgtgccttttctcaacgacaaactcaatctttaattcaatttgctcacatggccacaaagaggtgtacaagccgatgtctgtcttggcatgaacctctggcaatcatttgaattatttctccgtacaagaaggtcttgcgaaaatgaagctgacgcatttgtcaaggaattcaaagtttggacgctgctgatttgggttgtcatctcaaaatccaaagtccttcttccatatgcagctagttaactacttccagtacctcattgaccaataacccactcactccctatattgacacaaaaaaaaaaaaaaaaaaggccccta

SEQ ID NO: 60395 - DNA, 426 bp, Triticum aestivum
  Clone ID: PAT_TA_60395
gccggccgggtcgggcacgtcaccggcctcgcctccaacctcaagtcccttccccacagctggcaagacatgacaatgatgctcgatcagaagcgctggaagaaaattcttgacaagaagcagcaacaagcttaagttccataaccttcatcgcttgggccacagttggaagagctcctttctttctggctgttgggcatgacagaggaagttctgcatcagtttggtttcgtggatagagttttctacctattgtttttctttcatattgttggaacctcattcttgaagttcaacgtgtaaggggttgtattcatctgctgccgttgtgatccactattaaacagcacctcagatgacattgatttatcgagaaaagtggcgtgttttggtgataaaaaaaaaaaaaaaaaaaaaaggccccta

SEQ ID NO: 60396 - DNA, 266 bp, Triticum aestivum
  Clone ID: PAT_TA_60396
gccggccggtttgggttctgttcatgttctatggtatcagtttcgctggtgatgttcctgccggtgggactagtcttttggctgttgtcccaaggtgccaagcctgacggggatcaggttcagagcaaggcagcatttacctgaatgtaaaacgccctttagtactagtgcttatcctagaaagtgaagatcgcagtcgccgatgtaaatgttgaatgtgtttgctgggacattcatctagcatagcacctcacctcagttttccg

SEQ ID NO: 60397 - DNA, 491 bp, Triticum aestivum
  Clone ID: PAT_TA_60397
gccggccggggttggagcatatctcaacgcaccacccctaaatctttctgccaaactccggcctccagaaattgaaggcatagagaacaatatcgacccagtggcagaccgcgaagagcgaaacaatagtattaaggacctctactcgagattacaagccgcctttcccgggttcgatcccaagaaagagcccgttttccgtgcgaacgcacagggtggacaaaagcctggcaacatgatgggaagccaggccagtcccacagctcaaaggacaccaaagatgaccaatatgggggcacctccaatgccatagctggacatggccagattgattttaaaaaaagatagcaaggtgtacattgatgggttatagacatttcagacaggagtacttccccttcgctggttgggttgttgtgtttcattcttcaaagaatagcatttgcatattgtttcagtaaaaagaaaaaaaaaaaaaaaaaaggccccta

SEQ ID NO: 60398 - DNA, 776 bp, Triticum aestivum
  unsure (1)..(776): unsure at all n locations
  Clone ID: PAT_TA_60398
gccggccgggctgggcccccaaatcgaaccctcccacccctcctcctcgaccgacaccgccgccgccgcagcccccttagtcgacttgcgcgcccgcaactggatctatggcgccggggcatcgaggtcaggtcgcctgcctccagacacctctgatgcgcgaggtcgacatcacctccctccattcggcacaaacatcgacgacgcctgtgcgtcgaggtcgaaggcgccggtgtgtcgaggtcgacgtcatcttcctccccagcaacagatccaacgacgaacaccaatccttgtccattgtgatgcgtggcaacggcaagcgcaagaggaagaggtgctgtccaagggaccgccaaagcatcgcgctcctcctcttcacgatgcttcacgctggcgggcatgggagggctcctgaccacggctacctccccgctgacggcgagtgcggtgcctgctccccactatggtacaacgcgctgcttagatccgcgtcggtggaaacccgatgcagctgattgatggaatcaaggaaggaacatacagtgcagtacgaaacgagggatgatctgatgatgttgagatgagtatggtgctcatactggatcattttttattcagaatctctgaagttanaatggtgaggtgttaaatgtagcccttgacaaaaactgggagattatactaccatagttagctccactgtagaagtgacatgaccaaacttaagtaggtgtatatttgttactcttgaatactacataagcttttgaacc

SEQ ID NO: 60399 - DNA, 267 bp, Triticum aestivum
  Clone ID: PAT_TA_60399
gccggccgggttgggcctaactggggggtctcaatgatttgagtagcgagaaatcccagcgaaaggcacttttgtatctcggctgttactgtgcaaagggcctgtgatagaaaattgtacatataccatgaccgggtacggaggagcccaggggcgcaggaatcaagtttacatttcacgagataactgaagtcgttcctctgaaaaaaaaaaaaaaaaaaaaaaatccgtcgtagtctagaaaaaaaaaaaaaaaaaaggccccta

SEQ ID NO: 60400 - DNA, 426 bp, Triticum aestivum
  Clone ID: PAT_TA_60400
gccggccgggctgggctcggggactccgtcaccgtcgcccgcgacaagagcaaggtcaccgtcacctccgacggagccttctcgaagaggtacttgaagtacttgacgaagaagtacctgaagaagcacaatgtgcgtgactggcttcgggtgatttcatccaacaaggaccgcagcgtctacgagctccggtacttcaacattgctgagaacgagggcgaggaggaggactaatatgcactgccatgcttctgtgtcgtgtgaaactttgaacttgttggagcactcctgcagtagagttttgatgtttatttttttcacccatgttttgaattgtggccaggacgacatgtgatggatgcttagataaccaagctgaagaattgtccgttcttgttcgaaaaaaaaaaaaaaaaaaggccccta

SEQ ID NO: 60401 - DNA, 781 bp, Triticum aestivum
  unsure (1)..(781): unsure at all n locations
  Clone ID: PAT_TA_60401
gccggccgggtcgggaaacaacccaacaccaacaagggaaaaaacacacagagctagccagcgtacgtgcaaagtttgagttgattgaaatggccggaggagacaacctgacgctggttggcatgtgggcgagccctcacgtcctgcgagtgcagctcgcgctccgccttaagggcctgagctacgagttcgtggagatggagggggagcaaggcctcaagaacaacaagagcgagcagctgctcctcaacagtaagctgccggtgctgatccatggcggcaagcctatccgtgggacgtcgttgagcataatacagtacatcgacgaggccttcgctggcgccagcccctccctccttcccgacgaccactccgagcgtgttgtggctcgttactgggctgactttatcgatgacacgctcgtgaaggcgatgcacaaggcggcatggggcaaaacggacggggagaaggccgaggggaagaaccaggtcgcctcagccgtggagaccctagagggagctatgagagagtgctccaagcccttctttggaggcagcaatgtcggatatgtggatgtcgtgctcggtagtcttcttgggtgggtgcgcgcgactgacacgatgcaaggtgtcaagaccttcgacgaccctgccatcacgcctctccttgccatgtgngcatgccgctttgatgcactgaaagcagtccaagtggtcatgccagacgtgggcacgctggtcgattttgccatgcccatgatgtcggctcgccactctggtcg

SEQ ID NO: 60402 - DNA, 548 bp, Triticum aestivum
  Clone ID: PAT_TA_60402
gccggccgggccgggctacgatgctgtggaattgggctatgagaaagtattgtccttattgatgcaacagctgctgctaggccagatatccatttggcaaatatcagagatatgaagaccatcggcgtggaaacaccaaccttggaagagtggcgccgttaagcttgtgggtggtgtacttcattcttggcacgaagtgacatgcatatgtgcagtagaggcaacaaatgcgctaccacttccttgctccccattcagtcccgacaaatgtaaatatgttaatatttgcatggttacatatatacaacttctaatccgtcctacatagagttaatcatacagtgtcatgtggtttccctttatatgtggtggactttagggatctagtgtaaggtagtagccaactccagacccaaaacagggcgattggaaggtgctcgggttgtagaattttttggtcttttggagaacggatggtttgagatgccaggtagatgttaaaacatcatttgcatatgaaataaaaaaaaaaaaaaaaaaggccccta

SEQ ID NO: 60403 - DNA, 719 bp, Triticum aestivum
  Clone ID: PAT_TA_60403
gccggccgggctgcgagaacccaccgatcgagccaagaactttgcagtgcgtgagggagtgagagaatggcgggtggcaaagcagctctcctggtggccctgctgctcctgagcctggccttggagacccaggcggcagcggcggctacgaccccgccccgacggcgacgccgctcaccacgtcccacaggaagcggcgtccgtctccgccgcgccctcccacgccaacgctgcccccgtacaccccgtcccctcctgagcccacgccaacgccgccgccgtacactccgtcccctcctgagcccacgccaatactgccgccgtacactccgtcccctcctgagcccacgccacccccatacgccccggccccgatgccatctcccttcctcgagcacggcgtggaagccgactccgctggcgtacaggctgccgccgactacgaggagccgccatcgacgccggataatgcttagggctgtgaccgtgagtccctgccaatgcatgcagggccattctctcggagattaagtaatatgtagtctgaataataatgcagattgcttggttacccgccgctgatttgtgttcgtccagagttagcgtactttcatgcatgtgggtattgctactgttgtggtgttactgtaaaaccattatctgatagtataatgtggaaatggagatgagaaaaaaaaaaaaaaaaaggcccctagggc

SEQ ID NO: 60404 - DNA, 746 bp, Triticum aestivum
  unsure (1)..(746): unsure at all n locations
  Clone ID: PAT_TA_60404
gccggccgggtcggagcaaaagcgagccacttaccaaagctactctgtctgccccaccaccttgtcgccatgggcaactgcctgaacaaggcgtctacgcagcagcagcgcgagatgcggcggcggcacggccacggcgagcgggtggcgccggaggagagggaggagcaggaggagctcaggagcatcggccaggtgctgctgcaggaggaagacgaggaggaggaggaggaggaggtcccggcgtccgcgtcgccggcggccgggatgaaggtgaaagtggtcctgacgagggcggagctggagtggctcatggcgcagctcaagagcggcgagcagcgcctcgaggacgtgctccgccagatgggcaacgcccgggccgacgacgacaagccgccgcgcgccgacgcctggcgcccgcgcctcgagtgcatcctcgagtgccccgaggccgccgacgccacctagctgacaacctacacgccgtctgctctcgatctctcctccccggccaccgtgatcagagcttggtctcctccatgcatgggctactagctttcttgctcagatccgtccgtgtgcatcgtgtgatccatggagaggcttcttgtttttctgtttctctccaaaggatggatccatggagtggtgcttgagttaggatgaacaccaactgtactatgtagtagcctgttagagcagtagtagcttgatttctcagaaaaaaaaaaaaaaaaagcccctan

SEQ ID NO: 60405 - DNA, 534 bp, Triticum aestivum
  Clone ID: PAT_TA_60405
gccggccgggccgggtcctccactaccaaaaagctacctgtcgcccccatctcaaccaacaaaccacaatcacaacaccacaatcaacgtcataatgtctcgcgaagggtaccaaattcctaccgcctctaccggccagcgtggcggtacccgcgacgaccaacaggtccgccatgtcatgtcttacctctgcggcgattgcggcggcagcgtcaccctcggcaaggacgctcttgtcgcgtgccctcactgcgccggtcgcattctctacaaggaacgaactaagcgtatggtgcagttcgaggcccgatagagaatgaagaacctttgattaccaagcgaagagaggaagaagaagacgaagaccttgcaagagaacaagcacgagacatattgaattcatcaagatgggagtttgggggtctgggaattacgttgaaatgaaaaataaatagacaatgtgacacggtttgcgccgcgcgacaaagactcgacgctgtgtgatgacaaaaaaaaaaaaaaaaaaggccccta

SEQ ID NO: 60406 - DNA, 532 bp, Triticum aestivum
  Clone ID: PAT_TA_60406
gccggccgggccgggaaaaagagatgaagcggtggacgtgcggatggtgggaagtgacgcggccgcggtgcgtgtgaccacagcggccagccacgctccggcgcggctgatgggcgcgctccggtcgctggagctgcaggtgcagcatgcctgcgttagccgcgtgcaaggcgtgaccctgcaggacgtcgtcgtggacgtgccaccctcgatgcaggacgccgacggcctccgctcggcgctgctccagacgctgcaggacagcgcctaggccgcaagagtgatgggggtaataaaggagatgaaatggacgtctataccatcatcgttaattatgtttcctgctgttatacatgaaataaattgcccattatcaacgtagacggtgtagtcacagactgcggaatatttatgtacgtagcgtcgccccatccaccactccgtattattacttgtgctctactacttttaaaatgattaaaatacttgagaggtgattctccaccaaaaaaaaaaaaaaaaaaggccccta

SEQ ID NO: 60407 - DNA, 556 bp, Triticum aestivum
  Clone ID: PAT_TA_60407
gccgggccgggaacgacaacaaggcttctgatatcttatacggctcttctccattcacacgataccacctcttacaagacgacaaaatgaaggtccttagtcttaacttcctcacctgcgccgccaaggcttgcaagtcctccaaggactcatatcctcttcaccctaaggacgcagaactcgtccaggacgatattgagctgaaccctgacatgatcatcaatgtgctgccccgtctggactgggaggctcttcgcacgacagcttctgagctgggtttccctcaactccctgagcaggctcctaccgcagttgagctcaagggtgatgacaagactctcagggatcttcaccatctcctccttgagacgcaaatgtctgagggaaagctcgtttgtggaagctgcgggcatgagtatgccgtcaaggagggtatcgccaacttcttgctgcccagccacttggtatagagacgagcaaggtttactctggaaaaagctttagatggaaaagccttatggggatgcataaccactagtgaagggatctagtggtc

SEQ ID NO: 60408 - DNA, 833 bp, Triticum aestivum
  unsure (1)..(833): unsure at all n locations
  Clone ID: PAT_TA_60408
gccggccgggcttccccgcncacctttgacaagtacaacccttcacttcgctgggcattccagcccgttatcgatggcgaaatcattgcccgtccgcctttagagacatggagacaaggaaaatggcacaaggtgcctatcatgactgggttcacgacaaatgaaggatcgctctatgttgacaagaccatgtctaaatcatctgagtttagacacttctgggccgagctattaccattgctcacatcagaagacctcgacaccatcgaggaactttacagagatccagcaaagtttgaagactcagagtacaaggagacgcggaaagacatgggggctcagtacaagcgaatcgaagctgcatacgcccactacgcctacgttgcccctgcacgtcaaacagccgaactagcctccccatccgtccccgtgtatctctaccactgggccgctcagagtaccgtaaacaacggcgcccaacacgctgataacatgcgctacgaagtgtgcgaccccaatgtcctgaaagtgtcgcctacccagaaagatctggccaagacactgaatcactacgttaccagctttatcacaaagggcgacccgaacgcggttgcaggcgagtatccttcaagacccaagtgggaagcttatgatgtgaaagatcctaaggtgttgagatttggtgatgggaatgaggagttaatcggtggcgacgttggcaagacggccgtgtttgatagcgatgaatggggacganaacagtccaagttctggntggagtaaggtcgatatctcgcagcagtaagaagataataatttagtaaagaattaat

SEQ ID NO: 60409 - DNA, 717 bp, Triticum aestivum
  Clone ID: PAT_TA_60409
gccggccgggctcgggacaacaccataaggtatttcgtcttgacgacctcctccatcgtcaattggcctcgaatcgtcacataatcggccatggcgaccagcatttctcgaagcagggctttggcctcagctctccgacccgcgaagccctccgtccaactccgcaacgatcaagcaatccgctgcttgtccaacacggctcgtcaatatgtcgcaatgcccaaggaaagccccaacctgcgaaaggccccccgcgaccacatcggcacactgaaggctcctatcgtcaaccctgccgacaagtaccagagcaagtctgacaacatgcaccgatacggtgcctgggtgatgggctgccttcccaaatacgtccagcaattctccgtctggaaggatgaactcaccatttacatttctccttcgggtgtctaccctgtcttcagcttcctgaagtacaacaccgctgccgagttcacccaggtcagcacaattactgctgccgattaccccacgcgcgagaaccgtttcgaaattgtctacaaccttctttcggtccgccacaactcccgaatccgtgtcaagacatacgccgacgaggcctctcctgttcccagtatcactggactttttgacggcgccaactggtacgagcgagaggtgtacgacctttacggtgtcttctttgctggtcacccgatctccgacgaatcatgactg

SEQ ID NO: 60410 - DNA, 798 bp, Triticum aestivum
  unsure (1)..(798): unsure at all n locations
  Clone ID: PAT_TA_60410
gccggccgggtcggggaatgccggccgggccggaaaaaaagcgaaagcctctgtcaccggcgacgacgcgcaccagcaccgatggcccgctacgaccgagcgatcaccgtcttctcccccgacggccacctcttccaggttgagtacgccctcgaggccgtccgcaagggcaacgccgccgtcggcgtccgaggcgtcgacaccgtcgtcctcggtgtcgagaagaagtccacccccaagctccaggactccaggtccgtgcgcaagatcgcgagcctggacacccacatcgcgctggcctgcgcgggtctgaaggcggacgcgcgcgtgctcatcaaccgggcgcgcgtcgagtgccagagccaccgcctcaccgtcgaggaccccgtcactgtcgagtacatcacgcgctacatcgccggcctgcagcagaagtacacgcagagcggaggggtgcgcccgttcgggctctccacgctcatagttggcttcgacccctataccgagaagcccgcgctgtaccagaccgacccctccggcaccttctccgcctggaaggccaacgccaccggccgcaactccaactccatgcgcgaattccttgagaagattacaaggagacgtccggcaaggagaccatcaagcttaccatccgangccctccttgaggttngtcgagagtggtggcaagaacattgagattgctgtgatgacgcacaaagatggtcttcgncagcttgagggaaggggagatcgatgagtatgttgctgagattgaaagcagagaggccgctgctg

SEQ ID NO: 60411 - DNA, 769 bp, Triticum aestivum
  unsure (1)..(769): unsure at all n locations
  Clone ID: PAT_TA_60411
gccggccgggctgggattggaatatctcagctagagtcttacacctcttgtgtctgtcatccagtcacttggctcattctttgtcactcctctcaatatcatcaagtttgagtcgatcgactctttgacttcacgatgagattctctggtttcgtctctggcctcggccttggtctcttgactgctgtatctgccagtccagctgcctttcctgctccggcctcgatccctgaccctatacctgcacctgtcgcacctgcttcaccagctattgaagaacgagcagccaaagtcacagttgctgttccttccggtacagtcgttggatctagctctggaaaggttgattccttcagaggcattcctttcgccgatccaccaactggctctctgcgcctcagacctcccaagagactatccaagtctctaggaactttcgatgcctcgggtctcagtgctgcggcatgtcctcagatgttcatctcgagtggaggtcaaagtgttatcacagagttcctctctgactttctggctgtccctttcctcacgcccatcactggccaagaggactgcctcaccataacagtccagcgtcctgctggtaccaaagctggtgacaagctccccgttctcttctggatctttggcggcggcttcgaactaggctcaagtgctatgtatgacggcacaagcctcttgtctactgccatagatcaaagtcagccttttattctacgttgctgtcaactaccgagtcgncggcttcgga

SEQ ID NO: 60412 - DNA, 689 bp, Triticum aestivum
  Clone ID: PAT_TA_60412
gccggccgggttgggatcttaataaatcgaatcaacttttttctatctcggcccaaggaacctcttgatattgatatcctttcgcgacgtcctcactcaaatatggcagaagaatctattctcgatctcgaatatcgcggccgcacagccattttgacgatccataacgagcgaaagctcaacgctttcactggcgcgcagtactacgaccttgctcagaaactacgagagattgccactcatgatgaggtgttcactacagtaattttgggaaaggggcgcttcttttcagcgggagctgatgtgggaattactcgaaaagcacccggagaagacaaggactcgcataaacaactgctgcaaagctttgtcgccaacaatctaaacatcacccacgcttttgcaacccaccccaaggttctcgtcgttggtctcaatggccccgtcataggcctcaccagctgcgctggtcgcctttgccgactttatctactgcgctccttcaacctttcttctcacaccattctcatctatcggtcttgtcgccgagggcggtgcgtcacgggctctggcactgcgtctcggacctgcgagagcgaacgaagcactgctcatgagtcgccgcatcggatctcaagaactggagcggctgtggatttgtcaatgcatatatgacgagggcgacgacg

SEQ ID NO: 60413 - DNA, 866 bp, Triticum aestivum
  unsure (1)..(866): unsure at all n locations
  Clone ID: PAT_TA_60413
gccggccggttcggaatcattctgagaccatattagccttcttcttaactctagtaccaacttctatgcctgatcctgcatctgtaaagctctcatgacgaactccgttgcatttccacgttctgttatactccaagcattagcaatctcctccacagtttcagtttttctaacaaagactggagcggaagatgctctggggcaagcagtttgcccctctttctcctgtgggcatctccaagacatccaccatccttttcgattgcgaggggatccacctggttgtggtgttcaagaatacgagcttgtttgtagcgatggccaggctataattcaagtcaacacgggaagatacttggtcaccaacatctcctaccccgactctgttttctgggttgttgatgccaatttggataatagcagctgccctattcctgagaggaatcaacatccttatatccatggattgagatcagattacatgttcctgttatatatgcgtacggttaaatgggcttgcctttgtcagttgttcacggatgatgaaagatgatgttatttataagcccgtcgcttgccggagtacgaacacttcttttgtttatatgttgagtaccatgcaatcctatcaggttcagaatgttgagccttcatgtggatacttggccatgacccctttgnngaagnctggggtctggggccaaatgattattattcaacttatggttatgaagatattgtaaatttatgaggggaatggggtttgctttttagatttcctttcccagctccagaatggacatatccttgggatcctcaagacatgcnctgaaaatntcagggagcgacttccacaaacagacgtc

SEQ ID NO: 60414 - DNA, 772 bp, Triticum aestivum
  Clone ID: PAT_TA_60414
gccggccgggtcgggaacggggtggtggcgcagttggctcagcaatcaacggcgtttcccactccccattctccctctctccgatcgcccatctccgctcatatggccaccgaggtcctccgcccgcacaacatcctgcagccgcagacgcagaggatccgcgccgcgcaccggaggcccagcaaccccggcaccaccaggaggtctcctcctccaccggccacggcggtctcgacgaccggccggagacaccatggaaggccttcctcttcttcttcctcgtacgggaaggtgacgtctgcggccgctccggcgaggcgccccgcggtggaagtgtacgccggcccggccttctccgccgcgtcccccgagccgagctcgctgccgctgccgcagttcccgctccagaagcccgcggccgccgtcaacgacgccgccacgcgtgacctcaggcgcatgctgcgcctcgagtagctcgctagcccggtgccagctagtggacatgagctgtatgttagttagcaatcgtcgttgagtggtgcggccgcgcgcagcaaggcctctggctcggttttactgtgtggccggcggtatggtgcgcggaggccgtgggctccgacgacggctgtctggaatgagcacagccagcgatgtgaccatggaccggcgtgatgtaattacaagtagaatcccaagtccaagaatgcctacatatatgcacgaccacctccttaatcccctttggctctagttagcacgcagatgccaaatg

SEQ ID NO: 60415 - DNA, 775 bp, Triticum aestivum
  unsure (1)..(775): unsure at all n locations
  Clone ID: PAT_TA_60415
gccggccgggccgggaagacttggcccaccagtgttctacaaaatggctactcgcacatcacttcggcacctgggctgcgtacccagacatcttttcacctttcgcagatacatatcaactcgagatatgacagctacagacttgaagaagctcaaagttgaccaatcacgatttatggaagctttacacgacacttgcaaatggggaactggcctcaaatggggagacaaaccaactgatacaggcatgtcgcgtctggctctttcagattcagataagcaggtccgagattggtttgtcaaaaccacagaggacctgggttgcaaagtgacgactgattctatgggaaacatcttcgcagtgcgtcccggtcgcaaagaaggaccaccgacgttggcaggaagccatctagacacccagccttcgggtggaagatatgatgggattctgggcgtacatgctggtatagaaatgctcaaggttctccaggagcacgatgtagagnacagagtatccagttggtggtggtgaattggaccaatgaggaggggtgctcggtttccaatcagcatggatggcttctggagtctgggcagaatccattacccaagaaagagcacacagtctgaaagaggttgctggaaacgcaacagtcaagtcagagttggaaagaaaggggtatctttgtgaaacaccagccagctataaatcctcacccattgggtgctcatttcgaacttcatattggacaaggggccgattctttgacgagcg

SEQ ID NO: 60416 - DNA, 479 bp, Triticum aestivum
  unsure (1)..(479): unsure at all n locations
  Clone ID: PAT_TA_60416
gccggccgggtcggggcagcactaacagaactgggaattattagcatctgatcgagcaacaagccctcttgatctctcgaatctcgattcaccgagctgcaacaggcctctcaggtgcctgatcggagtttccacaggatccatggccatggagaggtttctgactgcgcttgtcttctgcgaggcgcccctcgacggctacggcatgtccatgatgacatcctccagggcggtcaagccgctggtgtccgctggctcgataaagccggcggctgctgcgcccaaggctgacgatgcgtacgccgggaagaagcctggattctgcggcgagacgaccacgcagcggcatgctgggcatgagctggcgttcgacggtctcaactgctttgaaaccgtcgtcatgtaccaagcatgaaaaattattgattcattgtatatgttatggacgttagaaaaaaaaaaaaaaaaaagggccctan

SEQ ID NO: 60417 - DNA, 733 bp, Triticum aestivum
  Clone ID: PAT_TA_60417
gccggccgggctggggggaaatgtgattaagcgattgatttattgtcatactacaaatacttacagtgttcgatctatctacttccaaaaaaaaaaaacccatggctactacgactcccagcatgggcctcacagccaaaggcgtcccaaagatgcccatgtggctcaccattgtccgcggtgtaactatcgccatgtccctaggcgccctcatcgctgcagcatacaacatctccctcatcagtagctgggctcgttactatggcggcagtggtccagctggcttgatcattttcagtgcaatcttcacatggatcatcctgggatgcatgctcgccgccgaattcttcgctcctcagctgtatatccgttccatcttcttcggtacccttgttatatcgtcgatcctctggctggccgcttggacatgggctgctgcgtggacagccgacttttaccatttgtacaacagctactacatcagtcgtgtcagtgagcttgatgcgtggggtggttcgatggctgctgctgtcgctctcggcgctgttacatggatcctcaccgttgtcactactgtcttcttcgtcaaggcttgcgtggctgatcctacaggctcaacgtttgtgcagcggcccaggaatgatccagagacagccaaacccaagcctgaaactaccgtcactgccttaaaaaatccccagaggaatcctgcttggttatgttgcaatgagaa

SEQ ID NO: 60418 - DNA, 656 bp, Triticum aestivum
  Clone ID: PAT_TA_60418
gccggccgggccgggaacaggccagcctacagcaacccaacgtcagtctacagccgcaggtctagttgatgagagaatagggcgctctattgcccttaaacgctgtctcgtatacgaatatgcgtaaaccccacaagaaatctcggcttggctgccaaacctgcaaaagaagaaagattaagaacgctccgagcatctaaatactatggatcttgagctcttccacaactacatgaccaagaccgcaaacacccttcacgacggcacgcaaccccatctttggtccgaaggtgcgcctcgagtaggattccagcataactgcatactgaaacttatactctcgttatcatcatatcatctggccaaactcaaacctattgataagccccgatatttattgactgcggaaacacatttgacgactgcgttgcagccagcgacggtattgattagtcgccttggtggagctaatagcccagctgcgtatttgacatccgtgctaatatgctttgtggctcttgctaaaggtccgagtcctgggaatattcttcttaccaatatcgaagggcacgtttcatggcttcatctccttcggggcgtacgttctgtcgttgaagtaacaggctggtcagggatattttcgggtgtactggcag

SEQ ID NO: 60419 - DNA, 818 bp, Triticum aestivum
  unsure (1)..(818): unsure at all n locations
  Clone ID: PAT_TA_60419
gccggccgggtcggggattttcaaaggcttctgctctgcagcctggagagcccatggccactccgcaatctcacatttaatctcaccttgttcaatgacaataccgtcctgcagggcgagtcgctcatgaatggattccaacaccatcatggcggtccaagagaccattgctgcccgtaattggcagcagaccggatgcttttttgcaggtgtctggctcgtttatatcgtcgccctcgtggtttggagactatggttcagccctctggcccatattccaggtcccaagctggcggctttgactcaatactatgagttctactacgactttgtcctgggggggcaatacaactataagatcatcgatatgcatgaacgatatggccccatcgtccgtatcaacccttgggaagttcatgttggagaccctgagttcttctcagacctctacaccagccccagccccagccgacgcagggacaagtggacattctacacccaacagtccggtgctcctcgtacacaagttcctcatccaaacgctctcgcagcccccaagactgcgactgaaggctctcttgctgccatcgaccatggccttaacaagttgcgtcgaagtgcgctgatccctctttacacaactcaaactgtgcgcgaactgcagccggttatcgaggagagagtggaagcccttctgactgcgttcatgaattatgccgaggtatccaatggcaaacctcttgatgtcatgtatccctactcgngcttgaccaatgacgtcatcaacgaatatgctttttgctcgaagtgaccatctt

SEQ ID NO: 60420 - DNA, 715 bp, Triticum aestivum
  Clone ID: PAT_TA_60420
gccggccgggtcgggatcgcaagaatctgttgctgctcttgtgcccaaggtccttgccgacggtcatgagatccgcatcttgatcaactgtgctggcattcagcgacgtcacccttgcgaagtcttccctgacagcgacttcaatgaggttatccaagtcaacctcaactctgttttcactctttgtcgcgatgttggcgcccatatgctaaatctagaaccgtcccccgtcaccggtcgtcgcggcagcatcatcaacttcggctcccttctgacattccagggcggcttcacagtccccgcctacgccgcatctaaaggcgctgttggccaaatgaccaagagtttcgccaacgagtggactgccaagggcattgccgtcaacgcaattgctcctggatacatcgaaactgatatgaatgaggctctactaaacaacccagagcgtctcgccagcatcacttcgagaattcccgccggcaactggggctcgccggatgatttcaagggcacttcggtgtacctcgcaagcaaggccagcggatatgtaagcgggcatgtcttggtcgtcgatggtggatggatgggtcgataagctgctgagccagactgaaaagaaaaagacgaatcataagagcagaacttaataactttggatacatatagtccaaatacccacatatcaagtcaaaaaaaaaaaaaaaaaaggccccta

SEQ ID NO: 60421 - DNA, 249 bp, Triticum aestivum
  unsure (1)..(249): unsure at all n locations
  Clone ID: PAT_TA_60421
gcggccgggtcggggatagagattcttgggtactcggattacatgtggatgttgcggttcgtgaaccaggggctgatccatggagaataaaataaaaatccgaaccaaacagcagaagcaaaaggagaagagctgagatcctagagcccaccggcgacctgacgatcggccggcaccgatggccggcgggaggaagcgggagtggatacgtaagaagatgacggcggnagncggcagcggggcgctgcg

SEQ ID NO: 60422 - DNA, 726 bp, Triticum aestivum
  Clone ID: PAT_TA_60422
ctgtgcgccgctcgaggcggccggtctcaaacatctagcctaaaaacgtacctatccaacttttcccaactatcatcttctacatctttccaataattcctctctgttcacaacacgacaacatcggctgttcccctcatattgacatcatggaagatcatcctgtgccatcatcctccctcgcatcctcgtcttcctcaagcgcggttatgctgctcactgcttcatcaacatccatcctacaaattactgcgttacattacccgggattagccactctctatacatcatcctcgaaaattaaaacttaacgcacttgacttctcagggtcactgcgcttacctaatgatctcaatgaacatccccgatttccaaacatccaccataagccgcccacgaatatgatgtcctgaaccatgccacatgttgtctaatcgacaatataccgatgactgacgtgaccaccgtgtacacacagtcttctgtcaacgctgcggtacaatttttcctctcttgggttcactctgatatctctggccagtgaaccacagcttatcgaggtatgcatgctacatgttacgacttcaatggacactatgcgatatcacctacttatataatctgatcacttgcatatgcatgcgcctgctgagatagcatctaaatgtatactgcactgctcttcctattaattaacttgatacccatcaatccgacgattcctt

SEQ ID NO: 60423 - DNA, 771 bp, Triticum aestivum
  Clone ID: PAT_TA_60423
gccggccggtactcaaaaatttattcttcattcttttctctacacatctgaatagacaccttcaagagcaaccatgtccaaaactacactcgctaccatggcctgcctcggcgcaggaggtggtgctgctatcactgccgccgtctactccattcgaggtggtaaacgcgtcgaggagaccaacacgctggctacacctcctccaaccaccaactccttcgccgcccttcctgctcccaccgcatcgccctccattcctcccacccaggtctttggccctcccgccggtgcccctccttccagcacccccgtcgacatcaacgccatagtcaaccccgccggcctcttcgaatacggcttccctggccccgtcgccgatgtcgccaaccgctctggtctcgtctcctcctacgaccgtcgtctgcgaaaccctcactgggttgtcgaacatatcactcctcagtctcttgccattcgagagggtgatcgaaagcacagcaactttgtcgaggatgagtctgtcccgcaaaagttccgtgctggtctgaaggactactaccgcagtggcttcgatcgcggtcaccaggttcctgccgctgactgcaagtggtcccaaaaggccatggacgacactttttacctctcaaacatgtgcccccaagtcggcgagggtttcaaccgtgactactgggcgcactttgaggatttctgccgtcgcttgaccgtcaagtacccctctggtcgcatcgttacaggccctctgtacctccc

SEQ ID NO: 60424 - DNA, 842 bp, Triticum aestivum
  Clone ID: PAT_TA_60424
gccggccgaatcgaagaaggcccgcttgcttcctgatctctggctcttttccaacctgtcttactctttgctcgtaacggttaacggatattatacctgtccatcttgctacttattcataaactgcacagcctgttactacgtcatttggttactcagtagcctgcctttatcactgctgctactgtactcagtattcgatcataggcgtattctctggggctatttattctacaaaaaaaggcgtctatccgtccactcaaattcggaccagcccaacaacaatcacacctaccactcataactcactcttaactcaattcaactacaaaacaaaagtcgatttaaatttcttacaaagactgtttcaaaatgctcacttacaattccacgtcaacaatgcccatcaaggctcccacaaaaccagtatccattgcattgtcgcccacaacttcgtcaccaatgacggcggcaactccatctctcaactcggccgccatcaacggccacaagacccaaggacaacaacacatctggctggttacgggccctgctggttgtggaaagaccactgtcgccgagtatttggccaagtcattgggtatgccctatgtcgagggtgatgctttccaccctaccgccaatattgaaaagatggcaaatggaatccctcttactgacgaggatcgatgggactggcttactgccctacgagaagagtccatcaaccgcttaaacgctggatcatgtggtgttgtcctcacttgctcagcactcaagcgcaagtatcgcgacgtcattcgtgtcgctggatactacgatcgccgcatccaaatccactt

SEQ ID NO: 60425 - DNA, 873 bp, Triticum aestivum
  Clone ID: PAT_TA_60425
ctgtgcggcgctcgaggcggccgtactgaatcctttcgcatctattccccacctctcattctgtttctctcaccagagaaatttctgccccaaacgctcattctctctgcttcgttgctttcaccggagcttctccctacccaacctagccccgccgccgacctgctacttcgatccaggggtgacggtggcgccgccgcacggctgtttctcccgctgctggtggtcgccgatgccggtcaggtgccgcgcggagagagcggtgacgcggtgcgcgtgcggtggagaaggcgccaccgcatgtcgccggaaatcacgagctgtgggagcgccgagatcccctgcccatgggtggattcggcgacccgcgggtggtggtgttgcgaccagcgcgtgacggtgctgggaccagcgtccgccggtgctggaaccattgacgtcagaagctacatccggtgactccgcgagctgcaacggcggtggccggaagctgcgatgatggtgccccagtgctacatccgtcgacggcagaagctacatccggctcctgcaaaagctacgagtggcccttgcaaaagctgccaccggcaagtctgacgggctacgagtctacgaccggcggcttggaaagcttcaaccgctgcatgcggaagctacaaccggcgcccgtagaagctgcaaccggcgaggtgacgactgcgatggcggcttagaaagctacaaccggcggtgggaaagctgcatccggcgcctccagaagctgtacccggcggcgcggaatgctggaaccggcggcacggcgtgctacaaccggcaaggcagcgtgctacgacggcaacgttttttttgctggatccctttacatgataatgc

SEQ ID NO: 60426 - DNA, 399 bp, Triticum aestivum
  Clone ID: PAT_TA_60426
gccggccgggtccgaacatgtctggcgccatgtttgcttctgccgccgcggctagcagcgccggcggcggcggcgctggcagtaccggtggctgtgccggtggctgctagcgagagtgccagaggagtatgcgcgcatgtactaattaattcattggcttgttgcatgtaatacatccctgtaattggtgtgctagctcaacctgccttccggtgtatattcttctgttctaggcttctactagctaggagtaatacaattgcgcagtgatactgtcacattcccctctattgtataaaccgcgacaagtttcatgtcgacttgtagttaaaccgatagaatgaatctacaccaacctgattgtttgatgaccaaaaaaaaaaaaaaaaaaggccccta

SEQ ID NO: 60427 - DNA, 596 bp, Triticum aestivum
  unsure (1)..(596): unsure at all n locations
  Clone ID: PAT_TA_60427
gtgcggcgctcaggcggcggtcactcnaacgaactcccaatctctctcttcagaatcccccagtcctccatcgcctgaggaggagaaggatgaggcaatggtgctgctgtacgcatgtgctcgcgactgctatgaggatgaagagaagttcgcgcgattccaggcctgggtccgcagcgagtacgcctccatgggattcgtggaggtcgactacgactacttcggtgagagggccgaggcgacgaggctgagcaaggaggcacgggaggaggtgttcagagacacggatctttcttcagacagcgaggacgacgacgagttgaagcatctcaagagaacagttaggagctgggtctgaaatccatagttctatctatttcaggtttctgatgctggtggcctgtcacggcatcggagctactacctcctcttgtcttatcttgtaaccctgctggtgcagcaattctttgtactgatgcccgtgtgcgcccatgtcgcaagaggctagtacgagcaagtattgtttgttcagtaaaaattgatataccggattgcaaggagtcagcctccaaaaaaaaaaaaaaaaaaggccccta

SEQ ID NO: 60428 - DNA, 878 bp, Triticum aestivum
  unsure (1)..(878): unsure at all n locations
  Clone ID: PAT_TA_60428
gccggccgggctgcgaacaccgatatatcacataccccgctaatctatcgaccatcaaaagccatggccgacgtcccgctcgttgtcatttcggaattcgcgcagtcggagcgccgaatcactccctcgtggtccatctcccagctcaagaccaagcttgagactgtcacgggagtcccgccaggttgccagcgactctcgctcaagcccacggctggcgcagaggctatcgccattgaggcgcctaacgaggatgacacccacttgtccaactttcccctggccccatatgcagaacttcatgtaattgacacacggcctccggcctcccgtatcaacctcaacgacactgcgggcgtcgacaagtatgtcatgcccgaggaggagtacgagaaaaagtcagactcggtgctggcctggaagaaggctcagaagctgggccgtttcgatcccgacgcccctagccacgagcaggccaagctcagcgccctcgacagagaggtcgccacgcggggcatcgctgtaggccgccggtgtcgcgttggcggtgaggatactcgacgcggcgtcatccagtacgtcggtgaggtcaaggagattcccggcggcctcgggagctgggttgctgtcaagctggacgagcccgttggcaagaacgacggcagtatcgctggcacgcggtactggggagagccttcggaactcaagcacggtgtctttgtgaggccggagcgggtagaagttggcgactttcctgcgcttgacgacttggaggatatggaggagatttagcatctggaggggaaatgcagggtagatgattcatttatactcaaaggacattatgttgctttgnngaaagtatgactgatacgatg

SEQ ID NO: 60429 - DNA, 368 bp, Triticum aestivum
  unsure (1)..(368): unsure at all n locations
  Clone ID: PAT_TA_60429
gccggccggttctggcaccatttcagatatgcgttgtaccctttactcctccgtgggtccaacgtctattagagatggaagattgaagtaaccctctcactctgcgtttctcagttgagcattgagctttcgctttttctgaagggcaacatttcttgattgtaaatctgtatcgtttcccttgtatccatgtttcgttacgttaaaatcattaaggggtttatgccactcattataagcgtcttaatgagactgttatgtcagtgcattaccgcatgcctcttcgaattggatctacggtaaggattttgtaactcaagctgagcattgtcgcctggaggtcatggcttanataaagaatgatatta

SEQ ID NO: 60430 - DNA, 813 bp, Triticum aestivum
  Clone ID: PAT_TA_60430
gccggccgggttcggaacctttaccttagtggtatcgtatactctagtctatacttcattccttgttcggcagaatgaagggtcttattacacaactagccctggcagtgtgctgttcccagacattcgccagccctgtgcggtcgaccagttctaagaacttggttgttttcggtgactcttactcaactgtcggattttggccaggaggacagctcccctcggcttccaaccccatcggtaaccctggactacctggtcaaacgacctcggctggactgaactgggttggccatgtcacttccaccctcaacacgtccctcatcttaacatacgactttgcctacagtggagctacaatcgacaagaaaattgttaattcgtgggcacaatactctatgtcagaccaagtaggcctatacaaacaatacgttgcaccagcggtcagcgacgcagacactttagtcgcgatctggattgggatcaatgatgttggtgaagcgttttggagcaagaccaacgctcttgtcacagaatgtgtaaatcggtactttgaacttttgcaaacacttgttgatgatggctttgacaagtttgttctgttgaatattcccgcgtacgctgatcagttcccaaagatgatcggtcaaccagcagttgacctggctcgtctgagggcggacataatttcctataacaaggcagtacagtccaaagcagcagccttcacttcatctcacccaaccgtcaaactacaaatctttgacaccaaaccctcatttgatcaagtcgtcaacaactatgccaagtacg

SEQ ID NO: 60431 - DNA, 744 bp, Triticum aestivum
  Clone ID: PAT_TA_60431
ctgtgcgccgctcgaggcggccggtccggaaatgacatctcgcctcgtacttaccgagtagatagcttttcaaacatcggcacaatggctaacgacagcaaagtcgacgtactcatagttggtgccggcccggctgggctgatggccgcagcatggatggctcgctgtggcgtaaatgctcgtatcatcgacaaaagaaataccaagatcttttgtggtcaggccgatggcctgcagtgccgaagtctcgagatctttgacagtctgggcttcgcagaccgtgtatggaaagaagccaatcacatgattgagatttgcatgtggaatcctggtccagatggcattattcgtcgttctgatcgtatccccgataccatcgtcggcctgtcacgttttcaacaggtcgtcgtacagcaaggtcgtatcgagcgcttcttccttgacaacatcaagaagtaccccaaagatcagataaaggttgagcgtgcagttttaccagaggccattgagatcgataagtccaacctcgagagcactaaagatcatccagtcacgatcaagattcgccatcttagtgaggaagaagcaacacctgctcaacaagccactgctagcaaaacccaggcatcggacggtcttttcagaagtaacttggtgtttgacgaccaagttgacaatgatagtgctctccgtaaagctccagatcgtgacgctgtcaccgagactatcccagcgaaattatgt

SEQ ID NO: 60432 - DNA, 861 bp, Triticum aestivum
  unsure (1)..(861): unsure at all n locations
  Clone ID: PAT_TA_60432
gccggccgggctcgcgagagcagcaagaaccacacccatcaagcaacatctcaaggcaacccaccattgaaacaaccatggacttgaacagtctatcaaactacaagacacctggtggtgccgtggtggctctgttggcctttgtaaccttttggtggctgacgacaactttgatcgcatggaatcgcctcaaacacatcccaggcccatgggtcgcaggtttcacctacgcgtgggcaggatggacagaatacagcggcaaacaacacttttcattcctggaccttgagacaaagtacggctcactggtgcgtataggaccagaacttcttgccacctcagatgtagaggtggtcaggcgcatgtctgcaagaaagagtacctatcgcaaatcatcttgggttgatggtgtcagactgaacccatatcacgagaccatgtttggcgtacgggatccaattgaacatgatcgaatcaaaacccgtcttgcacctacgtacagtggtcgcgacacgcctcatctcgagagtgttgtcgatcagcaagtgaacaatctagtttcactcatccgtcgcaaatatgtctctgaccctaccagtggagattttcgtgtcatgtccctcatcaaagtagcatcttatcttacgctggatgttatttccaaggtgggattgggaaccgagtttgngtgctgtgcttcagactctgatccatacggcttcactanagcagtagctgagctccttgaaagcctctggacttccggaaggcgaggccaagccgagacacttttcctggtcattgcaggatccgatactactgcggcagctattcgcgtcactatgttttatatcatttcat

SEQ ID NO: 60433 - DNA, 764 bp, Triticum aestivum
  unsure (1)..(764): unsure at all n locations
  Clone ID: PAT_TA_60433
cctcccccgctatcctattactttctgtcatatcttcctccaacaagagcattcagtctttattaaagtacgatccaacgacaggccattgactcattcttttggcttttatccagactattcaagcacgggctgaactcacaatctattcagataaaaaaaactgcacaaataacacctccagaccttcatcatggcttcttccgacacaccagctcttaagaacaaccccaagtttatcttctttaccgactttgacggcaccgtcaccaccgccgattctaatgactacatgaccgacaaccttggtttcggtgttgagcgccgtcgtcagcttaacaaggacgttctctttggaaagatgcatttccgcgacagctttgttgagatgcttgacagcattaagacccccttcgacgagtgtgtcgatatcctcctcaagaacatcaagctcgaccccggcttcaaggagttttacgattgggcgcaacagaacaacgttcctatcgtcatcctcagtggcgggatggagcctgtcattcgtgctctcctggacactcttctcggtcctggctgggacattcaaatcgtgagcaactatgtcacagcgcgcgagggcaagactctgaaggacgagggtggctggcgaattgagttccacgacgacagcatccacggncatgacaagtctatcgagatccgcaagtactcttcgctacctgaccgacctactatgttttacgcagggcgagggagtttccgat

SEQ ID NO: 60434 - DNA, 725 bp, Triticum aestivum
  Clone ID: PAT_TA_60434
gacggccgtgctccgcgtggatgagaagagagagtaatagcagcaaattacaagacatttaatacagtttatattttactctttcaacagttctaccaacagtttaacccatttaatctcttgtccaaccacatgctaggagcaaccactgccactgccacaaccagcactacagccatgacctccctatcaacagcccccaccgtcctaggggacaccactcttctaaatcaggacaccacagaaacatccaaacaaccagaggaagtcccatcattcacacctggccaatgtctcttttgctccacatcatcacctactctggaagaaagcatggtccatatgcaaaaatcacacggacctattcgtcccacagcaagatcatctcaccgtcgaccttgagacattcgtcagatatttacatctcgtcatctttaattatcgcgaatgtctttattgcgaaacttcgcgatcgacagtccaagctgtccagcaacatatgacgagcaagggccactgcaagattgacttggcagaacattcagagtttgccgacttttacgactgttaccagaccgaacatgagctatcagagggttctgtcaatgaatatggcagcaggaaagatattgatcgcaagccattgcaagtacatcaggattcgatgcgcctaccatccggaagactcgtctccaagaagtcatcagcacaggcagaggcatctc
